United States Patent 9,487,797 (GENOMIC PLANT SEQUENCES AND USES THEREOF) - sequence listing, part 34

SEQ ID NO: 60742 - DNA, 1808 bp, Oryza sativa
ttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtccgagtaggactccttccatccgtggactccatttctgttacgtgacggatttccttaacgtgtacaggaaacatccatatacgcgcaggtataccgtatctagggatgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgccatccctaaccgtatcggtatacaacatacatccaagggtaaagggtataccttatccgtaaccctggcagtagcccccgacttctgcttaaat

SEQ ID NO: 60743 - DNA, 4330 bp, Oryza sativa
  unsure (1)..(4330): unsure at all n locations
gccgtcccgctcggggagggatccgtccctggcttcgtccacgacgccggcaacatcaccgtcatcaaggccaccgtctccgcctccgccctcggcgtcgaccccaccaccgccgccaccgacatcaagaagtccggcgagttcaccatcaccctcgacctcgagaccaaggccggcgtcaaggtcggcggcctcaagaccaagaaaatcggcgtgctcgtccactgcgagggcatcaaggtggccgccccggcgccgccgccgccgccggcgaagaagaagaagggcggcgtcaagctctccgtctccgacgcgccgtctcccgccgcgtccgtcgacgacaccaccccctcgccgccgccggcgaccaccgtcgcgcgcgtgtgccaggtcaggatccgagtcaagatctggaagtggaccttctagtgacgtcgcccaaatcctaggggccgcattgcaaaattttcggggggcaaaaagaaaaggtgctttacttctttntttttttcttcttcttacgttggagtgtagtagaaattcagaccaaaatcaaccgtcggatgctgtaaaaaaatggtttctgtttgaatttgacgaaatttggctggggggagggaagaagcgaccacgccgacaagtgatgcgagggaggagtcttctttggagtgtgaggcttgatttttttactttttgtaatatcttggtgttagtgcaagtacaatttggggatttgttatttttagtaaatttgtactccaaatttatctgaatgtggcatcgcacgagtaacataatattcccagatactctttctttgaattacttttttactttttaaaaaatgtgtaaatgagatgagagagaggggtgtcggtgaggctccatgctagtagctgagtttgactgaattttgtacgcaagggaaaggtgtgagatattaaattcatgtgtagccttttcatgtgaagcaagcacaaatgtagagcacaaatgcggaggtgccggctgcagctgtgcaatgaattgcgtgacatttttaattccgggcgttacgtgacttgtgaagaattagtgggtcactagtcataacagtggcagtagtgtagtagcaaccgttaggcttaattgtgtagtactagaaaattaagagtttgatgtaaactaatcagtactggtacttaaatagagtaggtgttgagctgagcaagcatacagtcagatatatgagtatgcaacaacattaattaagctttaatatatgacaaatatttcactagctttatcatgaaaattgctttcatgtttaacattttcttggtactactcatatataagtggtactgtggtagagaaacaatgatcaaaacatagaattgctcatatgtagttttaatatatgaaaatgaatcggagcatagtttgtggtaatgagtgaggagacgattgtttaccgggattggtgaggccttaacataaaggtcaacacaatcattaaagcgggttgcatcttttcccaacacgtcaaagtgacaaaagaagccatgttgtagcaagcacagtaccgaagtacttcatccggtttattttaaacgcaatctacaactttgatcattcatcttatttaaaattttttataattagtatttttattattactaaataataaaacataaataatattttatacctgatttatgtttgtttttaaaaataaaacagacgattaaagttggacatagaaatttatgactgcgtttaaaatgggacggagggagtactttgctgtttactctaacacaatcgacaagaagccactaattaattgtgtcagtcgtgtgagatgagaaatgaagtagatgagatgccaaaccgtagaccaaccgcaacgagggatcctcggccgtgtgtctgattctctcaaggacgaaacgctagcttcttgacagcctacttgtaatttgacagcagacactccacctgtctttgctaacactgatcgtgcatactagtcgagtgataagcaattcacctctcagagatactgtagtaattatggttgtaaacgtgagatacctgtacttgtctgctgtatcggtgcaagccatttccgaccttatcgaagtttcatgctaagttgtaactaccgtgtcatgcaatgaagaaactcattatctgaaaacaaaaaatcatgaagtgaagaaaatcgtaactgcgtgtttcgtcctgaccatatgggcttattcatggtttgtagacaggcccaaatggtattgggggtaagaggccttgtgtaggcgaaggtttgtgattggtgttgatcaggccagcggcccagctactctcggtaccgtagagacaaggaatgaaagaaggaaacaacctgttttttggttttttgtatgccgtatacgtgacgtggagcgcatatatcggtgtaccagaagaaactacgagcattgttcagattgttgccacatttaacactatcaagctgtgtttagttccacatcaaaattagaagtttaactaaaattagaagttcaaagaaaaaagttgaaagtttatgtatgcaggtaagttttgatatgatggaaaagttaaaagtttaaaaaaaaatagaaaactaaactcggcgcaaactttcgtcaatgttataattggatagggtatcaaatcaaacatactttagccaatattttcttaccaacatttagtaatttcagaaacttctactattaaaaaactatcgaaacttaggcctcgtttagcttgcgaaaagaaaatttttgggtgtcacatcggacgtttgaccggtatcgaaagaggttttaggacacaaataaagaaactaattttataactcgcctagaaaccgcgagacgaatttattaagcccgattaatctgttattagcaaatcaaatgtaggttactgtagcactttgtagctaattatggactaattaggctcaaaaagttcatctcgcgatttccatacaaactgtgtaattagttttttttttaaaatctatatttaatgctctatgcttgtgtcaaagattcgacgtgacgtttttagaaaaaaaaatatgaacgaaacaaggtattagcaaggcatcaaaccaaatgcttccaaccttatcaaaatgtgacactaaaattagacgacaatcagaacaagccctacagctccggtcacggtgtgcctcgggacaggaacgacgtagtagtacgatctactgtatactccaatatatcggcagaaacaaacaacgccgaaacccctgctttttttactgcccccaacgtcacgcacttttctctcgcaacagcggcgcgcgccttgtgctacacgacgcgcctcgcttccgccacaagcaaaccacacccccacccacccaacccaagcgcccaagccacacacactgacacgaaccggaccacgaccacgacccgagcccgagcgtgagacctggtcagtcaacgagtcaaccgccttttctctttcccctttcccttctcatctcctcctagcggccaaaaaacccgcgccttcccgaagcgcgctaccaccactacgcggcgagggggggcccccggtcccacgcggcgccacgtggcgtcacgcctgacgcctcggcacggacggatgcgcggcacgacgcgccgcgccgcgccgtcgccatactctccgcatccgacggtggtgggtggttacatatacgtgccctccccccgcctacgtgtccggctcaaaccaaccaccagtccactactccactctcttctccacttggcggcgccgcggcggtggcggctcgatcgatggaggcggaggaggccgccggcggcggcgagcggaagcggaagagggacggggatgcggtgcgggatgaccaggaggaggaggaggagggggtgtatgagggcattgcggaggagtcggtggcggagctgatgcggtggctggagatggagatctcggatgcggcgccggagacggagaccaagacggagacggagtccggcgacgatcctgccggcgccgccgctccggggttcgtcaccatcaacggcaacgaggagagctgcgggccgtccttctccgccgcggcgtcgacggtcatggcctccgtcgacacccgcgccggcgcgccgcccgcaccgcccgtcccctggcccctccctccggcggcggacgtggtaccggccgaggtcgtcgtcgacggcgtgggggaggagtggctggtcgagctactgacaagtgggcccgcggtggcctagggagtcgtggcgtacgtacgcgtgtttttccttttgccgttttg

SEQ ID NO: 60744 - DNA, 4042 bp, Oryza sativa
  unsure (1)..(4042): unsure at all n locations
aagtgggtgcgggagatgaggcgcacgcgcgggcgtggctgacgtggcccggaggaggcggaggcgtggacgcggcggcggttgcgggcgcggcggcgccgactggaggaaggagacgggcccaacaggtggggcccacctgtcggcgtcccggggagagagggagggcggcttgggccggcccacaaggagaagggcgcgcgcggcggggtggtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactagggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtatgttccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcacaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggggcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaatttgaacggagtcaaacggatttacggttggaaagatattgaatttctaagattattggatttttggtctaaaggaaaaggatttaattaaatcctttttttttgaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcgcgcgggagggaggagagagagagccggtggaccgggctcaccatgcgcggccccgggtgggacccgcttgtcagcggctcggctcaccgtgcggagggagtacgcggctcatgcgcgcgagcgggggagggacgcggtgcacgcgcgcttttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggccgcgaatggacggcggccgggcggcggagcgaaccacggcgatacgggcaaaagctagcacaccgggcagttgttcgtgatgaggggagacgagccaacggttcggattcgccagagggagttcgacggcggcgaatcgcggcggcgacaaccggcggggagggaagagggaaacgccgacgaggtcacgagggaccgattcccggcggtgagagcatctacgcggtttcgggaactcgatgctagcgtcggattggacggagctacaccgagcaaggctggcgacgtgtgggtgctacggagctcgagcggcgacggcggcgagcacacggcgagcgacggcaacggtcggggcggcgccggctaactacggggagtctactcgagctactaccgaaagctagggggaggagatggagcgaggaggaagaacggagggaggcatcacgaggtgaggaggggcgctgtgacgagaggccgacggcgcgggagggatctctccggcatcgggccggttaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcttgggtttatagggggcggcaatgtcggtttggaaaccgactttggcggtcaaggcacgagctgtcgctccggctagcggccaaaacggcgacaggagggagggaggatgacgccggcgggaggaaaaggggaaaaaggagggagagaaaggggggctcgcccctttcttctttgggaaaaggggaaggggagcgggggcgtcgaggcagagggaggagggctcggcctccgtcccttggcggcttgcgcgcggagtggcggggccgaggcgatgacgacggcgatgacggcggggcggtttggagcggcgcgacgacacgggcgataggcgcgggctggcgcggtagagggtgacgggggccgcgaccagattggggcgtactcggcacgcgcgcgcggcttgaatgggagggcgcancggatggagaggcgcggctcgagcacgcgcgctggctgcggggccgagcggctgcangcgcggcagggcancggggccgggcggcgaccacgcggtgcgggcgaggaccacgtgggcgcgcgcgcgaacaacagcgcgcgggggccggctttgcgagccgggagctcgccagggagaggagaaggaaagcgaggggaggaggcgctcggcgcggtgactcacgcgcacgcgcgcggacagagcggaggaggaggagcgctcggcgcggctcccacgcacgcgcgcgcggcgcgcgggcggagcggagcggagctgagggagaggggagagggagcgcgccgggaaggggagggggcgagagagagcgagagagagggagagagagcgggagcgcgccgggggagag

SEQ ID NO: 60745 - DNA, 736 bp, Oryza sativa
cgtttttggtctcactactataggcgaattcgagctcggtaccctttccgtctcttagagcatgggttaggggacgcattcgcgaggatgtgagcgtggtgttgtgtgtatgcacctacttttggaggttaattaaaaaaatgtgccaattaacatctgtatagcttattagcatctgtgtaccggtgtgaatagctaagtgatcgtctcaatagctgacatgatgctctacagttttgtcaaaatcatcggtggggtaccactaacacagaagaataagatgctgaattttattctcttttatgccctaagataaagtacttcctctagtccaaaaggaattaaatccaaatgataaatctagatacagattcatttttaggatttaagtttttttttaaatagagagagtaggaaacatagaagctgacctgtccatcaattgtagtcccagagcagtgaggggtcatagcatgattgggcatgtatcgccatgggtgatcctttggtgctggctgggggaaccagacgtcaccaccatatcctgacaacacaaggatgagggtttgttctttcagagacagctaatttacataggtgcacaacactctttttctttctgacaaaattttcttcaataatttgggaaaaacaaaatatcatgcttgacagatatactgccttacttggttattcgagaaaaaaaaacagaatactgccttacttggttataagt

SEQ ID NO: 60746 - DNA, 1490 bp, Oryza sativa
  unsure (1)..(1490): unsure at all n locations
agccgttgggcccacactactatgggcgaattcgagctcggtacccctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaccaataccaggattaaaatattaaaataactttcacccgttgcaacgcacgagtattttcctagttatatcaatatgcgtctgatccattacaatgtgcgggcatatatctagcaaaagtaaaaaaaaaaaaggattgtttgcaattgtgaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatcctaattatataactaagtgggggtgtaactatggtgtaaatttatataaatagggtaccgagctcgaattcgcgtgatagtcatcggatactcactngcact

SEQ ID NO: 60747 - DNA, 9613 bp, Oryza sativa
ctttgatccgacatggtctcttataccaccttgagaaacagcataaatagttttggcagctgcagtttggctttcagctgacttggacctgagaagagcaagcaagggagggatgcaaccaccaagcagaaccttcacccttagctcctcttccttgcaaagagaccccaggacagtagcagccagcatcttaacaccagatgaaccagatctaaggagagaaacaagtatagggacagcctgtgcatgtgatccaacagctccaaatgtggtgtctcttgtttcaagaagatccaataactgcttcagggagttctctttctcttgggtggatgaagaaccttgccttaactgctcaatacattgagcaacacttgaaagtgtctcctcatcctccacattggcacggttcctgcaattacaaaacaattatgcttggcaccttggctatctacatatcaggataaattttataattaacatactgtaattaggttctaaaagatagcattatcaaggtacataacatattctcagtgataacttgtgtgtcacataaacccttttttcattatcttcaatatggtgaaagtgaaggtcccggaaatggttctacggtcatgatttactcacaaattagaaaacctattagttatacaaagtttttttttggctaatttaactgctatggctgagctcattttcccgacttcttcatgctattgatgagaatttcacagtgcaaaccaagaaatggaatcaaacttacttgaccattctcatcactgagacaggagttggtggctctgactcttgaactttgggttcctgttaatatccaagcaaaggtagttaatgttgagactcaagcatgcgacacaaacataaattttgaactttacataagctgatgcatgccacaagtttctatgccatgaatccttaactttactaaaaatgctgtgtagatcataaaatcaaattgctgacagacacttgattttataagcataaaataaagttgaacaagattgcaatgagggaaataacagataagaaatataatatgtgcattctcaatcaaacatggatcccagcactaagtgaacattagttttagtagatcaagatcatgcacagatgaagtaaaagatatgcagcagctctatatatacttatgtattgcttcacccaaataactgcattacacaataaatcaaacagcttcaacttagggcatttgcgtgggccttgtgtttgtaaaacagcattacagagccattcaatccattattgtaccattacctgcataaacactaatgacccagaagcatgatatctctcattcttggcttacctacacagaaaaaatagacagcgataaagacgtagacaagatctcctagactaatagaccatcagttgcttagcaaacctgattagtatagcccaagtatgatagataggcctagcgcaaaagctttaaaaaatgcagctgaaatgaagatccccaacgcttaaatattgacaaatatgcatggacatctttttctcaagtagaccgaacactgatctcactttcaaagcatatcctactgctatactattcaacgtttcacccccatgatgtccacatcagaaacaaacgcaatccaaataactccgttaacgtagacgacagcactcttacaattcaagcgacgctaagaaagtgacatgctgcaattctactagctcagaactacagcaccgaggagagcaccaaccagatctgcgcctccattggttccattgaaccgccatgctaatgccgccgccatgtttagctgcaaccccctttagctgagcagatcagaatatcccccacttcttcagtgcaaagctctcaacctgaaaccgacacaagagcaaaacaaaggcgcatcagatccaacacaaaatcatccgatcaagtgaattatacatcaaccaagagcagattccgcctcggattaaaccaatcaccgacgcgtaaccccagatctagcacgcacgagcgcaaccgctactcccaacagccgccgccaagtggatcgcacccacctctcgaatcaccagactaccaaaccactcaaaaagagaaaaaaaaacaccaccgctgcatctgcattccccgcgaattccccccactcacgacgcgcccagccagatcacacgctcagcctccgcatccaaactccggcaacccgccccaatcccacccccgtaaacaagccgcaccgcactaaccgccgccattcccccatcaacccagccgcctcaaccaaaaccgccaaaaaaaaaacagcacgaaattgccgcggaaggagggagaagcccaagtgcccacccaaccaacctctcatggaatcgccgcgacggatgagcgagattgtgcgaacaacctcgccgcccgaggatccgcgccgcgctgcttgcttcgccgccggctcgccgccgcagatccacagcgagaggagggaggcgccgagtctgttactctgccgcagcctccaccgcctcctctcttttttattttttttcccccggcgatttaattccgctaattaaaagggggcgtggtttatataagcgcgtagtgagctctctctctctctctctcccaacgactgccgacagtggcagtgtggtgtggctgtcacttttgcaagataccccctgcataatttagcatttgcaactatagtggtgtttgttttactgaaaatgaaaatgaggttagaactcgaaaaataagaaaatcattatctcacgattaattaagttttgattattataaatttaaaaaaatggttttatctgatattctaaagcaacttatatatagagagatttcacaccaatgcactgtttagtaatttgaaaaacgtgttaatataaaccaaggtaaaatatgtattgttacttcctccatccaaaagtgtttaatacttattcaatattttggtttttttaataagttggtcatactcttagttttcatatattaaagacttaaataaaaagataattaaatgttttagcgaacccaagaatttattggttacgtacatgcatacactctttaatatttgttatatataagatgaattaattttactttgatcttggtgataaaagtaatatgtctatttttcttaggaatgggtaataagaaaatgaaccaggtctgtagccttctcagatactgtgagggggtaaattgtgaaatttgggtttgaaagggggttgtgggtgatgattgtgtatttagattttgtgattaaattaattaatagggatgtggaattgttaattggggagcacactaggctggttgagatggtagttgattagtgccgtctgcataggctggaatgggttttgtcttgtggaagacaaaaaatcaacaggtgggagaggtatctgccaccttccaaatagctgtaaaaccagtgcccacgaggaaatcgaacacaaacagtttgtcacaacacgttcttaaaaaatcagatgaaattttggtgccaatgtgtttcttttttacaagcattacatattttcagttgcacttttcttttgaccaaacataaatattatacgcaaatttatcgtgtactataagactatgagtcatacaacgcactgtttacttggacttatattgaaatcgtctggtcaagacattgccctattatatatacaccaattttcttaattatgtccttaataaatcttgagaaattttcttggttctaactacgattcaatatttgttagaaaattcatgtgaacttgttggtgttgaaaatgggtcatttatcaaggtatcagccaatggcggtgcgtatatgcaaatctatcgtggactgttgagtcatagagcgtattgtttacttggccttctattgaaattgaaatcatctagttgaaacattgccatgaatggttttcttgatggccccaaataaacctcattccagaagtgagaaattttctcagttctaactaggattgaatatttgttagaaaattcatgtaatattgctgtgttgcacatgggacatcaaggcatcaaccagcagtagataaactatatatgctaatgatgctcataaaacaacatctagttatcagtgtttcctgtttgatcggtgatgattacttaaaaggcatgctagttcctgtcctacgtaagctttagaattgcctaatcagaaggatgccctacactgccgtataggtgtctggaccatatatacaactctgcaagtgaaaatacaatattgtcctcggggacctcgattcacatgtgcaagagatgatcaaataatgctcatcaattattgaccaaggcatggttcacataattaaattaaacagagaagcttagtgctagagggtgttttcactgtacgtattctactgctgtagcttgtaaaaatgctagtagaaacgatataagatgttgatctaccataagttttatttaccagacaattattttctatatgatggtgatctccgatataaaatgtcggtgcgtggtggtgttttttttctttttcttgattatagtcttctaggactatatttttgttttcggaactgctacataaccgtcgacagttttcttgagtgaaaactgtcaaatttattgaccatcgattccgctctaagatttgtaccgagatattttactatcggatctaaactctcttttcagaagctagtcccatcatctcatgtttatggtagatttgtaagttacattctagttatatgctagttacattatagttacactataattacattgtaattacattgtaactatagtgtaactatactataactacattgttatctctatataaattagatataaagttgcatatattattttaatacatatatacaagttattattattatagtatagttatagtgaaattatatactatagttagatttgaaagtttttccctaaaaaaacactcgacagttttgtagctagtccctttgttttttttcttgctgtatcgatatgaaacattgtaccgtctagtgttgtttgtttcaaaagaaaaatactcttctaatatataattggatcgaaagtagtactcctcactctatttgatgtttataatgatatttgttctttgtttagaattttgactatcgataaatttgtctcgagaagcattatcacaatataataaacttgtgtttataaatttattttaatataaaacttattgtcaaagctctaaaatttcagtcaaaatcttagcatgttctgaccatcaaatagtgaacaattacacagacgatgggtgtaataattcttgaacaattacacagaagtatttagcaatattctttttttttcatctttcctcatctctcttgtacggtcgaggcgggtaattaattacccgggggattattttcttccacggcgacggcgaccgcgcaacggccggggccccgggctctcgatctcgcgagagttgcaacgttctttgggtgaaggagacggcgcaaccgcttgggcgaccaggacatgcttagctatacgtgcttaactaattcgattctgaagaggacgaaataatgacgcgtgtttaaataattggtgcgagcgcgagttaatcttggccgcatttggatgcatggccgaatattttctcaaacttccaattcagatttgttatttttcttttttcagatttgggtgctgctttctttgagctagaattccaactgttttggggtttggcttaatcagtagaattatttgggaacagtcggtgtactcgctcgcaggtgtgtacatgtatactacaccaattaacacaagtcgtctttaaaataagatgacacataggcaagttctttttctttcctctgtcccagcctgaacaacatgtggatctgacgatgatggttcagcttagctaattaagccagatctaccctttcaggctttctcttcttcttctccccttttactttctccttcttctttccctcttcttggtttcttgccatggactctccgacagtacatgcacacatctcgcctccccatcacactacatgtctgcatactgaaattggatgatgatcagacgggaggaaacgatatcatttctatgaaagatatagtctcggtacagtcgagaattttattcatcaatttaactatttattagtaacaacttcaatactacaacgctaacagatattagaaaaatttaaatctaatatataacttgtatcagtaactgtatcatttttacaaaaacgaacttcgcacactcgggaattttcgccataattttcaccctagcagcaacctgaatacaccccaagtgacactcaaagagctcgatactgctgggtagattgagttgccatctcagctgagcaattcgatcgactgctcgctctgatgctatctcgccaactaaaaaaacgctccgttttccaacgaatccaacttttttcttctcgccatcatctccatctaccgggattgacctgacgaccagcaaatggcaggtaggtaggcaggacattcttggctctccttagctctctcgcatgcatggacaattggacatcctaatccctgaacaaatggcgatgtgtcaaaatccactgatccttcattcattcattcagctggagggcgatcaacaattaatcaaattaattaattcctcaggatcgatcatatgcaccaccatcttaattaaacgtggctgaagtgttcttctgttttgtccataacaaggtcactgattaagtgccactactggttgaattagcagcacgcagcagcagcatccagtggttggcgtgatgaggaaattaaagcagaaaatttcggatttcagatttcagggacactgcagctgtgatcttcttcttttctctgcatctttctttttctgcgtgcatgtgacggtggggcctcccgggaacgtgcaggtacagttggatgtagctgacggccatgagggtagctagagtacactgcgaatagaagtagaatcttccgcatgttgctcagaaaagctttcagaattgaatggttggtgaacaatgaaaaccgactcgtgtatacgtactgaaccgtgggatgctcacagctcagtactgtgcaagtgtaactgaaaactgtgctggtaacttggaaccagtactacggactgtacaagtgcagtgcaggaggtatagggactgttcgtctgcaatttacagcacagccacgacacagccggctgatggctactgctccctcctccgtcaaaaaaaaaaaaccaacttagaatctagtacaataaatctggatagaaggttgttcagatttattgtattaggaggggtcacattccctcttctcctaggttgggttttttctttgacggagagagtatttgctgcaggaatcaaactgaatagagggtttgaaagaatgctgtaaatggcagccgaacaactctatagagtggactcctttagtacaatggattttcctatgaaatttatagggttacatttttcctatgggcccgaggtttgaaatattgagctataaaattttcataggaattcttcatttccttcattttttttagtttcaaacataagtttaaaccttgtggttttgattttctttgagaagttcaatgcaccatctctcttcatctctcctctcagctctagtctagtaattagtttcctgtaaaattcctatgaaatatccaaatggcccattcgacgaattcatgtgtttttattttctatacgatttcatatgccatggtattcaattcttgtgtgtttttctcattctgttttttcaattcctgcattttcaaaggaagtctgtaccttctgttctaaaaaaattctgttggagaatatagtactactatgaagctatgggcaaaatttgatgtccagcatagaattcaccttttctttttataaaatgtaagtaaaatattttgtaataaatggcagtgctgttgtgtgcaaaaagaagagagctagtagcatttccacaaagaggttcgaatgtgaaagggggctcagctaagtttgcgtgtcggtgtaaaaagtggagtccatatctcagaatttgtgatgcacgcgttcgaaggctagaagttcggccccgtttacatggtgccttcaattctgggcttcccgcttttccggcccaattgaggaggagaagagaactcccaaaggacaaagaaagtaaggcccaacttttttttcatcctgaagagataaagagaaactcaatttttcattcatgctcttgtaattaatttcaactttattgatttttaaaaactgtgtcatgtagaacgagtggacaagaaactcgtgggaaaaaaaactgaatatcatacatcgctggaattggagatgaaactgatgtttgaatgctccacattctgcagataatttagagataactacccttaacaagatagagggggaacagcacaaaatgcaatttcagataagtattcagtacgtatgcatatacccttgtaagttagactccctcactccacaaacacaagggatatctgaggcttcttcctttatccacaaatataattcatttatccacaaatataaggaatttcacaatactagtagtattaatttcccgaatccatctagtagtagttgtatcgttaagcttctttttctaatcaagtagactggcagttgtatatatcgttaggcatcaaaataacttccctcaatcttaaaatctactaaataatcgagaattaatccctgtatttgtggatggagtaagtatataacgcatacttatccagagatttcaggtactaggccggcttatcttgtgtaaatacgtacttataattagctgaagatatttcaggtgctagctagagcttatcgtgtacttagctgaagatagcagattcactctagaaccctaagcacagcaatgcaagttttcttatcaaggaaatcaataatctaaccccaaggcaagttttttttttcgattcaattgaacctttccatcaagatgtatcaaatatccggccaatatcaaggcaagtatacatatcaaattatctgaatttcttttttccaaggatgaaacaatcatccattgacaaacaacaaactctctccaagcatgcagcaaagtgcgacctctctctatccggtatggatctcaactctcactaggatgatgactacaaaattctctctttgatgatccctactacaaaattctcactctacgatggcaactacaaattctttttctttgatggcaactacaaaattatcctacacggccacaaaaattcccctctaggatcccaagaaatgcaagaacttcatctcaatgcaccatcctgggcaggatcaatggcatcttgggcagggaggaggacgcgcggatcacgtcctcgtagcaaccctccgagcacaccagcggcggcagcggcgccacagccgggtgcagcgacagcgacggcgagaaggcatagcccaccgcggacagcat

SEQ ID NO: 60748 - DNA, 13853 bp, Oryza sativa
agctgatatccataaatgaatatgcccactgctaacctacatgactaggcatatattccaacatatacatactcacatctaaccatcaatcaacaaaagaaaatgcaagaagtcttgtggtactagtactgttggacagatagcgattaaacaaaagcaagctagtaatatttgtaggaggagataaatgatttgcaaattggaaatattatgtacgggggtgggccaagtcaagatgcggatggagggggggtgtcaggaatttctcgctgcactggcagcttcaccactgcatgagacgctctcctaacacatgcttatgataaatagactagaggtgtgatttaaaaatttatttagtgtgatctagatgtgtctatgacaatggaaaaggggagtgtgtctactgctctcttttcaatagagttgtctcctcacgctctcctagacgtgtctatgatagatggctagaatgtgatttagcgatttaattcgatccaagtgtgtctatgatagatagactatggatttgatttattggctaacgtagtgaattttacagccatataacatgtcacaactatatataatattaaatagcggggtaaccattttactatttgtagcaggatgctatggccaccacaacaatagaatggttgaaaacagctagcatctagaatgtagcagctgcaatagtagtggtagcggcaatgctaggaggcactattaaattaagttcataggaggctatgagataagcattgaaaaaatgtatataacatttttgcaacttcttttaaatatatgcctattatatcataagcgaacacatattgtttatctcaatttttgagtgtgtatcacataaatcaacatttttttgaagtccatgcctaatgtggtcataaccaacgagtctattaaagattgtcacatgttactagatcatgtcatcctggatcatggcgatgcttctatcaacacttgccatgtagagtttgtcaattacttcaaccatgaaaagtataaagcgaatgcatggatctttcatgccctattggtatgcaatgttacggagctcaagattttagtttggtttgatgatgagttcctcaaggatgaccaatccggttatcatctccaagcagttaagaaagttggaacttgattccctaaacctaaaggataattttgttgattcactacctgtgtattcttggaggaactataaatgagttatcgtatcatctctggaagtaagatcatacgaaattcaccgtagcatctgagaatggaatatatggttttcagggcacataaggttggtaatttgactatccacattcacatttgtgtcccaaaccttgtgtcactatcaccggtttgatttgaaggctggacaccactatttgaaagcatgccatatttggtatagagtaaagtgcatgggcagtccctaaacttggagagctatgtcatctaggtccccaaacttagaaaacacatttttgggtccctaaacttgcttagccgtacatcacttgtccaaatcgtatttgacccggtctgctcgccaatgtggaggggcagggacagctggggtgtcaaatatgcaaagaaccccctattccctcatcctagaaatcaaatcgaatcccttgtccccatttttccccaccatcctgagcgacgaaatccctagcaagctcttcttcaattcgacaccctcttctccgattccctagcggcgctatggcgatgtcaagatcaactggagctgtgcgctgttcgtcgtgtcctaccgtggctacagcaccaaaaacaaccctgtcggtgtgtggccgtcgttggatccactaggagctcgacgacaccaagctcggcaccgtcacctacaattactgcgccgatggctggtgtggttacatggaatcccattgattaattgcgcctaatacatctgagaataaaggcagcatcttttacattaggttatttcttctctcctgttgcagagcattggtgtcttgcaagcattttgagtttacatgtgcaagttttatcagcgagatggaagtggatgtatgttttggtattgagaggatcaatataaggagtatttgacgaatacaggacatcttgcagcttctggtgtccatccgcagtgtccagctcctgttgtgcatgtgcagagatatgcattggtcaagcagggttcagagggacatgaatatgctgcagagcaacttgttaggaagatgaactagacattggtagggatgttgtcctgttactaaaatgtgtagtagcttgttgtgtatttgttgtggtgaacaagatgtatgacatagccctacaagtttagggaccgcccctgcactttactctttggtatatgtatttgtcgtatttaacaatgcatgttatggtgcgtgtatatactcgaacttttgagaccgtggcgatgaagcctgtgagagttgctatgccattgttgatcacaaaaatggttactgctttgctagcaagcactatttaatttaagttcataagaggctatgatataagtctagaaaaaatgtatctaacatttttgcaacttcctttaaatatatcgctattataccataagccaatatacattgtttatctcaattttacattgatcacattaaaatgtgtatgtatcacataaataatgggactagctatacaacacattaaaatgtgtgttactattttttttgtgagaaacacttttttttagagaaacacttccaaatgtaaatatactataattgtagtattgtttgtaattacaacttgtatgttaacttgcataatgcaatgcaagtgcacaaaagtggcactgctcaatttttcttacaggattgtcgccgcttagttagccacgagcgtacttgtgcttgccatgtcatgggatcgatccccaccattgcacacacttctgaattttcccgtctcgcccacatgaatcttgatgtctcactcgcatgaatcttgatgtgaatagggccgcccccgaggcgcgtgcatgcgaccgaggcccccaaattataggggccccgtggctgatggcccatggcccatgggggcatccatccaacatccatcgccaggcctggagcgaaggagaagtgatctgactcctcccatcgcagcgtcgcctcgatcacgccattcgcgtcgccctgacgcctcgatctctcggcgtctcgcgtgactacgtgatctgccactctgcgtgatgctgtgatctgctgctctgcgtgtctgtgtcatctcattgtcgagggctcgaggccaaccgcccggcggccaggcacctgctgctctcctcagctcctgctcctattgctcatcggccgatcggcaccagcgcgccaggcgcctgttgctcctgcttggcgctcgcggtcgcggctcaccacgctcgtcggctcataggtaaatttcatctggtaaatttctctatctttttttcctcttcataaataaaaaattattagctcatgatgatcattttttcagcacaacattaattatgttatcgggaaaatatgtatctggtagcgaaaaaaggaaacggaaaaaacactcggatgatttcattgaaccacaacgaggagctattgacagatttttcacaagtaatgctaatgcatcaatgagccaaattctagaagaagaggttgctgtagaggaagatgttccaactcatgagaatttagaagaagaagaagaaaatgttgacatcaatattataatcaacgactttgtatcgcaaaatgttagaagaaatttttgaaagtgccaagtgtttatgattatgttatttctctttgaagttttaaaatgttatatataggtaattttgtcacatcgaatattaaatgttgtgtgtttataagactatataaatatatatattagtttatgtatatatataggggcctcaatataagttttcgccctggggccccaaaaacccaggaccggccctggatgcgaattggcagtccacggatagacatttttccaaacaaaaaatcgtcaacaatttttaagcatttccataaataatctaaattaattgtttccatgaaagtcatcgggacctatccactatctgccataccaaatctatatataatccacaatttcctattgtccactatttagtgccttaactataaccaatatataaatggtttcagagcatgcgattttttgtatgtgaatgtctccaatttcacttatgtggttgtataacaagaagtccatatcatgttagctaggttccttaaacattagctatgttctctagttcatgttgtcatatcatatttctttcttaaaacaacacagagaatacacgaatagtggttttattcttttccacttttttataagaaaaaggtaagatatataccattgacaacataattaattttacaaatcttggtgtagctagatggtcttcgtcggagggattagctatggcacacatgggaaaccatgggattgtgacgacaaggggttttggttgtgcttggtatgcctggaagtgcttgggaggtaagaacacaaaagaagcatatatgtttagcctcccgaaggataataacccaactcctttctagatcactattggtgaaaaatctgtagaaagttgggagttcttgagcttgctagcctagttcttgccgattctagaagccaaccccctctaacgagctctagtcgggcttttataccctaccacctctctctctctctctctctaaatagtattgtacacaatcattagatcgtttcaactcttagggtgtgttcgcatgcccttgttctcaacctcatctccctcgttttccgcgtgcacgcttttctaactgctaaatagtgtgttttttgcaaaaagtttctacatgaaagttgcttaaaaaatctaattaatccatttttgaaaaaaaaagttaatacttaattaatcacgcactaatggactgctccgtttttcgtgcgaagggaatggttcccatccacaacatacaaacacagccttagagctccacgccagttttgctgtagaagcaaaacttcatatgggactccgtgttgggcagacctgtagggtcttgtagtttccaccacaatcatatgaaaataagaacttagatacgggctatctcaccacattaaatgaggtgagacaacttgagagaatctgtgcaaaatataaataattatatgggttagatatgtgctatcttgtacatggagatttctagtggtctttgtgcaaaacagaaggattggcatcaacttttgggactttttacaggggcaaccaactatggggcaaatctataagtgtcatacaactttggtgcattggagcaaaatttgcaggtataatcattgtttaaatgggcaaatagttaatatccttgtaggtacggaagaataatattctacatttccttacccttacatctgtcacatgcttgtctatgtgttcttcattgtatatactcccccacttatccatcaaaatggctgagtagtaaaaaaaagttaacaatggggccatggaaactgtggcaccaacaacaacgatctcccaagtgatgtcctagagtatattctctctttcttatcaacacgtgaatttgtgcagacatgcgtgctctctcaaatgtggcgctatatttggaagtttatgcctaatgtggtcataatgaacgagtctattgaagatagtcacatgttattagatcatgctatcttgaatcactgcgatgcttctatcaacacttgccatctagagttctcaattactttaaccatgaaaattataaagcgaacgcatggatctttcatgccttgctagtatgcaattttaaggagctaaagatttctattcggtttgatgatgagttactgaacatggctaatcgaattatcatctccgagcacttaagaaagttggaacttgattccctaaagttaaagtatatatatatatatatatatatatatattttatttcactagctaagcattcttagatgaactataaatgattattgcatcatatatggaagtaagatcatatcaaattcaccgtatcatctgagaatggaatgtatggttttcaggacagataaggttggtgatttgactgtctacattcgcatttgtgtcccaaaccttgtgtcactatcaccgcttcgatttgaaggctggacaccactatttgaaagcatgccatatttgttatctgtagctatgatatttaaggatgcatttatgtactctaattgttgggactgtggaaaggaagcccgtgagggttgctatgccattggtattaacaaaaatggctttctacttctcaaccatttgtcacatactagtcacttgtcaatagccatttgtcacatactactcaaaacaactagcgtctctgcaatagcggtggtagcggccatgatagcaggtgctatttaaaggctaagagacaagtcttgaaaaaatatatatacaacatttttgcaacttcctttaaatatatgtgcattataccagcatacattgtttatctcaatgttagttaaacacattaaagtgtgtatcccataaatgatgggactagctatacatttttttagagaaccactttcaaatgtaaatatagtataattgtagtaattcaattacaacttgtatgctaatttgcatgcgaaagcacacaaaagcggcgctgctcagtttttcttatgactgattgacgctgctttgttggtcatgagcacacacctgcactttccagctcgtgggattgatccctgccattgcatgcacctccgaatttttttcatctcgcccacacgaatcttgatgtcttgctcacctgaatcttgttgtgaatttgatagtccacgaatcgacaattttttcagtagatccatataaattaatgttttatatgaaaagacatgggggcttatctactatccgctataccaaatccaatccactacatcctactgtccattgtttagtgccttaaccataaccaatatataagtggttttagagcatgggcttttttttacgtgaatttctctaattttcacttgtgtgtttgtaaacaatgaagtccatattacattagctatttgtcgacgtggaaaacacgcactagcctaagagatttgctttactctagtgcaggtccaaagagatcactttcgggttcagggcgtgccagttggtttgatcctgcaaccaacaagaaacaaagaaaccaaagttaaatccgtaaaacgatagtcgatcagctggtttgccgatgacgtatcgtttgtatcgggcctatgcgatatggatcagatcgaccatgtagtgtatggcgaagggataattgaatgtgctctgtcggctgtagatgtcagtaatatatgatctatgctttgaagtactcttaaactaagtgattaggatagatcggtcagcgcaccaagacaatataaaccacttgaattcaagaacgctttaaggcagggattatatatctcgcagcatagccgacaggcatcgtcatatcggctagtactccaataccactttataataagatttcgatatagatcaaatatgctaaacaataatcaatctagtgtcagggtaacccgatagactgatggcaggcttaatatatttggtccaaatgagatcttaatgtaaagggcagatttagcatatcaggtaaacatacgaggaacgagataactaaattaggtaagatcggctgaaacaccgatgctatctctatcgacaatcataagacaagctagatattatggttctgaacgttacttaacagatcaaacacatagagaaacataagatctaaacaagtctatgaaagcctttttgagatggtagatatgctatgtaatctagttcgttgcggctatttaaccctatcggctgttttcgatgatagaggctagccgatgagattatatagctagatcgatccagattatatagcatatatgataactcggcggtttacatagatggggctagagtgtcatgaagatgctagcactagccccgagaacgcaagccgccataacaagctttacctcttcgtcggagatcgaaactgatgcatcccaactcgaaagtaagaacttgtcgaaaacaaagaaagtaaaaagggtggtgatgcaccaagagtgtattgaactttcaatttttttgtttacagggtctcgggtcatatttatacccaaaatacatgatatgtccttgccggacacgactctatctctattacaactcaaaaatacgaacaagtcccttaggcgggctcttaacgaaaatatctataaggaaactatcgaaatatcctaattaatagatgcaattgccttctccggactcaatctatgcttggcaatacttgtgtagcacttgaaccgatcctaacaacgataccatgattgtctcaccgggatcggctacatcggcttctccctatctggttcggtatcagctgatgcagatggtagccgttgcaacccgtagccgatgcaggttatgtttccatgattatcaagttcctccaaatccactttggttctgacttcggatccaatctatgatttaccaaattttgtcgttaacactagtctccttaacactagctatgttctcttgttcatgttgtcgtatcatgtttctttcttaaaagaacatagagaaaacatgaatagcggtttcattcttttccacattttgtataagaaaaaaaaggcaatatatattgccagcataattaattttgcaaagcttggtgttctatctatatgggagtacgatgaatgatgcctcttgctctacgtgctcatgatcacaccttggcattgttgaatgttgtaagcttatttgttctagaggatcaacaatgtcgatcttagcagttgcgctggtcgtgtccacacacgccttttgggcatatatactgaggatacataaatggaacacatattccttatcttgcatgcaagcttaatgaacttagtgccatacatggtgttaggtgaataagataaaaaaaaagtggaacatatatcgtttagtctcgaattatttcttttattcatgtataagaattaagtagaaaatcctagtttaccagtgtaccttctggctcaaaaatgtcatcaccaacaatgttgtaatacactcctttggcaattggcttgcttatctgttatcactacaaattatgattcactcagatacaaactgaaagtagtgaagtgctagtaaaataagtgcataacgaaacatatcgtacatgtgcgagtgtaatttacaattgtaagctaaatgaagtacacatagttagaaaggccctatttaaagttatgattctttttgtcatgtaaaaattaaaatgttcttgatataccaagggaaagctagagcatctgagcgtggggtagagtactagagttgtgcctacttcctagtggcatagcgggtgcattaccactttccaaatctaatatccttaatcgcatacgaaacagtagcggatccaaagatattttggagcctatgcaaattctattatatcaactatttgctatgaaaattttgtttacggctcatcaaaaacacttgaattctattgtgcatccatctagcaagtctgggtggctccttagggtcactggatggtggatttgccactacacacacatgtgcttttaataggatttttagggacgacacattgtgcctagctacctccctcttgctaatagagttgtctgatccagatgtgtctatgatagatggatcagagatttgatttattgactttactgtagtgaattttacagcctgtcgtgtcatagctatatcgaatattaaatagtggtggtaaatcgttgtactagtgataatgggatcctgaggccaccacaacaatacaacagttcaaaatagctagcgtttggaacatagtagccacaatagtggtggtaatagccgatatagcatgctctatataattaagttcgtaggctaagagataagtacttaaaaaattctaaagcattgttaactctctttaaatatatatgcttattataccatatgccaatatgtttatctcaatgttagattaagcacattaaagtgtatagtacatattcacataaatattttaaattgtgtggccaatctaatacctactatccgttatttagtttcacaaccataatcaatacctagaatgggcttttttagtgaatctatgatttaattttccttgtggttgtaaaaattgaagaccatgtcacgttagttaggctctaattttacattctcgtttatgatgccctatcaaattcctttctcaaaacaaacagagaatacacagatgacaatctcattctcttttccacgttttgtattaagaaaaaggtaagatatatttccagcatataattaattttacaaagcttggtgtagctatagatggccttgctatatacggtgaatgatgccttgctctacgctcctggtcataccatgtaattaagcttattttggtctagaggattgacctatatatgcactattgttggccatcgatctcgtagccgtgtgcgtgtccacacacacatcttatggaccaaatctacagggtcaatgtaaatggaacatatactattccttatctcacgtgtaattttaatgaacttagtgccatacacccatacacggtctcaaatgaaaggtgaaagaaatggtacaaataattaatagttttcatttagttgtaaattacttcttttatctatctaagaattatgtaccttcttgctaagaaacatcgtcattaaaaatgttgtaatacaattgctatacttgtttgtcatcccagcaaattttgcttcaccctgctacaaagtgaaagtagtggagtaccaaaaatcagtgtataacgaaacttagtcaacatttactgagtgtggagtgcaatttacgattgtaaactaaatagagtatagttagaaattgtgccgaaaccaccgtgggtgacgaggagggcctggcactccccatcctgacttggcccacccctgaagaaaatgttttcaatttgcaaatcactatgtactcagtagtgactagttctaccatgagccttcttgtgttttctttcgttgattgatggctatgggtgagtatgtatattggaatattgcctactcatgtaggttagttgtggatatattcatttacatacctatcagttcaatagtagcataccagagttgagaataggagatgggagacattgagatacatgatttattcaagggttggtgcacacgacatgtacccctttgaaggctgacatgacaaagccgattgtgtcttactatcgtggcatttgtcgtctcaccgaatattcgagattctgatcgagatgaaggctaccactctataggtgtagagccgtatatatgcgaatcatgacacgtaagtttttgttctttgctcttgcatctgaccacctcaacttgctaccaactatgcatccactctgacatgatcccaacacactagtctcgcgactggcccctctaattcttaaattatagcttttcccctggtcccatcacacaaactacaaactccccttgcctgttgccccctctctccacctcttagggtatacataggtggtgtgttgttcatcatcctatcgtcgaatcaattagatcgttgctttccaaagatgtcgctccttcaacttagcgaagctaactgtctcactatgtcgccatctctccaaacctccaagattccaatcataccatgcgagagggtgactgttcgagacgaaggttgccacttcgtagatgtagagccggcaagccgccgatatgcaaatcataatatgtaagttcttgttttttgctcttgcattttattattgtgacatggcaccaaccaaacgtctattctgttgtctgtcgagccactggtgagttctcctaacacactagtctcatgatagaccctctaatcctaaaattttggctttgctccctgtccatcacatctctactagtaagaggggcagtacgcacaacgcacactccccttgctcgttgccccctctctctacctctgatggtatgaataagtggtgcattgttgatcatccggtcgttatttgaattaattagatcgccactttccaaagattttgcttcttcaacatgatggcgctgattgtctctcactatgtcgttatctctccaaacctccaagattccaatcataccgtttgagaaggtgattgatcgacaaaagttgccatgttgtaggtgcagaaccggcaagccaccgatacgcaaatcataatatgtaagtttatggttttttgcccttgcatctgatcaccatgacatggcaccaaccaaacttccactctgttgtccgccgagccaccagtgggttcatccaacacactagtctggcaaccggctctctaatccttaaattctggctttgctgctagtcccatcacaactctactagcaaaagggtcagtatgcacactgcacactccttacccccccccccccacacacactctctctctcttgactcttgactcccgctataaatagggagtgactctaaatactggcttcgcccatgcgcaggaaggttctatttagagttgtgattcttttctcacgtaataattaaatattccaaatacaacggaaacgtaatgacgctacgataatctatctataggacaaacgaacaacgtaatggtgcagtatatttattgttttcaaccgccgcttcatctgtcgagcgtgtgtcaagtacactcgttaatccatactagtacttcgttaagaaagaaaaataattctagctaccaacctgaatcatagttaggattgtgttttttctttctttttacaaagagggagtacgtgcggtgtattcacattggtgtgtgtgtgtgtgttgcacattcacatatgcgcatgcgcgtctttgtataacgaaggaaaaatgtgacgcgcacacgcgaatcctaccacgctaccaaaaatatgttacagctgtcacctgctaccggaatcccacctcccccaaagaataaatacccaactaatcgagggtgaatctgcaaaaaggccaccgaatcccactcttcctcctcgcctcgcctcgcccgctcgcctcctcgcggaggaagaagaagaagaagaagaagaagaagaaattcctcgagaggaaatcgatccatcgcgttcgcggcgggatccgcatcctcgccgcgcgcggattctcggcgagctcatcctcctcctcctgcggcggctggcggcggcggctgctgctgaggctgcggttggtgggatcttggtcgagcacaccgggggggagagggagatggccagcggcggcggcggcggcggcgggatggaggcggtggaggtgaggttccggctggacgacggctccgacatcgggccaagcatgcacgaccaggccaccaccgtcaccgcgctcaaggagttcgtcctcgctcggtggccgcagggtgagacccccgattcgatcccacccaccatttccttcccccctctctctctctctctctctctctctctctctgcgtctgcgactgcgtgtgtgtgcgcttgtatttcgggaggttgctggcttgctgtcttgtttggtcgctcgttctt

SEQ ID NO: 60749 - DNA, 2962 bp, Oryza sativa
tcggcggtgacgtacgagtacctgcagtcggtggcggacctgatggtggtcgccgggcggccgctgttcgcgctgtcgcggacgtacatcgtctccgacgtgagccacgccgggttcaagagcgtcgacttcgggtggggggaggccgtctacggcggtccggcgaagggcggcgaagggccgctcctcggcgtcaccaactacttctcgaggtccaagaatggcaagggcgagcagagcgtcgtcgtgcccatctgcttgcccaaggacgccatggacaagttccagctcgaggtccaagctctcaccgccgagctcagctagaccattgaaacgcagcatgtgtgttctactgttacttttttttttttttgcccaagtgtgttctactgctcttgttttttcttggttcagaatgtacttatacctgtcggtgtctgataaaaattgcactgactatgtactactaatgacgatgtcctatcgtgttcaaaaaatatactctgtctgtcccaaaatataaatatttttagtataatgataaattaaatatttttaactttaactattaatataaaaaattaattatataaaattgatgttactaaatttatcattaaataaactattataatatataactctttttatttaaaatatttttcttttatagatattgttggttaaaataatatctcggagattgtgttagagtcaaaatgtttatatttttagaacggatcgtatctctctacatttctccagtccggtcatcgtacagcggagagttcctgtggaacgtgatccgagtctgctacagtaactaagcacaatttatggctacagcctacagtatcagtgtgatctggatcgttagactgtgatcgtgtggtttggtatcattgttcatccactgcgttagtacctctaatgcagaggatctaagttgatattttttttcagttctgtgaaagtgtgtggtactaaattatctgaatcagaactggtgatctctcgattgaatgcattagtctagttgtctctcattgctttgcttattggcttatcaacaataatcagcatttataaattttgaaaattttaattttagaagagacttacctttgtggtttgtttcgttctagtctatttctagcttggctgcaccgtagataatacggatataaaaagttgacctataaattatttttattcgttttttttccgtggcttatccgcacgactgctcctctttttaagcagaggcgaacatcaactttgttacaatcctaagataatttatattttttaatagaacttcaaacagatttttacttgctcttaggacccttttaaatagtaggaattaaaaaaaatagagaaaatagagaagtgtaaaagacaacaaaacatagaaatgaccgtttgtttagaccgtaaaacaaaataatacaagaatcggataagagagatagactccggattgtctattcctattccgcatgaatttcaaaggatagaatataatagaatcatttgtttctaatatgatagaatatatttttttctacaattcaagagggccttcgcagttagcaatcataaaaatagaattgaacaacaaatgtgacaaagcaacagttgggtcctttgaatcgtagaaatgaaaaaacagatgaatagagaaaacacaggattctgacaggaatacaattgtaaaacagaggaatgtaaaatacaggaaaaacacaggaatggccatttgattagaccacaggaaaaacgcagaaatcagatgagagagatagattcagaggaaatgttccaagaggttagacctcttgctaactttcctccaaaatgtgtataggattacccattccatataaattttaaaggattggataggatccaatcctttatttcaaaaacctttataggattttttttccataggattgaaatcctctaaaattcctacatttttcctacacatcaatggagccctaaaattaattcaaaaaaattaaaaaaattgtaatcacctccaaattaccactactactataatataaaccgtgtcaagcaggcaagatcctcgttccgtgtaccgaggatgcaagtgcaacaagatggatttaaagtacagatcccgtggaactttccgaggtgctctctggtgaatctatatcttctcatttctccttcatggtttcccgtttagttgcccaaattttttttcccaaaaacatcatatcgaatctttagatacatacatgaagtattaaatatagataaataaaaaaaactaattgcacagttagagaggaaattgcgagacgaatcttttgagttttttgagtttaattagtccatgattaaccataagtgctacagtaacccatatatgctaatgacgggttaattaggctcaaaagattcgtctcgcggtttccagacaagttatgaaattagtttttttattcgtgtccgaaaaatccttccgatattcgatcaaacattcgatgtaacacacaatttttttttcgcgaactaaacaggccacgtgaatgtggaacaggtgcgtcaaccagccagctattaaatggggattctctctgtacagtacaacaaagaatctgttgaaacatgattatgaataagctgtttgtattttaacccagaaataatactgaataaaatttgaccaaagtaggtcaacagatccacagttttttaaaagctcctcgtttaagcatttgcatgaatctgcacaacagcacaaccatgagaagttactgaagaaataatacaaggagtactctacttcacaatactctgacaacaaccttcttgattgctttctttagagatagtttagaacacttatataaaagttctttttcatcgtagtttatttttcagcctttgcttttagatactacctccgtcccaaaataag

SEQ ID NO: 60750 - DNA, 1059 bp, Oryza sativa
  unsure (1)..(1059): unsure at all n locations
ttattatattcttaagtatggcaaaagaaaagtattgaccttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagttggtagattcagaatttctatttcgtgaaattaatatattggttagcatggaggaaatcgttaatgatgccattggggcccttcaaggtgagctagctaagagcgctgatgaaaatggcaatgatgctgacggaaagggcagcttgcgtgtggccaaaatgaaacatgtagctngctgctacattgatggggcaatatggatnntttnctatgatgnatctctatgaagggctggaatctnccgaagatgaagatgaagcattagtgttcacgtnaaaatgaggcgaatnaacatgtgatnaaataagnttaattt

SEQ ID NO: 60751 - DNA, 682 bp, Oryza sativa
  unsure (1)..(682): unsure at all n locations
aaggcttcntacatttggtcatcttttcagaacaactattttcggccctcagtgatatggttgagtgctggatatcaggatatgttattcctgcaaatggcatcgttcaaataacttatcttaaaaaagtttgacgtgtgatctttaagtgaactaacttttgtaacaatctaaacttccttacttggaacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactagcttcaaatcagctgcttacattttggtgagcttgtgtttctatccttacggaattgccattctttaggatgggataagacgagaagtacaagccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtccacctacactcccaagggcatattcacagagatgtaaaggtaatattgaatctcca

SEQ ID NO: 60752 - DNA, 10723 bp, Oryza sativa
gccgccctccacctccacagcgggcgcgggcggggctgtacatcacgccgctgccgcggcctcctcagctggccgttgccgcccccacagatcgttgccgccgccccctcagatcggcgccgactcggaccccctccaagcgccgccgccgccgccctccaccacaacgagtgggcgccggcggggcagtgcttgacgccgccgccgccgccccctcagctcgccgccaccgccgcccccttagctagccgccgccgctgcacgcacgagtgagagagaggtgagaccgtgagagtcacgcacgattgagagagagagagagtcaaaatagggtttggagggtattttcgtcattaggaactcttgaaacattttctttttaaaaaaaatcgaaccctaacggagttatcaaaagagggtcagacggaagcttcgtacttaaaaaaagagggtcaaataagcaaagttcaaaaagtagggccaaatcggcaattacagttcaaaacagggtcaaataagcaattgtcccatatttttatagaaataagaagtcaaagttatgttttgaagatcatgtcgctgtcctaaacgacttcctttacgagtacggagggagaaataagaagtcaaagttatgttttgaagaccatgtcgctgtcctaaacgacttcctttacgagtacagagggagttcaccttaaagtacatgaagagagttgcaggagcaattatttttcaactagacagagaagtgggtgcccgcatccattttgaactgtatggtttaattttagaataatgtaagggttttgtttgcaaattttaacttttccaatctcctttcatgcttattaagaaaagtggaaaaaaaaatctacatacaactattcttaaaaaaatcaaagttcaaaactattatatttcgtctaatgtacaatgatgcatcatattaattttccccaagtctaatatattcatttaaatcttttacggcgtttcaaggcgtttgaaagttttgcatacatttccatttttttcaaaaaaaaatgtcctgtttagtacccttagcagcgtgccgcatcgaactatttttccattccttcaagaggaacatgcccggagggtgttatcaacacactcacaaccgtcgtatcgctagggatgcaagtggataatctcactacccgtataaaaacctacttgctagttcattttctatatggtagtacaaaatttcaaagaaaaaataaactaaaagtgagataagcggacaaaaaaaatccgcttgcccgccccgcttgtatccctacgtatcgccaaggttgtcaggatcgggatactaggtagtattattttgttcaaagtaatatcatatcgtagggtcgtatcgtagtatcgggatactaagagattttctttttttaactttaattaatatttatattaattatatatagccattttgtataaaaaaatatagtaatgatatatatcatgcaaatagagacatttatcaagagaaaccacgttggttttgatatatttaactgatttttatataaatttgagcatatttagttacattattttcaaaccatgttatttaaaataatattttatagtatcgtagggatcgtagaatcgggataccacctaaaatttcgtaggatcgtgtagtaatgaatagtaggatcgagatactatgaaaattaagatattatgtggaatcggtatcgtttcggcttggtaggattgtagtatcgtaagatactaggatacgaatcgggatactgacaaccttgcgtatcgcccggctgaccaagcaaactctatgaatcatcactgtcttgtatttggtttgatgaacctcctatcctttcttttttctttctgggtataatctatgggatgatgcaattattgtgtgatattaataaagcttgcaaaaggaaaaaaaacttgtactcatatgagcatgttgtaaaatattttgtctgtatcgaacgcaagttggaaaaatcgatctctcctgccaatctgatatctgtatttgtacagttagtagcagcattatattattgactttatatggatgaataatatattcatatatagttcactgccttgcttaacgcaattgtgttatgaaaaatatgaatttttttctcctatcttcggttgaaacaatgaacaaatactctttaccaatagcaacaacaggaatattatttttttatgtaccgaagaaaaaaaccaagcacgtcataggtcgacgtgtatatgttcgtctttcatatctctgctctataaaatcgtgtatataggctcgattatactcctaatacatttgaaatcaagacaggcataactcatccccaattatatataactgtatacggaaatgccctgcgtcgggcgcccgatgggcaccgtgcctccggcgcctccgtgccgtccccaccacacacaccgttataacaaatcacccacataatacaaaaatgttctattaagggaatacctttcattttttttccaccaacaatattttagcaagtatactcgtgtgtgtttcactatgtataaatcaaatgttacattgaattgtaatatcctttcgctattttgctgaaacattgtttttatatatggtgaaacaacttcaaaaaccattgttctatacattatagcaaaatgttttatgaggtgatttggttgtgtttcaactttttaaacgattgaaacattttcgatccacctaatgaaacaattccgatctatttggtggaacatcagatttttgcaaaaaaataaaaataaaaaataatcggacgtgtaggtggccccaactatataagcacatttgcaatacaagaacgtgaaaaaagaacaaaagcaatcaacctcccaaaaggcccaaatagaggcctggcccatcaacccacgaaggcccagctatcttcttttcctttttttttttcctttccagttccacttcagaaaaaggggaaaaaaatcgcatccgatccgaatccggcgagccgaatcaaatcctcccctcgagcaccagcggagcggaggagcgaattcgccggagacgagacccctcgccgtcgtcgattccccaggcgagcccgtgcattcgttcctccgcggcgagcagaagcggtgcgcctgcctgcgatggcggcggagaagccggctccggtgagggtgctgtactgcggcgtctgcggcctccccgcggagtactgcgagttcggcccggacttcgagcgctgcaagccgtggctccgcgccaacgccccgggcgtctaccccgacgagctcctcgcctcctcctcctccgccgccgccgacgtcgacaaggtcggggagcggcttcagggcgtcgggatctccgccgccgatggctccaccagtgcaggtttttttttcttcttcccccccgctacttctttcgtgatgattctctctgttgtatcagtaggatgtcagactccgatctgggatgggatggtgcacgagagagagagagagagagagagagaattgaatctaatctttgtgctacaactgtgcaggggatgcttctgcgtcgaagcaggaagaggtgaagcgcttgcctggtggtaaggtcaagaagaaggttggttcctgcagcacactcacttggttatcctacaactcagttattactgtcgtttgcatatgatgtctaagccataatagttagtttagtgtgtggtatggtgattattcgcgtactgagatactcaaaatgttaaatgtgctactacagtaatggttagttcagtgtgctggaagaaatatattttttgctggaagtttagtgcgtggtatggtcattttaatacacatgagctattgtattggtgccttctggtttgagtccaagcgagtcaaagtccacgtgtatgaaattttggttgataataacatcgtttatgatgagttacccttttgtcttacaggataaacaagaggttgtgattgagaagattgtccgcaacaagcgcaaatgtgttactgtggtgaagggtctggaattatttggtaagtgttgttttcataaacaattaaatgactgtttacaaactgaaagctaaaaccggtaaggtgaccaaaatgaacatgactgtattgttaacactatagaagaagatgtattttcaatattgaatccccgttcatactgaagctatggtatatttttatgaattatactttgtttcctggacaattaggtgtcaagctgagtgatgcttcaaagaagctggggaagaagtttgctacaggagcatctgttgttaaggtataccagtaatcagggctcatatagtacaatggcctttgatatcaatgtaagcatttttttaacacctgttctttattgcctttcttagggccccactgagaaggagcaaattgatgtgcaaggggatatatcgtatgatatcgtggagttcattacagatacttggcctgatgtaattcatccatcttctcttcaatttattgtggtttaaagttttctctctttttatttactcgcatgtttggtatcatttgtgatattctgtccaggtgtgaattcatttagtttcataacaatagatagaaacctattcaattggattataacatttagtttcacatttaaaaataaaaaaatcgagtaataatatacttctctagtccgtctgtatgtgatgttccttgaatgtatataggagtagagaaccatggtaacatttggtgactacatattcagtgaaaagttatatcctgtggaggttttggtttgtacatggagttcctaactcccattcattaactaactgggaaggtctaaagttgagtcccaaggcccaagggcaaggaggaagtcctatggaccaacagagcctgatatacctctctataacacaaatttggaaaattgtgacctgggagtgttgttatcaccaccatttgaatgcctcagctgttaaaatcgtagtatcttcatcaaagatgtatctatgctatttattgaattattgtcattcattcatacctttcaggtacctgagtcagccatttttttcattgaagatggaaggaaggttcctgctgcttgatgttttatggccacaaggcagaataccaatggagttacaaatatagtagaaatataagacaagagtatgcctgcagctaaggcatgggccttgcatgagctcatcaatgctactactccttcaaagacaaaaaactgttttctttcatttctggtcttaagttcatcacaactggtgttttatcgaggactggtcccatgtgtatcaactttatcctgcaagttagtttggtattgctaagccattggaagtggcaaatgttttgtgcgagcatcaggcttcatatttaacgacatgcaaagaagagtgcaaattagtagtgtctctgccctttctgctttcacagagaggttgtttcacactgcaagtttggatttgaatttgatctttcgttgagttctcgttcatcagggctactgactgcggtttgtaattggggttgtaattgtagaattcaggatgatcataatagggtgtttttgtttgcaagaactacatatcatacgggctgtagaataggcagagacgagtctgatgggcttctattaggctgtattgggtcggcttctattttacttttccagctaaccaagcccaaattacgtctatttagaacagaaattcggcaggcaattttaacagcgatttttatttcaaagtgcattcctagaggagcttcgcaattgtgatctacctcaagtcataaagaaataaaataaaaataaaacatgttaaaaatggtgaagataaataaaatgtggttttaaaaaaaattatcttcaccgttataagtattttttctaaaacaacccacagaagatagtggctataaccaggaaaataaaaaaatagcgacagctcgcatctacaaccgagacccactattgagaagcaaagtaggagcacaaacacccctaagggaatggcaacttcaaatgacgtctccagggagaatacaacgtcgagagcgccaccgccgcccatcctaagaggacgtggttttcgcaataaatctatttaggagagggaatattccgcgacaacgcccccatgcagcgcccgcaagcgtcgccgttatcggcccaaacaggctagaatttcgcccgtaatctttgtaccctcccatgccgaagtgcacctcctagcctcagcagctactgccaactaaacaccttcaacacgcagccactgcgccggcgccttgtcgacggttggccaacaagtaggagcatgacatctggcgcactcaacctccatccacgtagttggattggatggagagagagagatgtttaacaaaaaagaaaaatcaaatgctccttttcgtgtacgttgtagagtaaaactgtgtgcaaattatatttcagcatgcacacgaccaattgagatttcaaaacataagtgagatcaagattttatctctctgccatctcctatactccatatcccaaccactgctgctgttggctgcctagctgtaagccgttgcaagtacccaatcaagcttccattttgcttggtcagtatttaatggccacgccatgggatcaatatgttttatgatatgactaggcaaattaagaggcttgttagtcacaaatatccattgctggaacacaaagttttggtttacaagtaaagtgtaggaatcgacaaggccgtgtttggtgcagttcgagtagtccatcgttttcacagcgatttcttgtttatggagaaaaggagggaatataaatggttggggccgtgtttggttggtctcaggtaaatagcagatagccagctacactcacgcactctaacaaataaaaaataaataaataaaaatcgttgtagaatcaaaactggtagaaaatgagtggcaatgtgacgtgtaatttaatttcagccgagagtctgagcacctgtttgtaagcagcacgttaattattgactacatggttgagtagcgtaaaattagcagaaaaaacatgcacaagatatgtccacaaagcttagtttaattaatcttttaatttcacgatcgatcagttgatgaatattacatttcttttagttacttttacgatggtctttactaattcaattgtcagcatcatcacgtagagacgattttaactgctaatttataagttctgtactaccaataaaagtaaccgttctaccagcataacgtattcatcaaattgacagtacaaacagatataattcattagatcaaaaaaaaacataaacgacctatattaatcataccacatttatacatcatcattatgaaacatccctacatctcgcggtcgacgaatcagcggcaagtagaagaattcagaaagcaaacggcccccacgggaacgaacgaaggaacggatggatgaacaactatgcttggctagctttctgtaatacgtacgacgtcagcgtcatcagcagccaagccagctcagccagctacaggggaatgcgttgtggttttcaggcgcaggaaattgctggagcaacagccacaagtacgcagtgtactcatataggctgtgtttagttcactctaaaattaaaagtttggttggaattgaaatgatgtgacggaaaagttggaagtttatgtgtgtagaaaagttttgatgcgatgaaaaagttggaagtttgaaaaaatattttggaactaaacacggtgataacctaactaatctagccccctcgtttattaagccaataattaagaccccacaagactatgataattcatgtggccagcattacatttaggctccattcttttctggctaacatacagatttttagggtttctttggaacacatgattgagaaaacgtagaattttgacaggataaaagtataaaacagaaaattacaaaatataggaattagaacaaagataaaagactcaaaataaaatttccatgaggttttacctaatgttaaattttctccaaaacttatatggtaagaggcattcaataggaatttcaatgaattcatttgtctcattcctttgattcaaagagctttctatgaaaaaaaaattctatagaaatgaattcctcccaaattcatacaacttttctttgaatcgaagggggccttatcttggttttcattggcatgttttcaaactgttgatcagtgtatttcgtatgaaaactttctatataaaagttgctttaaaatatcagataaattcacttttcaagtttaagataagtaaaacttaattaatcatatgctaacggttttcttgtttactgaacatactcaatcgtgaagcaaaccctaaggtgtttgctagcctagctcaatctggccttattatacacgttttgatatagaggttggattcaattttattatcgaaaaagaaaaagttagcctagctctctcgccttcggttttggcaaccttctctcgcactctctccaagccagatttctgatgactaataactctcgctggtcaaatttatttaatattagaaactcagaatcttataacgctactcaggtcactgcaaccactatactagatgtctttttttaagagagtacttgctcacatgatgaattggttttgtccttagcttttgtacagcttgtgcatccactaaaatccatgggggagatgcacacgagatttctctcgtcaccgtttctgcattcaagtgattcagccccaaccaccgtgctctgaataatactactagctagtacatggtgaactactactgttatagaaattaagggagaagattaaaccgagtaaagtatatatgtacctgacgacaaaatcttgtcatacagctcctaataaatctgctgaataatgacaaaagcttcacgtacttcagttacgacattaattatacagtgaacagtacatcgacaaatcatgaacttgaataggagtattagtacctacagctaacagcctttctgatggatcatcagctcctaaaactgaaaaaacctgcatataagagacatgcggcacagtgaataattaaacaaccatcgatcacatgatcccatttttctgcaattattaacgaaaatcacatgtcattaaggctctgtacgattcccttgatcaaaacgtccacgaatgctactgccattagttttggcattagtcagagcaggtacaatagcaggctataagccagatgtaaatatattttaaagagaaaaaaagagagagaagagcagcgggctacagatatgtagccagctgcagcacagactctaagacataatgtgtgtatgacagatgagaccaggtattaatagtatagtaagcaactattgtatgaattgattattacattaactatagataatttgaagatagtagatggctatctactgatctttagagtctggactctgcaagtcaataggaacagggaacttgcagtcctatactcctatactaaaagtggctaatctattgtttactacgagtggtaaggttatgctcaggagtcagggcattactaattgcaactagttaaatatgtttaattcgtagaataatagcatcagtggtaagattatgctcaaagcattactaaataaattaaataagcatctgtggatatgataatctcatttggtgaagtagtttatttttatatatttttgttgtttggtaatttttttgtgtaaatctttgtattcgataatattattcattcctaaatattaactggcattgtttccactttgactgctagtaataattttaatttgaatgattaaacttcgatgaacgagagcttaataattatatttaaggctcaacacactttttaatagtatgataatatggtatccttttaaatattttaaaattcttatagaaaacacaagaagttaaagtttaaatatgaataatatttgttactaatatgaggaagtattttggagcaggggagtattatgtttagaaaatatgaaacaattagagaagatatgagagttgtatatcatattgtatataactgggttatcctttataaaagaaagcatgtgacgtacctataattcaattaataaaaataaagtataataattatatatttctattctctgcaacaactaaaaaaataggaaatgaaaaggcgtagtttggtttagattattgagcttattagtaccgtgaaatatctatttgcattatagtaataaattaaatattatgaaaataatcttatcaaattgcttaaaataggtggtatacggtctatgtagcggtcgaagtttttttttttttttaagtatggaggaaagaaattcatttcagtaatctgatgaaaataaactaaaacgattaaaggcattagtatcacaaccaaaaaccgtctaaacatacttaatttagcgttgtatggaggttgcactagatttgtactaaaaagtactcccttcgttttcatacatactacttagtttgaatgaaagtgttgcagatgttactgtttttttttataaactctatcagacttaaaaatatttaattagaaaagagtcaaaacaataccatttttttaagaaggcgaaatacca

SEQ ID NO: 60753 - DNA, 937 bp, Oryza sativa
  unsure (1)..(937): unsure at all n locations
aatgatcgaatcatgtcaattatgtcataatgattctgcaagagcaatttgagcttcttgtgagatagacatccttggaattgagctacatctatttattttatgttggcatcaatgtttctcttcgtgtttcatgcataatagaatgtcatgcatgtcaagaatataaagcagtaataggtcagtacagtagaaagcgattagcaagaaaaaagtgaacccatgtccacaaagagcatctgagactcgccgaaacgaataaacattcgaaatctgtattgcgtangactaggacagtttataaggcaagtaaaaccttgcttttgtaaaaaaagaaattgttttgttgggggaaatagatcatcatgccgttgctatacaaaatgaaatttggcgcaaaaaatgatcaaagtacaaaactctcgccaggtcattactgcacttctcaaggtcaagaactttaatggcaactccaatattaagtgggatacaaaaagctttgtacgccgtagcactaacaccatctccaacttcctcacataatttatattctttgggatctgttgcaaatctccttgcatgctccatggctcaaattcaaagagcatcatgcgcaataaccacagagttacaattaccatagcacacagaagcagaaggcaatagcacgaacaccttgtagcagcgacagagaacaaccagcagcatgactaagtctataggcgaatgtacagtccaatatagttcttaattatccagtctatctttcaagcatcctttggtccaaggtgttgtattgccaaacacgatagttaagtagaaaccacaaaagctaccgaaatggctagcagcaagcgtactttggcatccagtcttaattatccagtctatctttcaagcatcctttggtccaaggtgttgtattgccaaacacgat

SEQ ID NO: 60754 - DNA, 4869 bp, Oryza sativa
ccgcccccgagggggagatgggccgggaggaaatcggcccatcgaccccccgggggaggcaaaatagacttttgcggaggaatttgatttggaaggatttggattcggatttgaactcgacgatagatcggggtttgagatcttgagatggcacggacactagacaacaagcaaataaacaaatttcgcaattagattttttaagagataattttcccgctaggcgccacgacggaacgggcgctacacaaaggcgcacgggagggagggagggacgaaaagagatggggcgccgggaaggagggcgctgtgtgggagggagggaggaagggattgacgaaaataggtgtgaaagccatatgcattttttagttaggtatagatttaaaaaacacatggtttagctgttcaggaaatgtgcacgcagcgaaaaaacaagggagtagaaattggaaaatgcaagatgtgcaggcaacactgctatcaaattggactgatgatagaaacaagtgactggtaagctgatgtggatcagggagaatcattactcactagtgatcagtactgctatgttgctttcaataaaagcaaagattctccttttaaaagagaaagtggtaattagcgggaactattcaaagctctcgaggggacatccccgttgtttgcatgtcacttaaatgattatgaaaaaccataaaagaagataataatatgtaatagatcactctacaaacgtgtaatattaaatttaacttctacatgttacaacgaaaataataaattttattgtgaatagctatagtttaacttttatgtttgtagagtgatatatcacatattaatacgtcttctttaatttttgttttcataactatttggattacccagacaatgaggagatgttccgcgagagtttaaaatgcactatcgtaggtagccaatcaatttaacatttcactcaaggagaggccaccatttccgaaatgtaccatctttaaatcaagcaatgggcactgtttggttatatttcctgtttgctctgtgttttcttccaccttccatttctgaatcctcttgagaacttgcatagtgcatcatctactttagaacaattttgttggttcggcactgggaaaaagagtctccatgctgctctagcgtttcgtctgcaggcaaaatttttactgtgcaaaccaggtttgtctatcttttcctcagagaagcagctgaagaggaacacaaaacttcttggttgcgcagcaggtagtgcagcacaagcagcagcctggcactgtgattcccaaggaattcatgcctgtgactgtgtgacatgcccatcggcacatggagatttcacgatcagggtagcgaaggaagcatcgaacagatgcttgattgctggcctgctgccgcatcggatgtccagacatgaaccatctcaaacgaagcgaagcagatgctgccgcagtcccaggctgtctttgatcgtaggagtcaaggtgcaaccaaagtttttttttttttttttagaataagagggcaagagtactgccccttttcattgactgcctcttttttttagaataaaggtgcaaccaaagttgccacaaggataaagcaggagggaatcaaaacaaaggcctttattgctttgccactgctactactacctctctgtgaatctgtgcagtttcattgtacgctgatctctctggtcgaccaccggcttagctgagagatcctactcgtgcccggtgtcgaggagagcgcgcgatggagtcggtggccgtgaacgcggcgcgatgggtggtcggcaaggcgctgagcccgctgtcgggagggttcgtcgaggcgtgggctgccaccacggagctcggccctaatgtcgacgccatcaagatggagctgctctatgcgcaggggatgctgcacaacgctcgcagcagagagaccagcaaccccgcgctgcagcagctgctcctgaagctccgcggcctggcctacgacgccgaggacgtgctggacgagctcgactacttccgcatccaggacgagcttgatggcacctacgaggccgccgaagagcacgccaagggctgcctctatggcctcgtgctcaacacacgccgcacagtcagaaacatcaagaagaaggcgtgctcatgcggagataatggggaagcgagtcgccataccaacgatggggaagcacttgcaggcagcagctgcattcacaagctcttttccaatgctcgaggtacttactatccatctcattgataatataaacaccttccacgcctctcttttgtaactgaacatgacggttgtgacacctttatcaccattgcaacattcctacagaaagaagccagttcctctgctgcgcctatccttgcaaagcatcgcacatagagcacaccatgaaaacaccaaagctgaagtttgacagggtggatctgtccacaagaatgaagcacatcgtcgagcagctaaaaccagtctgcgccaaggtctccaccatccttaatctggagttgttggaatcaaaccgcaacattggcctcatgagtctcaatgctgcgctttcccggatgccagggcaagcaccttttcttccaagcagcgttgctatgagccggcctgtaaccacttcagagtttatagaccctaaatttcatgggaggatgagtgagataaataaaattattggcattactcggggtgattattgtggcaaagacctgaccatcattccaattgttggttcaggtgggatatgaaagacaactctcactcagcatatatacaaggaggtacagaaccattttgatgttaaggtttgggtctgtgtctctctcaatttcaatgtgtatagattgaaagaggagattgccaagttaatgcctgaactcaaagatgagaaatctggtggcccagacgatttaattgagcaaaggttgaaatcaaagaggtttttacttgtcttggatgatatgtggaattgtggtaatgaggatgagtggagaaggctcttagcacccctaagaaaagcacaatcaacgggaaatataattctagtcaccactcgttttctagcagtcgcagaaatggttaaaacaattgatcattcaatacagttggaagggctagaatctgaagtgttttgggaactattccaagcatgtgtatttggtgatgagaaatcaataggcaatcacgtggacttacttgtcactgggaagaagatagcggaaaaattgaagggctcccctttggcagcaaaaactgtaggacggttattgagaaatcaccttgacttggagcattggacaagtgtcctcgaaagtagagaatgggaactgcaaaccggtgagaatgatattatgccagcgctaaagcttagctatgactatctcccttttcatctacagcattgttttacatattgtgctctgttccctgaagattacagatttgaaagtgacgagatgattcacttgtggataggactagacatattacaatcgcggaatcaaaacaaaaaagtcgaagagataggactgagctatttgaatgatttggttaattatggattttttagaaaagacatgaacaaaaatgggtctccgtactatacaatgcatgacctactacatgagttagcactaaaggtttcatcatatgaatatcttgctataagtagttctagtgtgagaagtgtgcaaattccaccatctgtacgacatttgtctattgtgatagacgacacggatgtaaatcatagagtgacttttgaaaatgttaagaaggattttagcactctacataagagactagatgttgaaaaactacagtctttgatgctatttggacaatatcatgggagctttgtcattccttttggtaatttgttgagtaaagcaaaagcactccgtgtcatcttgatgtttaatgcatcttatgatatggagaatatgttgcgtaacttctcgaaacttgtccatctacgctatctgttgatgtaatatgcacttgtattggggaccttcttgcatatgtagctaagtgaaatagtgtgtgtgtgtggctgtgaacaacacaccagaaaaaatccccaaaactgaactttatggtatcagagccctaaccctagcttgctgccgccgccgccgccgtccatcgccgccaccgtcgccgctgccgtcgtcgcacgtcgcccctgctctcatccggcctgaccagcctctacacacagccacgttgaggggctggtgagcgcgcgctgcgcgcggccgcgcgggcgcagcgcgtgtgttgtaacctgctgctcacgcaggaaatgtgaggagctcagctaagggaaaaggaggatggtggcttggctgcagacttggtgacataggaggattgtttgctgcaggaactaggaaggaggtggtacgtctcttgtttttgcttgttttttggctactgcctggatggaggagcatttgacttgtggtctgtgaggggaagaagcctggtccttttttcttttatccaagattagaggagagtttttcctaccattgttgataaggggaagcaggggaagtggggtaccagtgatctattgagagtggtttttggagtgcagagaagatggtgaacaccgagggtactcaagaacaaagaaaggctgaggaggatgctgcactgcaggctgggaagaaggaaagtgtggcaggagaatcttcttttttcactaaaggtgagatgaaaagtctgttgcaggacctcatagctacaggtatgatgggtcttaggagtgggataggaccatctgagataaaattggaagtaatgccaatgaagtgaggttgg

SEQ ID NO: 60755 - DNA, 1142 bp, Oryza sativa
  unsure (1)..(1142): unsure at all n locations
cgcgcgaggtgngtgcacactactactatagggcgaattcgagctcggtacccaacgatcacagcctacgaagtcggagcctacaggagccaagttccgggtgatctagtcggaccaactcgactatggtattgtcgatatcatcgagttctgctattccctttgtaatatgtggtttccatcatataatcccataccaactggattagagctattacctatcaaggggcctgaaccagtataatccttgtcttctatttgcttgatgtcgtattacatagatcctcgtaccagcgtaccccaataccctctatatccggtctacgggtatccaccgtcgacaggggcgtgccaggtaggggaacttggtgctcaaggttctactactatgtcatcaagcttcgtcgacaacagcgtcaaccccggcatcaaccaaggagtttctacttcaacaatgctggtgtggactcaagtcggcgaaatcgtcttcctggtttacaccatggtgccgatctcaactggtccatcaatgaccagaagcgagaacgccgtggttacaaccctggacggctccatgtcgaaggatcctcccgcagaagtggagaacggaacatcgacgacatccgagcctgagaaggatcctaatgcggccaaatcttgtccttccgacgagaatcacgagccgacaaggacaacttccgaggcgacaaagtcctggtgtcatatccacaaaaccaggaaacacaccttacaagcttgctgggtatttctcgacgcctgcaaagagcgtggaattcaacgtacttctctaacccgcgatgtctattgtcctattcacaagacaaagaatcacgacctctcaaagctgcaggttcttctcagcgccatgaggacgtcacctcctaaggtccagcaatcacagatctctcttagagatgcggccaaggaacgaggagcgacagttatctcagatcgattcatcggggtaatcgacatcgatccccacgagccgtaagtactacaacttgctcgaagagcaggcccttattattaacgagtacaccacgtggatgtgttcgcttttgatggggaccagcccgtttgcgcgcgcttacgcagaaacataggatcaagtgggtccc

SEQ ID NO: 60756 - DNA, 3321 bp, Oryza sativa
ggcgcgtccaccacgcagtggcagaacctctgcccgaagatgaagccgccgcaccgcagcctcgtcacctggatgtagagcagcgggcggccgaccaccggctcgacgccggcgacggtggtgctctcgaggatgaaccgctcgaagcaagggaacggcgggctctgcacgtcgccgaagtcgtcggcggtgaggtcggcatcggcctcggcgaacatgacgccctggccggcgcactcgacgacgagcttccggccggcctcctcgcggaggcggccggcgagggggtagtacgggacgagcgccctggccagcgcctcccggatcaccatggccgggtcctgccccttcttggccgggttgttgcggtacaggtggatgcccgagctgtagaaccgcatgccctcgccgtcgtcgatgtcggacagcgccttcacctcccgcggcgtcggcgccgccggtgtcaccagcaccggctcgcctcgccgcaccgtgaacgccggcagtggagacgacgccattgttgatcgattgagtgatgcgtaggtgcgtatgtgcgttgggatgaaaggtggtcgtagtagtgtgttcgtggagtgggcgaagttttggcgcgtttatatagcgcgggaaacgaagacgggggttggtggccgggtgctattggtggtcacccaagtctagcgggtacacccatccaccccacgtacacgaacacacgtgttcgcattccttttacacacaccaaataagtttcacgcactctgtacaaatatatattactcccaccgtttcatattataaactagcataatggcccgcgcaatctgcgcgactagaatcattatattttctctcatataataacatatatgttttctaattatattattcaaatatattaaaatgacaacgtaattttaaattttacaataactttacaaagctactaatgtgtaatattcatattatattttatatacgtgttatttattaattatttttaatatcaaattttagttatttgtaaattatatatattcctatatgtactctagactcgtcttttaatatttctttttttaattccgaattttccgtaaattgtatttttatatatagactctatgctttttttccaatattatttatttttatttttgaattttcatattatattttatatacgtgttagttattaattatttttaatatcaaattttagtaaattataaattatatatattcctatatggactctagactcgtcttttaatatttatttttttaattccgaattttctgtaaattgtatttctatatagactttatgctcttcttccaatattatttatttttatttcttaatttttattatttataattgtatttctgtgtggactctaaactcatcttttaatattctttaattttaaatttcgaatttcagttctaaattgtattcctatattgatctttaaacacttcttcccatgtttttcttaatttcgaattttagttatttgtaaattatatttttatacggactctaaaatctacttttaattttattatgtttattccaaattttagttagttttaaattcttatatggactctatactctacttctaatattccttattttctaattccgaatttcttttttttttcttaattgtatttctatatggactctatactctacttctaatattccttattttttaattccgaatttatatttttttcttaattgtatttctatatggactctatactctacttctaatattccttatttttaattccgaatttcagttattccataattgtatttctatatggactctatactcctcttctaatattccttgtttttaattctgaatttcagttatttcctaattgtatttctatatggactctagtctcctcttctaatattccttgtttttgattccgaatttcagttattttctaattgtatttctatatggactctatactcctcttctaatattccttgtttttaattccgaatttcagttatttcttaattgtatttctatatggactctagtctcctcttctaatattccttgtttttgattccgaatttcagttatttcctaattgtatttctatatggattctagtctcctcttctaatattccttgtttttaattccgaatttcagttattttctaattatatttctatatgggctctagtctcctcttctaatattccttgtttttaatttcgaatttcagttattttctaattatatttctatatggactctagtctcctcttctaatattccttgtttttaatttcaaatttcagctatttcctaattgtatttctatatggactctgttttttcttttttctgattaatgtgagaatttctataccatgagagcaaacatggaggcttctttttctattcctttaataatatagtagattattttaatcttttctaatcaaaattatgtttgatcaggactaaaaatatagcaatatgtacaacaccagtcagttttattaaatgtagccttgaatatatattttaataatatgtttattttatattaaaaatgatttttctataaacttgatcaaaactaaaaatatttaactatgaaaaaaaaataaaacgggttataatatgaaacggagagagtaggaagtatcggatactaccaatatactccctctgctgactgttccataacattagaagatattttgggattgtctcgagtcaaactttctaagatttgatcaaatttatagaaaaaagcacggtaacatctacaatatcaaattaggtcactaaattcatcattgaatatatttttattatatattttatttttatataaatgttattatattcttttagactcgatcaaaatataatgatgtttgatttagaccaaacctaacggagtagtacgttagatgcgaaaaatgcaacgacaacacttgtgtggaccattttttttttgtttaactaaagctaacccgtatattagtcacattgaaatggtgtagaactctagcgatacgcaaaagtttcatttcatgatcatacctcgtaccccgccaggctcgaaactagaaatctctagccaagggctcaattaatgaattatgggtttcccccaaatttttagtgatgatttaagatgatcaaaacatgattgtggagccttagctgccataggctcccggccatactcttactaccaactaccaagagcctaataaggtggttggggtacaagatagattatcaacagccg

SEQ ID NO: 60757 - DNA, 8033 bp, Oryza sativa
tgtatgtatatatgtatatgtagtatgtatgtatatatatgtatgtatgtatatgtatatgtatgtatgtatgtatatatatatgtgtgtgtgtgtgtgtgtgtgtgtgtgtgtctatatatatatatatatatatatatatatatatatatatatatatatatacccgcgtgttgcagggaattaataatttagatgtactcgagaaaagaaacttatggaagaaaattggtaaatcatgtcacttgtgatatctatctaaagcattgtaataattgatatgaaattgtaattattaatataatcaagcaatttaatataaaatataaaattttaatccgttagtataatttaatatacaaacttcaaacccaatgtacaaaacaatgtctttctttttcagttacagagataataagaggtatacacataattgtgaatgtgtctctttaaatacacgttcaaataaatgaagactattaatatatctcattgttaacgaccaaatttggtaatatcggcatcggaaaggaagattagatcgaagcggaatcagagataaggattatcgcggaaacagagtaaaaatcggctggagtccggatcagctacgattggatcggctaagttcgagtcagacttggtttggtgatgcagccgattccgacaatacgacttggtgtacgatattgggttgggtcgatatgcttcaagatgattgccacgcgtggatagagtcctgagaaggcaactgtatctattaattagtatattttatgtaatttccttagagatatgtttgggcaaaagtctgccgcaaagacttatggtatcttagagtttgttagagataagagtcatgtccgatatggacatagtttgtaattctcgggtataaatagaccccgaaccctatgtaatcaattaacacacacgtttaatacaatcttggtgcatcgccacccttttttgctttcgttttatttcgacaagttattgctttcgggttgagctgcatcggtttcgatcttcaacaagaggtaaaacttgttatggcggcttgcgttctcgggattagtgcttccatctctatgatactctaatcttgtttatgtaatccgtcgagttatcatatatcttatataatatatagcaatatcatcatctaacctacaatcagctaacatctactagtagaggtcagccgattaggttaaatatcgatgttggtttagattgtacatgatatctaccactctatgaaaattccaatggcttgattgtctagatattgtccttcttttcatacttatagctgcatcagttgtttgatcttatgagtcgtgattagaatctcaacctctagcttgcttcttggttgccgattagggtagtatcggggttttagccgatcttagctgatttaactatacttgttatatatgctttactgacatgttaaatctgccctttatattaagattttgtggcatttaagtgtattaagcttttgtttgatatattctgcttgctttaatatcttaatatagagtagtatcggagtattagcccatacatgctagatctatctgatcgactatgctatgaacatatatagtcccattattaatatatatttcgatctaagtgatttatattgtctcggcatggcgactgatctatcccaatcacttgatttaagtatatatcgatataaggagtatatattgttaatatctacagccgatcaaatagatttagttccctcttatttactcatggctgccgatcgatacatatatgacaccggctcaaagataaatgatatgtcatcggcacctagccaatcggctatcatttatagatttaaccgcggtttctttgcctttatttcttgttgattgcaggatcaaatccactggcacgctagcatacccgaaggcgagctttggacatgcactggagttaagcagatttcccaggcctcgtgtttttcatcaacactcatcacttcgagatcctataaaatgtaaccacgtatgactaaacgaagggatattagaggatcttatactattttctaacagggattttatttaggaccaccaactgctattactaccaggtaacaggactacaggaggtaccagtgacatatcccaccactaatttgaaaagagtatgatggtagtaccggatatttgtgttggtaactagatctagtagggggtaaggacaagtgtatctaagggtgtaagcgggcagacctgcggacccagccggtttacccgcttatttgtattataagtgagttcaggggcctgtctgattgcacctttaatctcgtcccattgtacaccttgtccttcgcgccgagttcaagattgcgcaccgccatcgccctaccgtcgccctgccaccgtcgccatcacccgacgtacgtccatgctgccagcaccagagccaatagcattctctaggaaatccagaccctactgtcttaaggaaatccaacccatccacctccacccagcatctcctggcctcgattttgaatctgatgactattgggtgtttctctcttatttgattccttgcacaaggttttgtcttagcaaccgagatggccatgacaaagcttggagattcccacaatgcaatgagtggtgggctgagcacttcctgaagttgtggacggctggcgcagtgctatctaggacatccagtcgtgaaagataacacggagacaacgacactgttgagagaaaggagtgggaggcattgtgctcttgcgtgacgggagagggagcagcgggggagcgtccaattaagtggatcaaccatccttatttataagggtgtataacgagacaactcaggctcgtctcttttgaactcattgtcttaacgagccagctctgcttgactcgttaactttaacaagctaaagtctagcgcaattcatcttgcgagctggctgctaggctagttaggcttgtgaacatatttatccctcctttataatttcaaatttatcattttgtcatatataaatatagtaacacacactaactaataaagaattcacaatgtaattagatgactaaatattagttaatataagcactaacaagctaattgagcagttcgcgagctatcttgttaagctcacaagctgaaagcctaatttgatttaactcattaagactacaagttcgaatcgatctgagccaatcgtgctcgctacgagttgatccgagccacaagatttgagctttgtctatccacccgtactcatttaggacctcccatcttgttgtagctagtatggtaaaattcctcttttctaatactctagtatttagttactactcttgctgtctcgcgaacgtacccacgtactattcctcccatgcgtcggacagctgagctatctgagcacctaccatctcagctttgactgatgatatgcttatggctcatgtgtgatgttaattaggccgcacatgacacaaaccccatgggctactacttttgcttttagccatgcatgtgatttaattaggctcctagctagttgtgtgttgcatggtagttgggtacttcatttggttggaccgatgagaggagaggagatcatatttgtgacaatgatatataggatagggtgtgtgtactagtgtatgtgcagcagtagaaaactcgtcttctcttccaacggacgggttagcctaccacgtctattgggggtgcagtgtgagtatatcaccatgtaattaccatggtctacatgttattgtctcgtggattatcagggggacattctcacaacgtatcaactagaacagtagaactagagattcttttgcaatgattttgagtggaaaaccaacacgataaaatcgcagctctagttacaccgatacatcaattctgtcatggaagaaagattgtaaataagggcatgcacactgacaattagtagtgagctcttatagtttttagcaaagtaagtttgctcatataaaaaaatattggaattatagtatggaataaagtccatatgaggtgtaatttatatgaaaatcacaaaggaatgcctcacaggaagagagacatgtgaacttttagtattaccttaccttactcattctaggagagatctctttaaaatggaaagggctctcctagtgacttgagccatgtataatggagagaattagaggaacacgtgtgtatgcgctcactcgccttacacctacattacgacttatggagatcatgtgcaggcattctaatcacacatcttgatatttccatatgatttgagttgtcgtctctacgcaatacatgcgcaaaacaagataaagtttgcctcctcctctgtattacgctatcgctactctacatttgggcgctgcacatcgatgtcgacacctgatactgcacggcttatctagtttggttttatgacttttggggatcgtgcatgtgttctaatctcgcattctgatatctccatatgaaccgagtcaacacctatatgcaacacacacgaaaacaatctaaagtttgcctcctcctctatattgcgctatcactcctctacatttgggcgctacatgtcgatgtcgacccatggtactgcacggcttatctggtttagttatgacttatggagatcgtgcatgtcttctgatcacgcatcctgatatctccatatgaaccgagtcaacacctctatgcaacacacgcaaaaataatttagggtttgcctcctctctgtattgtgctattgctcctctacgtttggacacatgcatttagttccatgcacgtagtgcgaacttgttcttttttttttgtgtgtgtgggggagggagcgaactcacgcgccgtcacgtgttcgtatcttcgttcagcggtgatgatatatttttatcaattctttccaacttatatattcatgtaaaatcgtttaaaaatatatttttaatgtttttcaacatgctctaatgcttgtttacatacttatatttttcctggcaatgtgatcagttctgtggctgtcgttcgatactttttgcgttgcttcatcaagataatgagccatcctattctatgtgggcacaccgtgtacttcttctttccgataatgcttaccattagccgtccgacacggaagaaaaaatcggacgcctcaatccaaatgcatggtaagtctgaacgtgcatgcaagcatattttaaacttaaaatgattttttctctcaaactatttatctaaatttcaaactaattatatcgttggatttgttatagttaaatctttataacaagatttcacatgactatattctgatgaccttttttttactttttaaatgttgcacacattgttaatgtatgttccaacaagtatttattaatgtttcactaatgcattagcaatgttgcacattattttttatatgtttcagcaaaaaaaaattttatgtttcagcgattacaattcgatgcaagctaaatacaaaaatattttaacaaaatcaaatatttgcaaatgtattgtatcatatgattttttttcaatgtttcactaattgggacataatgtttcatgcagtgataattaccgttgcagtcaatactttttatatgttgcatctctggaatattttatgaactaggttgacgcatctgcacaagtggtgaaactttttttagacggtgcaacataagtttgattttttaataaatatttttatcaaaatatatccatgtgagatcttgttataaagatctaattatgacgaataaaatggtgtaatagattatatattgaacacatattttagaaaaaggaaaagagagagaaagtagaaaaatacatgcatgtgacatacgccatgcatgcgccacaagccaacatgcaaacggcatacgatgctcatcctgacgaatgtgccagacgccaaggatgggcgggcgtccgatatttgataaaatatccaaaaatgcttgaacccgagcgcccgatccgtgcgccaaacaatcgggtgatacctccacgcgccgcgcttcccgcccgtgcccgcgcccatgcatgtgtccccaccactgcgtcgctcctgccacgtgtccccaccacgcacaacgttgcaacaaatcaaccacatattttggaaatactctattaagggaattcgttttatttgttgtttcacataaaatgtttcacctagtgtactcacaatatttcactatgtatagatctaatgttgtggtgaactgaaacattctttcgctatttactgaaacattgtttttatataaggtgaaacaacgcccgatttaaacgactaaaacattttcgatctacttagtgaaacaattccgttatacttggtgtaacatcgtgcacatttaaaaataattcaataataagctaattttttttcgttggaatatatccatgtgtggtcttgttttaaagatttaattacaacgaatttaatggtacaattagatcatgatttggattaataatttaagagaaaaaatagtttaaagtttgcttacaaaacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggcattagagcaagtgtaatagtagagctaattatatagatccacattagagttaatatgtacagtagatgagctatacatatttaatgcatttatcttgaaatatagtagcaaaatactcaacctttgctttggacaaaataaaatatattataatatgtaatagacaaaagaattattgtgtaagaggtaattttttctgggcctgtattctttttctaggttcaataggattcttagtggttggggctttcagttatcttggtaagaatattatatctgtacttccatctcaacaaattcttttttttctacagggggtcgtgatgtctttctacggaatcgcaggcctattcattagtgcttacttgtggtgcactattttgtggaatgtaggcagtggttatgaccgattcgatagaaaagagggagtatcacctgtttgcatttttgaatatatggtattcacgtgttttaactaaatatttagattgtttcataatattagaaaatatcattggtaaatttgtaaaaactataaaccgtggtggagtgccagatttactatcaccaccactagagacttttaaatgagtatatatacgtagagagttagcttttatatgaaagctaatcattttaatttttcaagttctattctccgaataactttataattgatttaggcttagtactccatattaaacttgaactcatcatcgtcatgtcggctgacgacccagcaaaactccggtccaaagccggagggcatccgcgacgacgaacacgcacttgtacttgctactatagctcattagcttgtactccctgcagggctacaagtacgaacatttggtaaaatccttatcaaacacgacgaaaaatctcttccctcgaaggctcaaaaatcctcgatcattgcctatgtgattggtccaagcatgagattgctgatcgactgtgtgggttaatatcgtaatctttatttatgcgactattaattctttcgaacttttaatgttctggcagatgaacagattaatgagcatcagtcaaccacgtgtgcatcttttgtgtagcagagcaaaatcactgaaatttttatattttggtcctttttgaaaacttattttacaaata

SEQ ID NO: 60758 - DNA, 1431 bp, Oryza sativa
  unsure (1)..(1431): unsure at all n locations
cagtaaagcagtatgtatgtcaaatatgataacttgttgctcacaattattgaagaatctttttttaaaaaaataaaagaacttctctgcacctatgtaaattagctctcttaccatgattctttaatctgtgacaaactactaaatgtcctttccttccagagaactaatattggggtcctattgaaaaaaaaattattagaatgatgccgtattaatatttctatcttgatcaatatttcctttagcatgaaaacctcattcttccttctcaggatatggtggtgatgtctggttcccccaaccagcaccaaaggatcacccatggcgatacatgcctaatcatgccatgacccctcatatctctgggactacaattgatgcacaggtcagcttttatatatgttttctactttaacttaaggcattggagcataaaattctagaatctgattctgtgggtacccccacaatgctttaacaaaactgtagagcaatatgtcagctagtgagatgagtaacttagttacccagatggcagcgcatgttttgcatgatacatagtacaaaccaagggccactttattgattcatcaataattggttcttaagatcaaaatcatataaagatgtttttactccaagctagattaaatatgcacaactgctttattcagccatagggttgagattcggcgtcaatttctcactacattggcaacgggtcctgcttgtattatgtctagcatagattatatgtgggcatttggattggtcttataatctgtttcctataagtattgctgactgtgtctgtaacgaaatttcacggcaaatgaacaattgctgcagctgagatacgcagcaggagtgaaggacatgctggacaggtacttcaaaggggaagacttcccggtgcagaactacatcgtcaaggaaggtcagctcgcgagccagtaccagtaataacccccccttgtgtgttgggtgtccatcctgtggccaccttcccgcagtgaagggaaacagagattcggataggaaccaaaacaccttgtgttgttgttgttgcttgagtgttccctgagaaactattggacaccggaaataatggatgcctgccatggcaaccatggctccgaagaataaaaagccctcggattaaacagttcagttcagttcgtctatgtatgatcttttatgtgctttctgctctctgtttttgatgtgaattttctggtccagtactccagttgcacataacaattgtacttgtacctgagtacctccatgccaggggccgggggcaccctttgccttactgcctcggcagtcggctggagggctgcagtctgttatctatggaatctttggttagggggatcctctagagtcgncctgcnggcatcaagcataagatctacaatccgt

SEQ ID NO: 60759 - DNA, 763 bp, Oryza sativa
  unsure (1)..(763): unsure at all n locations
acgccatattagtgaagacacgattactatagggcgaattcgagctcggtaccccgctccgcccgcataaaactgaaccccgataagtgtgtgtttggtgtacctgtgggcaagcttctcgggttcttgatctctgcccgaggtatcgaggccaaccccgagaagatacgagctataaagcggatgcgccccccagtaaacttagggatgtgcaatgtgtcaccggttgcatggccgccctaagtcggttcatatcgaggctgggagagaaggcgctacccttatttaagctcctcaagcgctctgggccgtttacctggacggaggaagctgagcgtgccctcactcagctgaaggcatacctcagttctcctccggttttagtcgccccggagccaaatgagcccctgctgctctacttagcggcgaccccccagtagttagtgcaacgatggttgtggagcgcgatgaggacgatcctcattccgcgcaccctcaccctgtgctgacttggcccgggagcgagcatggaggagaggcccccgagccgaacggtggcctaaaggccctgacgaccggagtcagncctcttcccgctcgtcagatggtgctggtgcgcccccgacccttatgaagagccccgagggncactgcgggaagagcttgaactatcggccctcttgaacccgaggctatacttctgtacccgaattcnaaccttgggaagcgaagccaagttagaatgaaagaccccccaagccct

SEQ ID NO: 60760 - DNA, 1068 bp, Oryza sativa
ccacttacacctctgcctcttgttgccaccaattacttatttcttgtgtaatatatttcgagcaaacataggtcaatttgcataaaagcaatacagtgcttgtctagttaccagacaatcacaatcggcgaaagtgtagctacacatgacactttctatgtgcccacatgtttattgtggtccagagtacaatgagatgcctaaatgcactccacatttacagctaaaagcttaactcggttatacttgatgaaatgaacaacatggccatcctaaagcagattcaccaaagcactggctggcctaatattcagttgtttagaactcaatctggaccactaaactcagtatgcctaaatgccaaggacgccacaagatccatattatctacagaagaagtcattccaacacatgtttcatacaagatccaaaatgatttcatggcactaacaattgcaatcctattccatcacatagctatagtgggtacatagaaaataacttctgcttgcctctttaagcagtgaaaccaaggggaaaatcccaagcagaagagcatagcaactgacaagaacttcataggtaaatgctgccatgtttgctaatacgggtaaggacacgtctaaaagaatcaatcaatactttctttctttgtccaggtattccaaaattgcaatagcaattatctcagaaaagaaatatcgcattcgcaagcaagaaaactgcacctacccagcgccaagaacaagaacagaagaaccacgcaatccacggaacaacctgatcggaaattagtagcttatcgcaacaccaagagcaagaacaaactcccaaaatcctaaccccaacatcaacctacgcccaacaaaatagcgacaagacaccgcgctttaaagcttctgcttatcacaggattcacagcacgaaatgctactactactcagcgcaagaacagaataatcacgcaatccgcagaacaacccgatgagaaattggaaaacctatcacccaccacgcctagcgcaagaataaactcccgaaatcctaaccccaacatcaacctacgcc

SEQ ID NO: 60761 - DNA, 1666 bp, Oryza sativa
gccagcaataggcgcttttttctctgatgtgcccgcctcctttccttttcacctatatcctatttcagagttatgtgatccctgtatcaatagagaaacacctaatcacaccaaattttcctgagcctttttgaacaagtgctccgtcctcctgttgtaattttgatgcatccctctgttgaaacctgaccaaactgtaaatagccgaagaagaaattttgtcccgagacaacagataatatgctgttacaacaaaataaatcccatattctttccattttgtcaactgctgaactgcagctactgctctccatggcagctcgtgcattatcatttcatcattgaatttttctctacctttgcaatgtggctgctcattttccatgtcttgcgttggccgtttcgctcttgcttgtccatgtttccggctttgccggcctgtaatgtagttctacctgccattcgatgccggcgagagctgggactcggtgagccgtcgtcttgtcttgccgttctgtgaccggcaagtgtttccgcctgtagactgtagtggtgctgcacgccttcattgcctttttgtcttctgattacgtgcgtgcagcgagcgagttggaccaaagcactagtacgtggcaatttggcacgttttggagagcgcgactatgcggcgaatggaactcgacggcgagataagcgaaattttattgttttgtttagaacttttttaattttagaaataaacctaccctcttgaaaattaccacgtcacctcgccggcatgctgaaataactcacaccacttggggttggtatatatacggcctgtttgatacgacaccaattctagctccacctctcatatagctagaattcaactattaaacttgctctaagctggattaattgtatagtatatttttatagataattattatataaattggctattaaaattgactataaatgatttagagtagatagttgactatactattaaacttagctctaatctgggttaggcttccagtatacctagcactaccgggaggactgcgcgtaggggtggaaacgttttttggtgggacctgcttgaaaaaaaaattgatggtagacctcatctaaagctacgcgcgctgggagatggagcctatttacttttttcctacatgatgcttgtgcttcttggtgagccgggacacatttgctattgcctgtagagtggtacgcctagtacgtacgaggcaggagacagattagcagctgcgtgctttcctctccatctgatggtgacggggatggccacgattaagttggaggaattaattcaatcgattggggtgaactgatcaagtgaaagcatgaacgagtcggtacgaattaatgagaggaggagatctgcgacgtgggtaaagattagaggagggacatgtgggcgtggggctcattgatggatgttcgcttcaaaatataataagctttgactatgaatttatttagatgtatgtattcagttttgtaactaaaatttattatattttgaaattagaaatcatggagatatagagttgtagttgtatttttctacggtactaccagtattggtaggggcgatgaatgtccgtgtcttaggcctcggctagcagaagtgaacaaatatagttcagag

SEQ ID NO: 60762 - DNA, 21873 bp, Oryza sativa
  unsure (1)..(21873): unsure at all n locations
ataagtttatatattcaattcttcataatcttaatgataaattttaagttgacaaataataacaccataaaaaataaaataattgatataaacacatgatagcctaagctcgcgagctagctcggctcggctcatttcagccacgagctgaaaaggaggcttgggcttggctcgtttggctgacgagccgagccaagtccgagctgagctcacgagcccgagctttttttttttttccatccctaactgcgcgtctgccgcccagcccaccaccggcgacgggttgacacgtgcggcgagccgccgttgcttgactgcccagccagcgtggcacatgacatgatgatcatcgaaccttcaagcctgatgacatgatctctctaccatgatttgtggatccttgtagtctgcgcttcttttttgtacgttaaaaaaaaaacttgtagtacgcgcttttgtgaataaaaagtatcaatgggcaccacaatttaaactatattttataactcctatcacaatcatatatacctttggtgtttgcccatattttattaaaatttagcgttgctaatttaataagataataaactaaactagtcaaaactcatagtataagcctgtaattgttacagatttctgagaggggcttgaaaacgaaccagagcagcacaaacaacatctggtgccggctagcgctaacataacagtcaagtctcaaaattggcagcgccacctactcccttctttggtctccatgcatgccaccaacccaaaaactcacaagtgacaatccgacgtggcaccgtgaagtcgtctcgttcaaaaaccagtcctgtatgcaaaaggtagggagtgcatggtacaggcttaacaaactccaaatttcattcattgaccagagttaagtatccccaaatttcgaataagagcttttatatgtatgtaagtaaccaaagaaacaatttttgttaaccttttcaccttgtatccgatgatttttttttgttttgttttgcattgaggataggagaaaattatcgagaaccaatttttcactttgtataggctactttccattctactccctccgtcccaaaatataagtatttttagaacagtgcgaagtcaaactttttaaattttaactattaatagcaaataaattaaaaagattaatcatgtaaatttgatgttactatatttatcattaaacgagctatcataatatgcaactctttttatttaaaacatcttacttttgtagatattgttggtcaaagtagcacctcgaagactgaaccgagataaaaaaaatcttatattttcggatagagagggagtagctctcacgcattgattgtctataagaactatggaaccttggaaagttggtgctcttacagtcttaccgtcagattacttgttgtttttgttttttatttctaacttggattacaatttccaaaatattatgggtctatttagattagtgccaagataaatgttaccaaaatttggcaatgccaaaattctggcaaattggcacattgccaatatttagtaacaaactaaatatagccacataattattaattttattaaataatggtattgttaaaaatgtcatcaacatgaacaggtcctatatatttatgtagtctaacagcaagtgaactctctatatagcactatacaatacctatgttttttaatagatgacactattaacttttggtatacgttcaactattcatcttattaaaaaattgtgtaattatcatttattttgctgtgagtttttttatcactaaaagtattttaagcatgatttatatctcatacatttgcataaattttttttaataagatgaatagttaaacatgtgtctaaaagtcaatggtgttatctattaaagaacggagggggtatatcatgaaaatattactcacggtgaataaaagaataaatcttatggtgttaaacaatacaaaattttaaaatttaatgatcaaagttagtcatgtttgacttagaacaaatctaaaacgacaatgagtttgaaatggagggaatatttacataatcttacaattaattattacatggtctagagaaaaaacacatggaattattgaaaaccaagtgtaaacttaatctgtgttataaataataatcccttaggtacaactttcgattatattgaagccgatttatgtacaggagaagaagttgatatatatgaccataatccataggagacactgataatactctctatccagaagtctcaacgcacgttgttactaaaaccaaagaacaattaactaatcccgcatgtaacaaatatcaatgaattgtacacatacatgcatataatgacaaatgagtatttagatagctactcggattctaattaacaattttatctagcaccgcaaaataaaaggcaaatatttgattaagacttttggatagaaaataaaatatgatttagacttttggatggtgggaaccatacggaggtaggctggatcaactcgtggatattccttgacccatgtttgttttagattactgcaaaagtgaacattttaaaaatttggcgacaccaaaatttttataaggtggcagcattgctaaattttagagtaaagtccatcaccggtccctaaacttgtaccgttgtgtcatcccggtccctaaactcgcaaatcgaccgttcaggtccttaaacttattcgactgtgtcatcctggtctcaaaacttgcagatcactcgtttaggtcctccaacttgttcagttgtgtcaccccggtccctaaacaagacggtctaaaaactttataccaaaaaataattcataactttttcatgtgaactctaatgatgacaaactttatatcaaaattgtagccctcgacacgacctacaactttgtagtagaaaagtttttgaattaaaactgtttagggtcccaaaatattgttgcatgtttatagattttgaaattttaattttaaaattatattttgggacaaaaaatgacttaaaataaaaaaaatcgactacaaagttgtaaatcgagggctacaagtttgatataaagtttgtcttcattagagttcacatgaaaaagttataaattatttttaaatataaagtctttagaccgttctatttaacccaatgatatttaaatccaagtttagggaccggggtgacataacttaacaaattggaggacctaaacaagtgatctgcaagtttagggaccgggatgacacagttgaacaagtttgaggacctgaacgatcgttttgtgagtttagagaccgagatgacacagcggtacaagtttagggatcggtgatggactttactctaaattttagtaggataggctaaatgtattggtatcaaaattttttaggcattaccatatttggtgacaagctaaacgcattggtatcaaaattttctaggcattaccagtgtttgttaatttttaaaaaatgatatggtacaaaatggcacttatctgaacgggctcaaagaaacactttaaacttaattaattattatgttaactctcttattttacgtgccctcaagttctcggtctccattaatcgcaagccgcaaacatggcctacgaccaaaggttgttgaccaacccagatcgtttttctaagacctgtaatttacgcgtatattagctcagctatttcagtggtagtataaagtactcctactggctactaacacaagagaaacgtggaagccgtgtgagccgttcgacgagaccgattgcacgaagcagctaggaaaatgtggataataaggtcatctcaaactaaaactatcaaaatagtttttatactatactttacatgtcatatagacattatttataaaaattatatacccagtgaatggcatctttaaattaaattctcatctaatcacctctcttctctcttttttttatccacagtttttattcttgttattgtgttctctcatttcttatgtctccttttatccaccgttttcattattggttcctgtgttctctctttttatctatcatttttattctatagagatggtttcttgtatgagaaataatgtttttatctttttacatctcttctcttttaactcttttgtcacttttgtcacattagatttttgcttacgtgatactccctccgtcccaaaaataagtgcagttttacactattcacgttcaacgtttgaccgttcgtcttatttgaaaattttatatgattagtatttttattgctattagatgataaaacatgaatagtactttatgtgtgactaaatatttttaaatttttcgcaaatttttcaaataaaacggacggtcaaatgttgggtacggatatccacggctgcacttattttgggacggaggtagtaacatatttagggcatgtttggattgatgccctactaaaaattttgatagtgtcaaatcttagtcaagttttggttgccaaaactttggtagggtagagttaaaaatattcatttggattgaagccaaactatacttataagagacaagttcattggcaaaaccaaatttatagcattaatagtgtttcaacctatgtgtttagattgttaccctaccaaaattttacaatccaaactgcccattctatggatggattggcctaaagcatactactcctaagaagggcagatccgtaaattcattatcttatacactctcgagccgcgaaccaaccaccttcgcgacacgtcagcatcccccgacccccgcggccgtctcgccccgtatttattagcgcccggccgccgcgcgtctcctctctgctctgctccgcccgcttcttcgccgccggcttcctcccacccgcaacccaacgccggcgcggcggccgtggttggttaccctacctacgctactacacgcctcaggggcaatggaggctagagcggggctggcgatgcagtcgcgggcggctgtcggggtcggagctggccccggcgtggggcggcggggccgcgccgtgatccgcgtggggaagcggccaaccgcggcgagcctgcgggtcggaggccccgccggaccggcggcggccaagcccctcgccccgctgtactgcctcaaggcgtccagaggtgattcatctgttttttttttcttcttttttttttaactcccttgcagcgggcgattccggggttgtgctcgtgcgagcacggtgtcgttagggttaactttggcgcgattttgtccgggatttttttctcttcgagcggatgcggatccctctggtatggtattcagtgtggatatatgggttcgtcgtggtagccagatttttgcagttttttaattggattgggggaagtggtcactttcgtggtgatctggagtaaatgtgacaacttatgtgttggaaatggagttgttcagggtaggtgatggctttgctgggtcaaataggaaagttggatggggcaatttcaatgaagctctctctctctctttgttaggtgggttggaaggggttaaatttcagtttgtagaagtgtgtattgttacatgtttttcttggtatcaacctgctatttacttcaaaaatggtcaacattttgtaacaaatacactactacaaataacctctgatgatcacaccaacgttggattgtctatgcaccttgtatcatttcttgttgtgatttcttacccgatgtagtcttctattttaggtagttgcctgacgagatgtatatgctaaattttgcttgtgttcagctgaaataactttctttgtaatcttgtatcgtacaggccacgacagcttgcataactcagttgatgaagccctcctgttaaaggtaaataacgctttacaaaaattcctactattagttaaatcaagagtaaaatatggctagaactttgttctctcatctttggctttcggccattggtataatgttttctaattgtaattgcagaggaaatcagaagaagttctattctacttgaacggacggtgtatttatttagttggttagttctgaacctgtatcatttaattgttaacctgtaactggagactaaataccaagttaaatataacttgatcttatttgaaaatgaaattaataatattgagtacgtattgtaggaatgatgggctcagggaagagtacagttgcaaagatattagccgaagttttgggttattcattctttgacagtgataagttggttgaacaagcagttggaatgccttctgttgcccaaatattcaaggagcacagtgaagcgtttttcagagataatgaggcaatgtttcttttctgaattatgtttccctgttgacaacatgacactgttatttttcagatagtttctatttttttgtagtgatttgaatggaaagatttgtggagtaacaatttctcagacatgatagactaacaattccatggttccctgctttgtctaacagagtagtgtcttgagggacttgtcctcaatgcgacgattagttgttgcaactggaggtggtgccgttattcggccagttaactggtattgggattaatctgatctcacgcccatcctcttgtaaatttggctttttctgtttatggataataagtgaaagctcttgtgttttttcaggaaatatatgaagaaaggtctatctgtctggctggatgtgcctttggatgcacttgcaaggcgtattgctcaagtgggtactgcctctcgtcctcttctggatcagccatcgagtgatccatacacagcggtagttactctctatccttgaaactaatcgtttgtacattcacaagacagatgctttcttaactagaagataacagtcttcatgtgaaaacaccaatcagcgttagtgcttatagaccttgtagcttttgaacttgcatgtatttcatttaccatcttcattttgtctttctgcatggttgtgctcattaaaatggatggctcatggaattgtttgttccccaggccttctcaaaactcagcatgcttgcagagcaaagaggcgatgcctatgcaaatgctgatgctcgagtttctcttgaaggtatgtttcttttctgacatgtccttcatcttaatatgctcctagtatgctgatagcagatggatatctagtgtcgcttcagcgaagcttttcatgtatccaacagagaataatacagtctgcatgattttacctctgcagaaattgcagctaaacaaggccatgacgatgtctccaaactaacaccgaccgatattgctattgaggtattgcacatttcgggacaattattcatgtaaacttgtcatttcatctctctttgtaaggacgtctcatactctgcccgattgaatttttttcctaacataacatcctgttgcatttcaggccttactcaagattgagaatttcgtcaccgagcattccacatcaagtggcccagttggggacttaatagttgattcccagaatcgaaggacaaaggccttgtagaattttgccctctttttttcttcttttggtgtatcctgtatttgtagcatgtgctgtttaacattatattgatttattctttatatatccaaaagagagataaggcaaagcttgttccccttgtaaaaatagaataacgaatggagctgacgcgagatgttccacaaattttcgttctggaaataagaatcgttgcaatatcgtttgcccaacttcatgcactgtcactgccgtgttttttgctcaatttctgtagatcactagttacaaacatatcgttatctctctatttcgactttttgagaggcagaaaggaaggattattaatttgttactactccatctgttacaaaatacaacttgtagcgttcaaaatttaattaagaatgcaataacgttttcatcttatttcatttaatttaacccacttccttgatgtccgtacaaaactaactatttatactttgggattgatggaatacatctttattcatattttagaccaaaacgactctccctgttcccaaatacttctcaccatacactgttcacattttaattttgaccactagttttttttcgaaaaaatcaaagtgattgcgtcataagtattaatatttttatcgtagactaactatctaaaattattattgattaaagttgctcaattaagtgcaatgggcgaatgataagtttgttcctgtagcagcataaattattgaatcaatgcattctatttatcctgaggaccagtgaagatcgaatacatgataatctaagtgtgtatatgtactcaccgttggcatgttcggccgccattcccacggcagcgctgcggctgcagcagcaagcagcatgctcagctgcatggcagttagctgcagcttgctgcgaaaaatgccagccgaataggtcctgtagtgttgtagtgttagtacgtgcatattactagttcggagtattttagtttaataagattgtgaatatttatgtgtgcgaaacagagcctatagaatgtttagtgggttggcccaatgtagtatgggctaaggtgcgcatgacttgagaaggcagcccagcccatatccatccaacccaaagcgggtagattttgccttggaaaggcaaaattaaaagtacaccgaaggtcccttaacttgtcactgattacgaaatcgtcctccaaccacaaaaccggatatatgacaatatgacattcctcaacttacaaaaccggtcactttaggtccttcggtagttttgaccccggttttatccgatgtggtggctgagggacgntgggacccacagaggcccgacatgtgagtaagccatgtcaccacctctctatttcccctcctcttccttcctcctctctctctctctcacacaccttctctcccttcttcctctcctctatcccttactcctctctctcactcttccggtcttccctgggcaggctagccggcgcggcgcggcgggacggggtggggcgagggcagcagcggccaacgcggcggcggtggcggccggcgacgagcggcatgggagaaggagaggcggtggctcttcctaccaccatcaacggcaccatccactccctcctcggtgtgtcctccagctccgatttcctccctccctcctgtgctgcatccactcgtcctccttgttcgccgaatccctcctcaccgcatcctctccgacggtttgcttcccgaagtagataagaaagagccacacgaggccaacgggcgcgagacgggagaggagatccggcggccgacgacgtggtggccggcgagaccgacgctagcgccgcctgagctcctccagtgccgcccaagcccaacaacggcagctctttcccagccgccgccttccagatgtcgccactgcgatcttcccagaagacgtcgtcgccgccttcgtgggagtctctggcgaccacgcactcaccgtgtcggcgaacgccgattccggcaggatgcaaagcttgggacctcgccggcgtttagcaagacggaggtagtggtcgatgaaggcgtcggaggagagcgcggcggcccaggcacgggagagactgcagcagcggagcaccaacctgagcgggatgcgcgcgcctcgctcgcctccgacgaggccgatgccatggcagactgtgctgaggaggctatggggcgaccaggccgcggtggaggagcaatcctcccgtgtcgtcgtagccacctcctccccagccgtcggccggcttgccaaaccaaaaaaaaaaaaactgtaataaaaaaaggaggaaggaaaaaaaataacttaacagcctgacatgtggggttcacgtgggtcctatgctgactcagcaaccacataggataaaatcgagatcaaaaccaccaaagaacattgtcggagatatgggcccgggggtatgcgaggtgaggggaatctaccttcccatcctgccacgtgtccctacaacctggtcctacccccgcattccgcgaatcgcaggagcggccgggggaggggacctcggggtgccacgtcatgcccctcgggcccttgcaccgctttgccccgaggccctcgcccagccgccatttggtaggggtagcaagcgaggagggggcccaggctgaacctcctttaatgcgcgcagcgccccaactgccccctgtcgcatttaatgcagtggggcagacgtgcggcgagcccgactggcgcgcgatggtcaagaatgaccaatctatgaccggcctgacgccggtcacgtctgactggacagacaaccgtgctcccacgtcgcatctgcttctggcggagtggaagtaggtatgacccgtcccatcggagggtcattcagagggcggccaccacaagtcttcacccattaatgagggattgacatggctgtccctcgtgtcaggcgagggacggcgctgggccccgcttaaggacaagctgtggtttagcttccaggcgaaggctcgggtcgagttccggtcaaggtagggcgggtccccacccgagagaagagtaggtagaggtggtgcatgtagtatctccttgaggtataaaaggaggattttgcccaccgaggaaggggacgactctcagaaaacctgaactcgaggaggagggaagtaagagcgttctccggagtttaggaacctttgtaactctcagtctaaatcccatacacaggagtagggtattacacttcatagcggcccgaacctgtataatttcgttgtgtgcgagctagctagtagccttcgggacggatacgcgatttccaaaggcgagcttcttcccccggccgaactcacgaaaggggggtctcacgatcccccgctagagaggatcactccttgacaaatatattgtgaccggtttggattagttaagtgacaccagatatatggttttatggttcgaggacgattttgtaactcatgacaagttgagataccttcgatggagtactttattttcctttcagtttccacccgagccaaactctcgctccaacggaaaatgccgtctgctcttcctcctcgccacacccaagctcccgcgccgccggccgccgcctccgcctccgcctgcctcctccgccgccggcgcggccgactccgtgtcagcctctgttactgcagagcctccacggagcctctcgtgttcgcctccccgagctctccgtcgctcctccgctcctccgttgccgtccccgtcccctcctccccgcgccacgcaaatcgggggccgggagacggcggcggcctcctggtagtcaccgtcgctgcgtccgcggtacggccccccttgctcccaaccctcacacatctcatatcgccttctcaatccagcgacatgacactggggtagcctccggtagcgatggcagcatgacggcgttgctgctttgaaggcgcaagattgatatgcgtaacgtggttttgaaagcgggttcttggccagcttttgcatctgtggatggatggatactctctcccccctgtgaagagtaaacagcgggtggaactgaaaacttatctgaatcgaaactcatgatatgcttttaagctgtcggttttgaatatgaattagaaactgaaatgccaatgaaacagcataatgtgataagggtttaaggttggtttttccactctatttgaatctattatttagtactagtatcacatgtctaccaaaaacaaaaaagttctccatttacattcttgaaaaaaaaaaaagatacccagactgaaatagagtcatagacacccccccccccctttttgttgtttaatttttgtaattcttgtaaccgtcaactccttgccaaattgattctgacttgattcctgcatgcgaagctttctgctatatgatattctaggaacatatcagatcaagagtagagcagtacttaaaatttaactggttatgtggttgtgtgttaaatttgaatatatacaagctttttgtttcaccatgatctacatgttaaattcagttttgtgttgaatcaaatatatttgctttattaaagaatattcttatacagaaaaatggttgacaagtgtactcattaacaattttgattccattttcacttgtgcatgccaatgtatactcttaatttgatagtgcgtaactttggaaccttactcttgctgacagttgctgtcttatataggttgttctttctgcatgctttgtattcctttcagcaatgcgctccatgttggtacgttcatctaatttgctactacctctcttatgggaccggtaacagttacagatatgccgacatttttaggaatgcaagaaggcagcagaatctcttgagaagtccttcggttcagcaagagagaagcttcctgaaaccatggcttcagtgaaactagttggaagggagatctgtgacttggctgtggatctcagtaatctaaggtgagtagttgatatgtatcagccatcacttgtattactttcatttatgtgttcttggagaatcttataatcgtccataatacacattcgtgcatcttgacgagtagatttggatgattaactcttcacaagttacacaaacaaacctacacagccatctatggcagtatctcaacttgcattctgacaatttgcctgcttgcttgtgcacaaatttagcagtgtcatgtatatgtttgatcacataaggcatcgggaagacaactactaatgccaccattctgtagatcagtcaagaattgaggaagggcgtccaaagttccatgagcgttgttcatgcagccgatgctcaactgcaccaactgacgacctctgccccacaaggtgattgatttatccattgttggaattaacttccaacgtgatgtacggaatcatatctccttttttttcccttcttttgccctgattgtttctttcacttgaataggaaatcagagggtgactagtaatcgaaagagagcagcaggagagcctttgctcgctagtaccgtgagagaactccgtgagttaattgcagaattacactcaggatttggagtagccgtcagcatcgcgggccttttaacgtgggcatcaaattttgtttctaagcgtcctaagaatcgctcatagcgagacacagaaagtagatagaggtcatgagggcttctggccggtgtaagtgatactgaatcattttgcttgaagttagatcatgatcatttatcctgggttcatgaattatgatgagttcatggattatgaagattggctttcaaatgaaaatggttaatttgaagagagctggactgtgttgctttgcaatccaatccatactaatgaaagacagacaattaaggaaattgtgaaaaatgaatccatactaatgaaagacagacaattaaggaaattgtgaaaattgggatgaatcattttgcttgaagttatgatcgtgaatcatttaacttagtacatgaattactatgagtgcatggattatttagattggcttaaaaaggtagagttggactgtgttgcttcgcaatccaatccatactaatgaaacaaattcaagaaaattatgaacaatccatagtaatgaaagacaattaaaattatttttgatttcaaattggtaggggccgcgcggacgcgtaccccctctgccacaaattatgacgtccactctcccgcttggggagatggtaaaccaacccacccacaaagtgcaatgtgaggcattgatctaggccatgagcctttcttgatcgcccattgaccccgtccaggtaagtatgttccaacgttgccccgtgggatgcttaaatagggataaccacttcgtaacgatacctgagtccccgatacggtactaaacttgatttacttcgcataacatactcccacggattggccggagcgttgaaactaggcctacccactaaggcccaaataggcccactgctcgatggtaattttcggaaggatccctgtagtccggatattttctaaaaacaccctgtacatgaccgttaccacttgctcgcggtctaaagttttgtaaaaacacccctttccggacagttatcatgagtaaaattattaattacattggcagcgacacatatttttacaaaaaagacactaatggatttttgcgattagcccccaagcatttttgcaaaacttgtttggaactttggccaccgccgccggcgccgcgacgcgacgacgggaaggcgccggccgccggcggccagcggcgctggcggtgaagccgatcgaggaggcgtcctccaccgctcggcgaccaaccgccgacggcgacggcgatggcgacagcgcgcaccatgcagggggccccactctgtttactcccccgcgtccgcgaccgcgaagtctccggtctccgccgcgcccgcgtcgcctcgccctgaccaccaccagtccaccgccgcggcccacacggcacagcctctcacaagggaggaagggggaagtgagcccccgcgccacggccacgcgccgcgggcttcctcctcctcctcctcctcctcctccccgagccgcacgccgatcgatggccgcgcggcggcgcctcctcctgctcctcgtcctcctgctgtgccgcctcgccgccgtcctccccacctccgaaggtacgcacgcgctccctcgctcccgcccaccccctgttcgatgaaatcgctggctcgctcgctgcggcggtctcgcttgttcgatcgattgcgatttttattttatttttttttgggtgcagtggaggccttgcagggtttcatggcagggttcgccggcggcaacgcggcgttccagagctgggacgcgtccgcgcccaacccttgcacctggttccatgtcacctgtggcccggggaaccaggtcatcaggctgtaagcatctactgtactacctgctgcagtgttgatcactaattcactggtgctactgctgaatgaatttgcatcttcgcgcagggatctcgggaaccagtcgctgtccggcgagttgaagcccgacatttggcagctgcaagcattgcaatccctgtgagtttgtccatgtttatttgctcatttcttccatggagaatattgggttgcattgcatcttttcaccgatcagacagcactggtagtactcatgcctgctatgaatgtttccgttatgcccagtgatgtggcgtatgcaatgcatatgccctttttccatcttgcctctcgcttattatatgagtaaaaagaatgttgtttctggtctatctcttctatgaatcagtagcgtttgatcatcctttaggaataaaagctgacgatgcatcttgcgaaagcatactatacaatatcactatgagtcttgcattggaatgttggtcattttctattctcagatttgatgattctatgtgactaatgtatcttttggtagcagggaactttatggcaatagcatcagcgggaaaatacctagcgagcttgggcggttagctagcttgcaaactttggatctctacttgaacaatttcaccggtgaaataccgaatgaactgggaaatttatcgaagctcagtaacctgtaaatattctcatctctgcttcaaataatttgtatttgatgttaaatttatgtcttatgatatcacatagccagtgaaaaattaatgtagaatttactactcctgctctttgactttgcgtgcaaggatagccgtctgaacaacaatagtctgtcaggtgcaattcccatgtcattgacaacaatccaaaatcttgaagtgctgtaagttctctgctacaccatgccgcaagatgccgcaattgagacgctgatatgctaatatattcattcagggacttgtcacataacaacttgtcgggaataataccgaccaatggttcattttcacacttcaccccaatcaggtttgcttggcctggagtagtgattatgtcgattcaacaatgcattatgactggtgtgaaattttgtaattgtgtcttgcagtttctccaataacccacgtactttcgcaaattcttctgattcgccatcaaataactcgggagcagcggtgccatcaggttgtctgttaattccttactctggagtgataaactgcatttatttctgcagtgtttcattattctgtgtagaatcccatacataacccagttgccaagtgccaagtgttccaaaattgtctataacctgttgttgcagcagcctgggcatttggaattcatctagtttttgctcttatctcatcatccatttcgatgctatttatctaaacaaataagtcggaaaaacaccactttaattctttcgaattggcggttactctagttgattctgtatttggcacttgttaactcaggaagaagtagtgcatccagcattggaacaattgctggtggagctgctgcaggtgctgccatgttgtttgctgctcctattgtattgttcgcatggtggtggcggcgtaaaccacatgaccaattctttgacctactaggtcagtctacgtgagaacttttggcaatctctacggtttcctttgttatttgatggcattcctttttctctatgcagaagaagaaactccagaagttcatctgggtcagcttagaaggttcacactgagagaactgcaggtggcaacagataacttcagtcaaactaatttgctagggagaggaggctttggaaaggtctataaaggaaggttgttagatggttcattgatagcaataaaaagactaaatgaagatcgaattggaactggagagcggcagttcctaatggaagtcgagatcatcagcatggccgtgcatcaaaatctcctacgcctccaggggtattgtatgacacccccgagcggctgcttgtgtatccttacatggagaataaaagccttgagacacgcttacgaggtattttctgaatattctgcacttgaactatggagtatagaggtgttagtttctcaaatatgtgcagtgagatgatactttcaataaagatctgattacaacattaaaataagtttcatgtcaactacacagagtgctctgattcacaacaaccacttgactggccaacacgaagaaaaatcgcgttagggtctgcaagagggatctcttacttgcatgaaggatgtgatcccaaaattatccatcgagatgtcaaagctgctaacattttgttggatgaaaaacttgaagcagttgttggtgatttcggtctggctagaattatggattacaaagtttcccatgttgtaaccggcgtgatggggacattggggcacattcccatggagtacctgactgcaggaagaacttcagataaaactgatgtttttgggtatggaatcatgctttttgaactgattagtgggaaaaggggatttgatcttgttggtcttgcaaatgaagaaaatgccagagtgcatgattgggtaagtcatgctttgttgaatcttcccttgttttgcaggatatgtcttttctcaagctattatattctgtcagttatattgactacctcccatgctttacatttgacattataatttgcactataatctttagtttcgattcttatttctagggacaacatgctaatgtcttcaatgaaccacttaattcatactgtattactgaagcaatccttatgaaactccaactttcttcaatagatcaaacatgtctacctccctaatcattagtagttcgcacgatttcatttgttaaaaaacaatattgactgcaaattatgcagatatttacattctgttgatctctttaacatggaacgaccaacatacactgtaaactggttaccaattcttacttcatattgaattgaattaaaaaaaatgatacagtgctattcctgtagagcataagcatgaactcagtgataaaagagggccatattctttttattattcaggtgaagaaactgctggaagaggacaggctggaggtgctgattgacccaaacttactggaaatctacaatggtggggaacagggagtgcgagaggagatgaggttgctggtgcagattgcgctgctctgcacccaggagtccgctccaagccgccccagaatgtcaacggtggtgacaatgctagaagacggtatcgcggagcactgggatgcatggcaaaggaagacgattgtgcaggcaagcctgcaaggaggacagggcgtttctgaggctcgcaatgactctgttgcaaatctccctccagacacattgtctggtccaaggtgactgccaccttaaggactatgaagggtggttcttttgtagagcttagtgaacttagacagaacacttgccattcttaaaaaaacagcagattatatgttttcttgtagcatgtgtatgtattttagtttttcccctttttttcaagtaattcataatcactactagacacagggctttcagaaactgttcagaaaccacatcatagttatgctaacgcatcaatacatgtggttgtgctactccaggatcatcaaaggcggttatttaaccctctctgaaaaaaaaacataactagagatggctcgaaggtgagctgtaacctattgccagagatatatcaattttgaatcaaagagtactctaaatctggccatttcctattcattttgcaacacctgattttatataatattcttgtgaagtgttaactttaggtagtcttctatattttcatggaaagagtatatgcactaccatttttttcaaaaagataataatcttgtaaacattcccaatttgacgcattcagcccaacaacttgaatcatcgggtgttggtttagtccttaatgcctttttgttgctaagtggagtaagtaattgccataaaacctttgatgttctcaatccccagagctacaagatgcaacaagtaccaaacaacctacatgctttttcaccagaagagtcaacattagacattacaaaatgaagtaacaggggacaaaccgtaatatcttgcattcttccgcagtaattgagccgaattctccacaaactgtagcgcataatccatttctgtctacacaccaagcagtgaagcaactccatttgctgtttccccggcacaactggacgtataagcatcagcgaggcctggaatgtggcacttgtaaggatccacaaacttccgcacaaacttcctctcactcatcgcggctgtgttgtagtaatccaactcacaatccagcaatcccttcatcctgagaaccttgagcaagtgatgccgaggcaacaatcgccgctcaaggctgtacaaaaacaacactggcctatgcgcaatgtaccgtccctccaaaccaacatccctcttcaagaattcagcggcttgccgtatcttttcctccgatgaggccaccaactgcggtgccttcctgatgatcatcaacaattcatcccgcgaaaacccaagctcctccatcacctgtatcttcctcgcaacggactccttgctcgtgaaagccaccgcgatgagcccatgccggaacatcctcgagctgcggtccaggcctaactcctccacccgtgccacggcgtcccggagatagatagggttcgcggtgaagagcctgctggtgtacaaggggaaactagtggcaaaatcactcatcccacattgctttagcaattccaggttcggcttcaccaccttctcgaggtcggagccgagtagcgaggagttcatcctgagggccttgaggatcttgtcgaacgagcccacgatctggagccagaaccctagattcgtgccgacggagctggaccggaagcaggtgagggcgagcgggacgaggcgcgcgatctgggagcgggagagtcccaggccgccgagctcgtcgacgcgcctggcgaggttgctctccacgtcggcgcagaggaagcgcgggtctgcggtggcgacggcggcgatcttgcggggcgggaggccgaggtcggagaggaaggcgaggacggcgtcgggcttggagggggacctgaggtgggagagcttcttcgaggccttgcgcgcttgggctccggtgaggccccaggtggcgacgaggtagtcctcgacggcgaagggttcgggggagacgggcgcggcggtggtggagaagaggaggaggcggcggagggaggagaggggagagattgcggcggtgggatgaggatacgctggccggaggaggagagaaatcatatgcctccggaggtggtggaccatggcggcggcggcgcaatggtttgccggcggcggcgcaagggtttgcccgcggccgcgtgaaatcgcaatgtttacgtgcagtaacgttggtgggccatgtttaacggcccatttgaaatggacgaaggccttattttcggctgtgtatgttcgcgtggggaaagtccgctttacgttcccgaaggttttagagcgtcatctaactcgtatagctaggataaaattaagtttctcggtcgttctcactctgtcttaaataaaaagaatttttaaagagatataatatattttagtactatgtgttttaaaatataagagaccctccaaaatttgtaggacggagggagtgtttaagttggttttgacttgtatatcgcctacattacttgttgccttatttttcatcctatatccatatggctcctacacgatgtagaggcaaaataataagtaaataaaataaaaacacccgtggaaattaagtcactaagaatcttgttagaaaaatataaaacaatattatgcattattctaagcactaagattttaaatcatagtactcacaaatactatgcacgcgcgaataggctttcaataaaattttagtggtagatgcgtgtcactgatctctgtctctttgggcatgtcatccatgtaataaaaaaaaccttaaattcagcggttcaacttgggtgtgcaaatatatgcatgagtgtggtgtgtacatatgcatcatccgtgtaatcggaaaaaaaaggcaagagatgagaaagaaactagagcaatataaaattgcgtgtttttgcgtacgcgttaattagaaaagagaaaattttacaaaaactcaggtttttgggtatctataatgcaaaaccccaggttttacaaattgtttcataaaatcctaagttttgggtaaagtgtttcataaaaccccatctaaaagcttatattgtctatccaactaacatatttatctataacaattgtaaaaatggtatgagatatttttttttaagttcatgtacacgtgagagcattaccaagaaatccctacagctactcccaatttcaaacttttgggttttttctaagataaaaaatggatccaacagatatcaaaactatagctctgaaaaaatttgagaccctaattccgtgctttcaacagtagttgatgattatagtatgattttttttacatttaatcaattattgagttaggattatattgagtttctagtgcactaaaaagtaagaaaaaaattaagctagacgagagaaatgtgtgctttgagtcgactaatgtgaatttatgaaaaataatcatatgtaacaatgaaataggagtatttcatataaatacgaggtttttctgaaatattttgttctaaaataatgcgttcttggaaacaaaactcgtcagaaaaaattgcctttggtccaagaaaaaaaaaaggaagaaatactcgtatgcattttgttgcgccatagccgctagtccccggctccccgccctt

SEQ ID NO: 60763 - DNA, 2607 bp, Oryza sativa
gcttccgccgccccaccgtcatctccaagctccagtactacgtcccgctgttcggatccttcgagaccctcctccaggcgctcaagaacaactcctacctcctcagctccgacctcgagaaggttgtcaagcccaacgtcgcgctcctgcgggagtgcgggctaggtgcttgtgatattgctaagctgtgcatcccgttgccgaggctgctcaccaccagcccagagcgtgtccgagatatggtggctcaagcagaaaacgtcggcgtgcgccgtggctccaagatgttcaggcacgctattctggccgtcgcgtacatcagcgaggaaaagatcgccgccaaaatgcagttcttgatgaagacattaaagtggtcagacgcagaggcgaggattgcggtgtccaagcttcctgtggtgctgaggagctcggaggacaagctgagccgtgtgtcggaattcttgatctctgaggtcgggttggagccggcatacattgcttacaggccggcaatgctcacttatagcctggaacgccggctcatgccccggcactgcgttctgaagtatcttaaggacaatggattgatagaatccgacaagagctactatagcgcggtccaggtgaccgaggaggtctttgtggagaaatacataagtccatacgaggacactgcgccgcaccttgctgaagactatgctgctgtatccagcgtaaagatacccaccagattcagattgaaaggaccaaaaacaggccatgcaagtgcgcaaactgcctaattcttgccacgagtagtgagctggtaagtcctcttgcagtgttctttgcctgactggttgttgagtgcgctggttttgctgttgctagccaccaacagaactgaactgataattagattcttgaattaagatatgccatctggtagatatgtaaccatggcactgttatgaaccggttcatcgttttgtcacatgtgtgcaatcgttcattcgaatgggctcatccatctgtggttgtatgaatttgccaatgaagtcatctggtagatatgtggcaccgttatgaaccagttcatcgttttgtcacatgttttgcatattgttcattccaacagctcattcatctgtggttgtatgaatttaccaatgaagttagtcttgaacaactagctttgagcatatttaggagtatgtgtttacacattcccatctatgcatgtttcatttgctcttgtttttttcttcttctactagcaatctagcatatactatgagtccatgacacttcaaaaatttccattctgatgcaaacagtgtaggcaatcatagaatctctttgtgaaatcatgctcatattattcatatgaaatgtcttgattaattgatacaagaggcatatagatacatgctctgagtctctaccatgttctacttgatgtactgtgacatccacctgaagccatcgccgtagcccatccggcggacgacgctgcacatgaagacctcgaccggccgcactccggttcctgcaaggttgacattgcccttgccggtggtgaggccggtgagcccgaggtagtagcacagctcctgctcgggcaccgcgtacgggatgtctatcttgttcccgaggacgaggaacggcacgccagcgagcgcgtcgtcagacaggagggcgtccagctccatcttcgactcggcgaaccggcacctgtcggcagcgtccaccacgtaaactactgcatcaacctgtcaagcagacatgaagcttatgaagaagcagcaaaagtggctcacttcagactttgaagagggaagtagctacaaatgctggaaaaacaggtggtatttggctattgacaagatatgcaacagcatgtgacaattgacaaagtatgcatgagctggcgccaccactgtgattactgtgtactggctgattgggaagctgtgttcatactagcatgaattctcaggcaagcgcccaactcaatccctgttcattatgagtttcaaaggaaataaacttgttggtcagtcctgtaaatagtccattttctcctactctatcagtataaaaggcaaaccttttgcccgccttagaaaaaaaaagaagaaaaacttgttggtcagtcatgaatatacacatgctggctgtacgactaaagaaacatggtacagttcctcccgcaattgataccactatcagttttttcttggttttgttgtaacaatatgcagagttgggttatgcactaatatatatgactgtcaatctgtcatcccttaataaggtactagtactaacctacattattattctttttttttgttcagattccaccaaggttattatcggcgccaaatattaaaagtaagcttcctccagtcgccagggggctcacacaatcgctgccaccgggaggggatacttcgtggtcactcatgtggtgcacccatctcttgacgatgaatccccgtcaagtcgatgtccgaagaaggcgatgcccaaaggccacggtgaggccccgcttaagaaaaaaggagtgattatatcctatgtataccttttgagaaacacccagggatcttatgaatatcttca

SEQ ID NO: 60764 - DNA, 14290 bp, Oryza sativa
acagggtaacgatacgataagtggaaattatagaaaaggcattatctgaaaagtcattgcaacttgcaaatactgttcatcaccattttaaataagcattttttttttgtcccaggcatatgcttgaactttttaaaaactagtaagcccataaaccctattagagtgattcacactctctcaacgaggatggacggctaacagcgaaactagctcttgctagatgggagcatctgattccagtggcaatggctaaacctagatcagttaaagatgaaaccaggactttgatagctcatttaaatgcagtacctatagaacagataggaaaaaaaaaacagagattatgaggtcccaatgatgactgaaaaagcacactaatgctgttctgctgtatgaggaaatatgctggatgagtacacataccagatgatctggaaaattttggaagtgcgctatgtggaaatctttgagccaagccatccgaacccctgaatctgattatcagcaaccatgcagctagagtgcaaataatcaatgctataacagtagacaagacggcaatagcaattaggctgccgttgactctttttttgggcctgcctacatcaaccccgagaggcttcattgcccttgcatttctgttgtttccaaatgccccgtcaccaacactttccggtgctgaaggtggagaaggaggaagccctgcacaaaatccatatctttggtgaaaacttgtggtgcagaaattcagcatgttcaacaatgagaaagtgcaagatggaataagtttatgtctgacattgctgttgtttatgagatcaaccagatgactataataaattgatagcagttggtggcattgaccagtgacaaaaccaaatagagaaggcacatcaaaagcacaagcaagaatacacacctggatatacaacatacagaatctcgtagtccccaaaaactgatggttttagggaaatttttttgctccataagttttcaaacgttaaaaaagcagtagcattgtcaaacttcacttgcattggtactaggtcaacaagaactactgtcttgtcaggctgatcaccagctacatttgcacccataacacgaacctgtctctgtgccatatttaccccagatgacacttcttccgcaaaatcagataccaatggaaagaatgaatacagatcaacacttaagcggactccaactttgattggtagaacacaaacacatggggctcccgcaggtggatctgttagaggctctgggcatgctaatgaattgcaatctgcatttataaggctcattagataatgaaacaataagagcacatatattatatccatctgtaaatcttgaaaggacatactaggtatgtgaacatgtaaataaagcatgcacctagattaggcggtggtggaggtaatgcccaaataggatgggctgatggtgctttcggccctggttggggagggattggtggcatggttggagaaatatgaggccctgaaaaaggcagcattttttttcaaaattcatcagacaagagaaacatggatatttaacagggagataaattaaggctttgagagtacttttgtttgaatgagtgggagtccttgatgacactggtgcagaagatggagaatacgcaggcaagttcgtatggcctgggcaggagaataattaagttgttagtgctatcaaataaaatcaggacccatttggaatggaatattttcctttttcccatgggtactcataggataagaactaattcttgtgaaatccatacaaatagggcattaattaacacagaaacagcctatcaaatatgtttagacagcaatggcctacattacctcgaaacataggtggaggtgcatggtgcttttgccttttagccccagactgccttggagcccgtgagttctcaggacctataatgcaaaacttttgagaatctaaatgactcaatatagacaataactaggttgttggtagaagaattttgtcaaaccttgagcatgagatggtggataagatggggcaaatggaaggtgttctcctttcttcggtgccccaccccgaccatggtatctgctagaagttgctggtttaggagcagctactgttgaagggggtcggtcatgagaaactgatgatccattctttgggactgctggcatatttgtgttctggggcaaaggagtttctgcaggtgctgatcctgagatgaggaatttttgtaatcaagcaactttgtcatatccaagctaccacggcccggcaacccaatgaaattttctgagattacctctaattggcggtttgtgagctgtgccagtttgactactggattcctttggtggcagtgcacgtggaatatgactattcttatggggaggtgatgtatttgctgggggcactgagtttcctaaatatttaaaaacaaaaacctccaaaaatttagaacaaagggacttacaaagcatcatcagatcaataggattggatatgtttatacttcattctcaccattgctatggtcactacttggtgccagtgcttgctgacgtggtgcttgtgcaataataggtggtgcaactggaggttttacactttctcgcggaactcctattgaagaaatggaaaaacacaagcatacacaacatgattattttgattgacctcaaagcaaatagtttagtttacctgaagtggaaggaggaatggcaggtaaacttctttgaggtggtggatacggagggacgccattccctagagaaataaatgtatcaggtgaatatttgcataattgtaaggaacctttttggacatggacatgaagaagtccaggaacttaaggttttgagttgccactatcagaatatatacttatacgctgcctctcagaaaaaaaaaacagagaaagaatatatacctgatccaattggtctgcttggtggattgttcacagaaggaggttgcactatcggtagattaggattcctggccacagatggagcaggagcctgaacagaaggcaacaaagcaggtgtcccaggaagcactggtgcaggattttcaactgcagcttgcgggggagctactggcgccacatgagtgggagcaggaggcgtaagctcaactggaggaggcgcattatattctacataagacgtagttagtgatacactcattagaactgatgcgacatcatgatctaaccgcgggacgaactacctttagggggtgttactggagtaggcgcattttgtggtcgagtgggaacagctgggctgacagcgcccttcgccacaggagggcttgctgatggagcagagggtgctgagacaaagcaattgtaaggacaattgtcaatgctggttatgatcttgagagccataatgccacaccacattagaaattcagagcaacctgttggaagagttactggaccgagggcgattgtaggttcaggagggctagaagtttgatcttgagcatctggcgagttagcgaccacaggagaaggacccagatcagtacctgcagtggagtaaagaacacaacagggtcatggaatgtgccacacgtacactgatatccaactactaagctcaaaattgcacaaacaagttggtaaccaccctgtgagtgtggattagtactagaggcaatttgtccatgttgttttgccgtatgaaattagcaactaggaaaacaagaacaatggtaatgcaatgcaagtgcacagcaccaaaattatcagaaaagaaaacaaggtgtagtatgcaacaagtggggaagatacatattcagcgaagttaagcatttcccagtagacaagcaaatgggtggaaaataaagcacatgtgatggaatttaaagtggctagtaattagcacgagatgcctagcacacagccaaccagatatgccaagccaccgacattgcaccatccttcttaatgagaagaagcccattcaatcctaacaaaattcacaacatcctctcccaaatttgctcaaattttgaagtaggaacaggcaactgcatttttttttcccattcacagatcaattaggcagcatgtgcatcacagaatccatccatgagctctcctaacaaatcacacagcattcttctaaaaattctcctaacaattcaaacagcattctaaattaacccagaaaaaaccatggagaaacaaccaaatctccagattactggaccagcatccacaaccccatcatatgatcccaacctgaagaagaagaactaaaaaaaaaaaaacaggaggcgcaaaaacaacctgaaaaccatggcgaatgcccggagctcgtctcacctgtagatccaagaaccgaagcgagaagaagcaccgcgcaacaagcgagcgaccgcatctcgcccttcctcccctattgcgcctcacaccaagaacagccaactcaagaacagccgcgccaaaatgcgagagaatcacagatcacaaccatctcgggtggcgcgcggcgccgctcctcctcccgcaggaaggcgacggggcctgaccgccattttggcaccacgccatgagcagccacactcccatgtggggagggagaagaagagggcaatgaggaggcggcagaagaggggttagccaagcaaagcttgtactagtaccactagtggttactggttagtacagtacagtacaccacaaggcagtggactagtggtagctaaggaataaattagtgagaaattagcaacagaagaagaggagattaagaagaaggagagagctttgggtcaagatgcaagaaccagcacagtaaacattccttgcttgctgcccctgcactcctccctccaccactacccagatcatcataagctgatgaaagatgaaggattaaccaactaatcaggaagaaagaaagaacaaagcaggaatctttgcttggggctaagtaaactattcacccccaagaaacaccctcagagatgcaagctcgtcctctctctcatgcatcagagtgcctgtctgtctgtccctctcgctgtagattcttggtctgtgttgtggggggtcactctcctctcctgcatcgacagcctggtccccgttctttctcactgattactttatttactgttgcgaaatcggtgggttggatgggatcggagtatgcacagcagcagcaagaaccctagaaatccctctccctctctctctctctctctctctctctctctctctctcctcgtgccacggctttgtcggttgatcacgagggcgcgtcgaccatcaccgatcaccaagcacgcacggctgctccctcccagcgtagtaagtaaatgagcagacatcggattctggcgttttgatctgcatttgcaattcgaatttgattgcagaatgtgatggtggtgggtttatctgaatctgaaacccatcctaacagccgatctgcgtcagtttgcgtttggtttcgtcgggactcgaggttgtggcgtcgccatcaccagcgagacccatatatcagctcttctgctgctgtagctgagctctgctcatgcaccacgtaccaaaagaaaatgggattaatcttggcaaaaaaaaatcacaaacaacaggtttattagtagctaatcacgggctgttcatggtgctcttgaggtaatcattggttagaggcaaaaacaagaaaaagaacagcattaacagcgatagtcgattagtttactcggataaattgggagcttttgtcatcatacttgagctgctcgtgatcacggtaacagacaagcaagcaatgcccttccaagagcccagattacgaaaatcgatagtccaaaataggtttgcgcccgtgggagactgtcagatcctctagttaattaatcaaagacaagaaaagaattatacaacttggaatacaatactagtagcaaattactctcggagcttaattgtctttcacttcatgctcgaccagttcttgaagcaagcaaaccatgcaacatttgcaaccacaataaacaccatatcatctcatcttatctcttctcttatccatatgcaactcgatcaattcagcatcaagcaacagcaacattagaatgatgccatgtcatatttcaacctgtaaaaactaaaaagatgataaagcttctagagcagaagcttatatacacgcaacaaccgaaaatgtatcaaccctgaaaactgaaggaaactttttttccctttctttctttgcactgcatgaactgaagacatcaaggctacatcaacccatatatatgtacataacaaattaaatcgatccagaaaaaaaggaagtatgtgtagtgtatatgcttgtctccatatgtcgtggtcgcttgacctactctctcatgctttcgcttttggcatcgatcgagatggcatttgttcctgagattgcgtgacatgcaaagctgaaagttaccggtgtgctcgctctcgatcgccacctttgcttgctaacttgccattcatccacgtgaccacgtggtgatcctacgtggacacatatgtagaccatccccatttttgttttcaaatttctttttgtgtgaaacgatggtattttgtttttttcccccgaagaacacatgcaaaaattgtactacattattgcgcctagtccatgaatataagcatttatatgttgttctaagtcaaactcttttaagattgatcaagtttaacttatgacgaaactaaaaatatttatggccccgttcgaatccacctaaaagtgtggattaaattttggattaaagtgacacgcttttcaaactgctaaatggtgcgttttgtgcgaaaactttgtatgtgaaagttgttctaaaatatcatattaatccatttttcaagtttgtaataattaaaactcaattaatcacatgttattatcacttcgttttgcgtgaaacacttaatcttcatcagattcaaacaccgcctatgtcttggaactgggggagtacatgtcaataagaaatgagaatacatctgaccttgtatttccctcaacagaacctgcaagttataaaggcttgttcagactgcatggaacttctatgattagagtagacatctttaaataaaacctgccactagatcttttaaatgagtatggtccaatgactaaggtaatgctaattagtagattggaaaaccaagacccaacccaactactgctcttgtattatgttcttcagcaggagtcagaatagggcggtccaggtgtatgtgtgcagtaaagtatcagcaaccaacctattcttttacccaggtctatctgttgattcgtcccggccatcaaaatcaccatacaatgcatgccgaatgaagtggtaggttagcttaatttgcacagcgatacaaaagacgacgttgtaccagctcaatatacttttccagatcaatccaagtatcatctaactgtagtcggcaagaaaattaaccaaagtgtctgcagggccgtcctggttggtagtggcagagccaataaatttgaagagcctgggtaaatctaactacgttgaatatttgctaataaaaaaaatatttttttcaatccctgtgataacatcaaaattctatcgtgtatatgtcaacaaacatagacgctagggatgaaaacggtggaggagattcctgaccaactcagtatcttttttattctgaccgtgtatgaaaaaaaattctaatttttgagagcgttgtttgaattcgtcattagatagttgaagtgctaggtacggaaaattctgaccaaccgagaatcatttccatggaaatgatatcgtttctgaccattttcatattcccttaggattgctttgcaagtggtgagatgcgggtggagccatggtacagatcttgaaatggaatttctaatcatcttgaaatttccattattgaatttcttagtatcggtcccctctgacagcgcaatattgtttttttttttttttgaaaattctcaaaccatgtgtccatacacaattcagacaacaacagcaaataaagttccatgctgcttgaacctaaaattcccccaaatttgtttccttgatctaaaatctgtctgaacatctttcttcaaaatgtagttaggagccaagaaattaatggaagtgtcctgcctccagttagttggtccatctcctgtactcggtactctcctcatcctcacgcgcgtataaattactcatacacagctacactagttgagccgttgtttgttgctgttcgtacgtggacctgacaaaattaacaagccatcaagacagttgggctcacatgctcttgtctcttcacaaaccttaatgcaaagatctatctatacccaatgtctgaatatctatctgaatacctgatggaagcaaatgccaagaacacaagtaaatattcagggacaagacagcataattcattgccgcttaattagtacgtggggcacggatgcaactaggaatattaattagttttggttcgtgagatggatcgtcttggggagaagagaaatggataatgccatttaatttgtgtatattttaagccaatcacagttgatctgcatgcgcatagttgagaaacagcgtagtaatgatttgagttcgtgcgtggcattaattggttaggattttgggtgatggattcgatccatacctgatgacgtgatcgatttgttaggagtactgaacaagatggataggataaggtagtactctggtacagtgatgatcttaatttcatcattagtttaatgtttatgtatcagtttcatggattaatcatttgtgctagcactaaccatgtttaactgtacttttctcattttttctgaactcgatcttgccccccccccctttttttttctgaaagtgatcggaatatttgctatcttcagcaagaacaacatcatactaaaatcttcatgacaaattaatatatgttattgaattttgttaagatccgaaaatttatctgaacatgtaaactgactagcagcaagtgatccatagtgtttatcagtactgaaattttgatccgaatagttgcatgaatgcatggtgctgtaaaggggaaaagtgcaggcattctgctgagctgcatgtggcaaccgatcgaggctccaccaaccttaccctagcaagaacacaggccaatgatgcttttcctctcctctttcctgtactaacaaccacgagcagattgattaggttattgcaaaattaccagcacatgatcaggcaatggtgggattaatgattaattacagcagaaatcaccatcactcgctgtgatgatacacaccatcagagaaagaaaggatggctcttttacgttagatatccgcatgatgtctgaattctggatgcaatgcaactaactgaacgtagtacgtttatcttcagaacaatcattcagaaagcaaaagccacaccacatctcctcgtcgttgttgacgcccacattagcagagagacaccgagagatatctgaattctgaattctgaaatgggagtgaccactgaccaccaccaccagcagcagcaaaagtgaccgaatccaacgaagttgcagtgcagtgcagtgcagcgcaggcgacgcaaacgctggcacgagcaggcaggcaggcaggcatgtacacgcgacgtcgctttgcctgaatcaatcagcgcccaaagcagcaacttttcctttttgcactcgcaaagaaagaacacaagcaggcagcccatggcgatcattgcaaaccgctttgccgttgcctctctagctactgcctaggttacagttttcaggctgccttgcgttgcaattctgttcctcatcgcaaaatctctcatgcagcaagcagctctctctactctctagaagtatgaaatcatgaacgggatggtcaatgatgcatcggttgaaaaaacagacagtgatcctgaatccatggggcttgaccagcaagtctctgatagcactcctttttgcaggcccctccaaaacgaagaactgaagaacagtatgatgatggatttttttttcagcaaaaaaaaaggttttcagtgatcttttatctttgctcttttgctgcactgctcatatgcgctcaagaaccgagttgcctgaactagactgaactctgaagccctgaatggatgagaaatggagttgcacttgcacaggcacatacttcgataaggcttccatttttctggcacgaccaccactgtatttatttttccttttcttttctctctcttttgaagcacacgaccgtgataattgcacagggccgtgataatcgtggtagtagtatatgtgaatcgctagtgttttctcatcagcttaagcttttgagttgaactaactagttttatccgtgtatataactgaatatggtatcagagtaatgtccatctttcaatgaacagccagccagccagtcagtttgttctgacttctgaattctgatgcagatcgggttcagctttcagtctccgtggtgaggcgtcgaaacggagagaaatctctatactttgctcggcaaatgaacagtgggccggccttctcgttctcctggtccaaagtaggctgttagattaaaagcccattcaggctcggcccaataaaggtgcagacagacaaatcaggattcagggctttgcctgtgcagctgtggttgcgttcaatctgtgccagattttccatcagcagagtattcattcagttcatctgagttgatcagcctacaccatccgccccaaaataaatttacttgtgggtttttaaatccaacgtttgaccgtccatcttatttaatttttttaatgaaaaaagtaaaaaaagaatacgcgtaaagtattattcatgttttatcatctaataacaacaaaaatactaataacaaaaatattaaaaaaaacggatgatcaaatgttgaataacaccagagtaatgaatgaaactcttctctgcaaatggatctataaattagaatctggtaacaccagcccctgctgtgaattgctaaggaaaaaatacttctcagctgggggaggtttctttcagtcttctactgatgggggatcacaattttggaaaggacttcatgaagtaaaaaggtggatgaagtttggtagtgcatacaaaattggctgtggggattctgtacagttttgggacgacatctggttaggggagtctcctttgaaaatccaatgtccttacattcacagtgtttgcagtgaccctgacaaaaccgtgaaacaaatgttgtctggaggggagtgggaaattaatctcaggagatctttaggtcaagacgaattacctgattggctaaggttgtaggacttacttggtacagtccaactgacgacaaagagagatattatgatttggaaattgaatccatccgggagatttacaacaaaatctctttacaaggaaattttacaacaaaatctctttacaaggaaattgtttttgggggagtcaaagacattctgcttcaggaactctggaaagcccctacccccctaaaaacgagagtgttcatgtggttgatgttacaaggaagaattcaagtagctaagaagctcaaaaaaatgaattggtcaggtagccctctttgcaagctgtgtggcttggaataggatacagatcacctaatgtttatatgccctccggcacgttttctttggtgctgctacagagatgcttttgggtggaattcgatccctacttctagaaacgatcttctaaacctttttcagaatatgaggcgatcagatatgagagtgttgtggtgttgttttgttgcaggagcttgggctatttggcgcgtgaggaatgattgggtttttaacaatattcttttgcgaaatgttgtttctctgcctcacaaagccatgtccttcatgttacagtggaaagctttggcatcatctcaactaaggggcgagctggagaaggcacacggattactgcttgccaatatccgagcggcaggagactcaagcgcctaatgtcaccgtaatggtgaccccccctcagtagtgttcttctcttttagactcccagcgcctttttgttctatccctgacttgttatggctgtgccagcagcatttctgtcctacttaaactcctgtgcatctcgagctggcagtcccagcggttgtaagactctgttatgctttgctataaaagctgggctttggcctttgtccaaaaaaaaataaacttattttgggacggaggatataccattatagaatttggaaaaaaaaaacagtgcagtagcagatgttagcagaggagtcgaatgcatgtgtttgcttggccatactttgcctgcgagcactgcattgtgtattgtgtagcctgccaacgtttgcattacgattataaaaagggcagagatctgttactatcgctatgcagatgtagccatactgatactgctgcctctactctaccgatcggccatcaatggatcgatcgatcaccatcgatgcctgcctgctgcaagtctggatggacgacctttttctctgaattgaagctaaagttcagtaccgagtactgtagtgggactgtgtagtagtaaaagttatggcgctcgcagagctgcagatccgggaaagtacagttcttgttcatacattactgtagtactcgtaggttaacccttcaaaaataaattattactccctccataatatgatgtatgcagccaataggagagcacacgcaatatatacttatatcgtattaaatttctgatagttccctaattttttttcccaataacatcacatcaaatctttgaacacatgcatagagcattaaatatagattttaaaaactactaattacacagttaggagggaaattgcgaaacgaatcttttgagcctaattagtccatgattagccataagtgctacaataacccacatgtgctaatgacggattaattaggctccaaagattcgtctcgcggtttccaggcgagttatgaaattagtttttttcattcgtgtccaaaaacccttttcgacattcgatcaaacatccaatgtgacacctaaaaattttcttttcgcgaactaaataggcccttagatatataggtccactttgaattgcatgattggaaaaacggataaatagaaaaaaaaatcaagattctgacaagttcaaatgtaaagcagattaatacaaaacacatgaatgattgtattattgaactgcgggaaaaccgtatgaatcggataagagagatagcataaaagcaaattttccaaaaggttggagctcttactaagttcctctaaaatctatatgcaatgagtcatttcataggatttgaaaagcataaatctgtttaatcaaatagccgcatacaaaagtttctataggatttgaatcctatgaaatttctacataaatcctttgattcaaaaaggccttaagaggagagaccgagatagagtagctaagaccggtgttacacactgcacatcttttctccatcccaaaatattattatcttgtactatgaatttggacaagggtatcgcggatatgccccatataacactatgtagcatcacttttggatgaacgtgtaacgcaaaggacatgtctttatacgagagaggatataccatggcctaacatcatgagatattcgggtagagagaagagttgtggttattttactaagaagggcctcatcatagctagtttaaacatttgtgagcagttttcaaccgagtgcattctcacatgaaccttggactatacattacagataatcttaaatttggatatagcgcatgtttagatttacagtactacgttatgttcaagctaatattgatactagattaatatattttgggacgaaagaaatataagtaaaaataacgtaggtcactctgagtttttacaaaatgtgccctaccaatccatcgataacttcaatattacttctacattaatagagtttggtttgaagctaaattttcacaggtcaactcaatgtgatgtccatggccaataatttgataaggtaaaggtccaaaatgatcctttattgcttttaatccctttgtaaaaaaatttgtaaggaaaaatttgaacacagtggacatagtgctcgtcgagatttattcttatgattggatttttttagatgaaaagagtatgtgacatcacagatgtatgaatgtgcaggc

SEQ ID NO: 60765 - DNA, 746 bp, Oryza sativa
  unsure (1)..(746): unsure at all n locations
gcggcttganattgtaaaccttaatcccgcangcccgcagggcgactctagaggatcccccggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcacccagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggtttgatgtcgattctcctccactttatggttattctctgcaaaaggttagtaatcctaatactagtggaatattattattctaacttaaatatgcattgcaagtataactagttctcctctattttggtaatattggcggtcgaaacttgatcgctaacga

SEQ ID NO: 60766 - DNA, 719 bp, Oryza sativa
  unsure (1)..(719): unsure at all n locations
ctgcggggtgatgaacacgatgactatacgccgaattcgagctcggtacccggcgcacacgaaagaggacgagggcttagaaagacacacgcgccccctacctggcgcgccagatgacggagcgtggggctcctcaccgggagaccgcgcaggcccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtgttctggtggatctgtgtgtgaagaagttacagagagccggagagcaagagagttcaggctctagaacccctcttcccctttctctcctctacgagctcaggtattcccagagtcgtctgagagtccccctctctcagagttcccgtgggcaaggtcctccttttatatctcaaggggataccacatgcaccacttctacctactcttcttttgggtggggacccaccctatcttgaccaaaacttggctcgcgccttctgctggaaagctaatcacagcttgtccttgagtgagggccagngccgtnactcgccttcacttcgncggaagcagatgcaacgtgggagcacggttgtctgtcgatgacgtgaccgtgttagaccagtcacaaaccggcatttttgttcaccacgcgtcagttt

SEQ ID NO: 60767 - DNA, 20816 bp, Oryza sativa
cggcggctcgaggcgcgaggccgacggcgacgcgacggtgacggcgcggcaacggcaacggcgcgcgcgacgggcgggcgacgcggcgcacgcggcaggggagggggcggggctagggggaccacgatcgaacacctatgccgcaatgaacagtaacttttcctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgtactaaaatttaattattgctaatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatctctgtttttttatcgcaaaacattaaaaaaaaaggaaccgttgaaacgtgatcttgagtgatctattttcaattgcaccaacgaattaaactgaataaattgaccaagggttagtgaacatctccagtcattttttaagagctcactgtcgaagcacttgcatcaatcttcacaaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaaggcagaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgaacaacaaatatgacaaaatgagacctttaaaattaattccaaataaaagttaaagttcaaaaccacctctgaagtatataatataaagccgcatgctaagccggcaagatcctcgttctgtgtaccgaggatgcaacaagatggatttaaaggacaggccccatggaactttccgatatgttctcttgtgaatctatcttctcatttctccttcatgtaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgctggtgatcctgtgcacgctgctggcggtcggcgtgatcgtcgccggcgcgacggtgttcgccgtgtacctcatctacaagccccggatgccgtacctggtggtgtccgacgcgcagctggtgcggctggactacgaccagggcggcaccatcgactacctggaggcgctcgtcaccgtcatggcgaggaacaccaactccagggcggacgcctccttcgcccgcgtcgacctcgcgctccgcttccacggcgccgacgtcgcgcgcctccgcgccgcgccgttcgtggtggcgagcgcctccgcggcgccgctccggtacgacgtcgtgtcgaaggggcgcgcgctggacgccggcgggatgcgcgccatggacgcgtcgctcaagtccggcgtcgtgccgctcgacctcctcggccgcgcgcgcacgcggtggaaggtcgggatcttcgcgtcgctcaagttctggacgcgcatctcctgccgcctccacttcttctaccccggcaatggcaccgtcatggcctccgatcgcaacacctgcacctccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggcttccgtacgagactaggaggagaagtggggattggattgccgcggaattatctccgtcgctgtcgccaccggccgtggggaagcagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaggccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacggtggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctgaaataaattattcaggagttccaagccaaccaacgggaagcaaaggttcccaatcgaaaaaagacttcaaagtggcctttccaaacataaataaaagttccaggaatttgagaaaataaggatcccacaggggaggaataatttttggtggcgcagcaccttgaacgtatatacaatataattactttgaacatttgctgccgtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatattcccatggtatcaattttttattactaatctcactctatacagtgtctattaggcagaagaagcttagatgtttctaagaatcaaactgaactgggaaaaggtgttccctttggctaggattaataaagtactaagattttgagacatccaaatcctaaacaattggctggggattgctgttatcaccacccgggtcctcccatcacttaactcctccaaaagtacctttcttgaactaaattaatgaaacaatctgcatatataaagaagggagctgctcaggtggtgaaccatcttacctgtgacttagtgagtaacctctgagttcttctcttccaatctccagctctattttgcttgttagcttcatggccatttcgtcgaaaaatgttgctgtgttcaagttgcttctgagtgtcatctttttcatgcagcactctgtgccagttcatgcaaggaagctggtagtgagggcacctatgatctgcatgcatcctccatgcacacggaggaatgccctggaggtgccagctgaacaagttgattcaaccactccaggccatagccctagcattggccataacactcctcccaactgagatgatctgatgctgctactgtgtcccagcctgaaatttgtaactcgggtctgtgaaaactcgggtctatgaaactcatatggtgtttcctggagcttctatgcatttgttcagaaaaggcgtaaagcatgcgactgaagaagctcgcgaagattttgttttccttttttcttttgttccccaagacttgtgcatgcctgcctgcatgctttcttttgttacctgtgtgaaaaacttttcctcaccttgtcttagaggagatctacagatctgtagcctgtaacagtgtgtctgttgaaaattttaactctccatatgttatgaacttgagaatggatgttgtaaggcgaggttaatcggctattttcttcaaaattttactagtacaatattgtaaactttaaagaggtacaccatgagtggtcctttggttttctacatatcctttgttgagcatgtaatttcgtccatatatacatcaagtttgtgtaaattgatcaggatttttaaagtcaaaattaatttaattaccttcaaatgagactgaacaggaccatgtttttcttcagaatggtgtaggacagcggtaacattttttcttaccctttgttgaaagataaattaacgcttggggtgtacaattgtataatgctgatactattacttgacaagtttatggcacccctggagctctaatctaacatgtcatctcattgttgtgtctgttttcttctggcaaagtgtggtatttttcttacaaagtttgatatgtgtagaacagttttgttatactgggtactaaaaagaaaataattttcctttgttcttcacttgtttgctacataatactactaagcaacactggccccttaatttttttgatcatttagtatgaggcaaaagaatgcagtggcagtagaactagcactgtgatgttagtaaaatattaagccaacaaatggtgcacaaatcactttctggtccagttcataaacaaatcacagtgtcctaggtagtactccatgctaatgcatctccttttgaaaaaaaaaagaagcatcattgttgcaaagaatgaccaacaacaggtagtgactgagaaagatatttccgaattaaggcatgtgtgggaactgagaactgataggttatttttaacacatcttctttattttattttttttttttcttgattgatagagaatctgcatcagccatcttcagcaaacataatgcagtttgttggtatggaaatagtgtgagatatcctatgcaagttataaaccagtttctttctcttgccattggagagaaatttcatcttgagctgtcacttcaatttatggctcccctcagacactgattctcaatctattacattatcaaaacagagggaaaacaagcgtttaccttttgctttcatgccctataaatttccatgtgaataaaagaaaagaaataattccgaattattgattgtagtgcgggtccatattataactgtctagattagaaaaagaatccacatcaaatacagttcaaatgataattgaaatttggaatagaatgaaggaacttcagaatataaaatgaaataaaaaacaaccgatataaaagaaacttcacaataaatactaaatagtacttcttccatttttaaatatataacgttgttgaaatctggacatttgatcattagtctcaaaaaaataagtatatttattttattttactatgacctttatcatttaatgcactttaagcatgtcctatattttttatatttgcatatatttttttaaatagtacgaacaatcaaacgtatgtccaaaactcaacagcgtcacgtattaaaaacggagctagtaataaaataatctatctactttagaaattcccaaaaactgatggttcgtgcaattgccaagtgtcagactccagtgacgccgttcagaagaacaaagagtaatctttcagtaacccatagttaattgaaacactttatccggccgaggtatgagcattttcacagcgttgtcgatgtctctctggctgctggtgaatcaatgatgaatcatggtcaaaccgacgacaatacaagagctgggcatctgcaggtacagattagtgcatctcctttacaacaaagaaaacctcagtgtttttccttaacttgaccagcagcagctagtgcctgacaaagctgtttcctaacttgggtatgtgactaagcagtgataagatatctgaaaaaaataataagtagggtgattatattaattattcttaacaccttcactactaaccttttgttttttggtggtgatcaggtcactgcaattaagcaagtgatcaattgatcaaatcatcactagctaccctgcattctccaagataatcaatacagcttcagtgtggcaacaaattaaagctgctttgttctcttttgcagatcaatatctgtgcgcatgcttagttcatcacgaataaatataaaaaccatcacgcataaatataaaatcattcatctgttggtattgggctacgtggttgaatcgagtgcttattattttctgctaagttgtatttctgtgattgtggatacttagtgcaattgtgcagctatctgatcaaacttttctctctttttttaaacttggagtctttgagaattcagatatttgcctcccatctcaattgataagtacgaggtgtatacagcttgattgcctcaccggctgtcaggtggtttaattatctgtgggctttccactttgtgttggaaaagtggtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgagccgcgtcgacgtcttgaaggaagtagtagcaggcgagccaccagctgcggccatcgaaccagttgtcaacgatccgtcgtcgtcgccgccgccggcggtggcggcggtggtccacacgtcggagccatggccgccggtgcctccgtcggccccgtcaaacaagttcaactagctcaccagccgctaccaccaggatgtccggtcgctgtgattcggcggacgtcgccggagacgatggccggacagtcaccgtcatttcttgattcagataaaatcataaaaagcttgcatttgagcaagccgtataggtgtttgtgcgaggagtgcttctatgctctactggagagaaaaatcttcagattttagggggcgtctaggcttctagctggttgtgattaaactctgagttcgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcacgcccgacggaatcagagacagtgctagatccctacggccagcctctaaaggtaccggatagggtcgatccaggcgtatctctgatgtcgatattcggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaatagaattttcctgaaatcaatactcagaaaagaatatcaaatagaaatagcccccgagcgaatgcccaaagggtgacatgttataatatgtatggtaaattgaaaatgaattaaatttatcgaccaatgttttgtgtatgagcgtcttctctcttaccgacttcgatcagttagtttgtagagtcatacactctccctagcccccagccttatcgtcggagaatcgttctcagaggataatgctcttggacccttgacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaaggccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatagtgggagaaacactacatcgctggtcgaggaccaggcagtagtcgtaactcgaccacttaaagtggaagtaatgggagagatgctacatcgctggtcgaggaccagacagtagttgtaactcgaccacttgaagtggaaatagtgggagaaatgctacatcgctggtcgaggaccaggcagtagtcgtgactcgaccactcaaagtagaagtagtgagagaaatgctacatcgctggtcgaggaccagacagtagtcgtaactcgaccacttaaagcaaatgtacgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttat

SEQ ID NO: 60768 - DNA, 3519 bp, Oryza sativa
  unsure (1)..(3519): unsure at all n locations
cagatcttacatggtcgcttgtctctacatgatccgcaaggccttattcgctctgggcgtacccagccgaagttcccttaggatcctcagaggccttgtcaagacggcgtaaagggacatgaggataggtttcaacgctaggtgtcgtcgtggtaagggatcgtcgggaaagaacactttgatcgtagtctgtacctgaaatcaactttattgaagtcgtaagatgtcttacaagtatggatactattgatttatacataaaatttacgtaattgatcaatgttccaggaatttgctaactcgcgaccatcgtcgtctgcaatcttgaatgcaactggccgcaagacttgcgtgatcgtgtatggtccctcccacttgngtgagagctagttacgccctgcttggctttgaacccatcggaggacgtaatcgccgatcgaaagcgtgcgtgctctgatgcgcttctcgtggtatcggcgaatggcctgttggtagcttgctgctctgacggtaactctttctcgatgctcctcgagtagattcacaatcgncgctttgctgctccctctggatcctcgcccaaggacttcctgcactcgtggcgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatgggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgtttgccgtcatcgagcgagatgcatttgagaagtaccccgtttggtgccttcttgtatagatcgttgccgatcatacagtaaatcttggcttgtcgggttattttctcggcttttgcatcatcttcgggcaactcgtcactactcaggaaattgatgagtggggtctgccagtcatatgtggtctcgatgtcggcaacggcgcgttctgcctctgtagcccccgagccgatgtcggggacgactgtgctatcttcgccgtttgtggttttgtcaggatgtccaggaaggtgccaggttcgagtggctctcgtctggatgcacgccgtgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggactngatggctgttccgggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtacctttcttgatttcatgattactgggtaaagcagcttttggatctgggggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttgaaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaacccagctgtgagtctaccaattggtctattcgaggaagagggaagtgatccttgggacacgcctttgtgaggtcggtgaagtcgacacacatccttcacttcccgttgccttgcgcaccatgactggatgggctagccactctggatggagaacctctctgatgaagccagctttgagaagcttgtcgagctcttctcgtatggcgtgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggttggcgctggagagtggaacgatcttgattgcgtcgtttggcttcggcgtcttgttt

SEQ ID NO: 60769 - DNA, 5143 bp, Oryza sativa
ttttgagtttaattagtccatgattaaccataagtgctacagtaacccatatatgctaatgacgggttaattaggctcaaaagattcgtctcgcggtttccagacaagttatgaaattagtttttttattcgtggtcgaaaaatccttccggatttcgatcaaaccttcgatgtaacacacaatttttttttcgcgaactaaacaggccacgtgaatgtggaacaggtgcgtcaaccagcccgcttttaaatggggattctttctgtacagtacaacaaagaatctgttgaaacatgattatgaataaagctgttgtattttaacccagaaataatactgaattaaatttgaccaaagtaggtcaacagatccacagttttttaaaagctcctcgtttaagcatttgcatgaatctgcacaacagcacaaccatgagaagttactgaagaaataatacaaggagtactctacttcacaatactctgacaacaaccttcttgattgctttctttagagatagtttagaacacttatataaaagttctttttcatcgtagtttatttttcagcctttgcttttagatactacctccgtcccaaaataagtgcagccataaatatccgtgtttagcgtttcgactatccgtcttatttgaaaaatttatggaaaatatttaaaaaaatagtcacacgtaaagtactattcatattttatcatccagtaataataaaaatactaatcataatcttttttcaaataagacgaacagtcaaacgttggacatgaacagtgctaaaactacacttattttagaacggagggagtagtttagaacacgcaaataaaaattttacttacaaattattttttatacacaaatataccgtttggattatttcaccaaacatccaaacgatggggctgaatgaccgtaatgatctttggtctaaaatttatatcacaattggccgtttagagaagagaaaatgacctcaatgatctttggtttaaaaattatattgtgtcactggttccttctagcctcgtcaccttcccacacctaacactatcaatgtgttactcctaacactaggaatgaaatattaccgtattaaatattcaaaagcatgtattttatgagatggggttttgtgattcttcatatggaatcccatattcttgatgtcctcgtgtttgaatcgcttccttgaagtttctattctatcctagaacaatggaaagcagcaggaatatagacaaagcacgcaattctgactgaacaccacaatattagtagtagaggaaactgttccaaattctcgagagaggatattctctcgttgtttgcatgttatctaaataattatatattttttttaaaaaaaatcaacaagatagattaatatgtgatgaattactttacaaacaatgtatactcaaaattaacaactgcaaaagttacaacaaaaaataaatttgattgcgaatatatattaactagatatattttaatttgtttttaacttgcgtgattgtgaactgatctatcacatattaattaatctagttgattgtttataactatttggatgatatgtaatccataaggggatgtctcattcagagtttagaatcaactcccataatagtagtgaaaaccgagagattgtttgttcgcgctgccctaatggtggtcgtcgggcggtcgctgtccacgctgtcgtggatgtacatcgtctccgacatgagccacgccgggtttaagagcatcaacttcgggtggggggaggccatctatggcggtctggcgaagggccgctccttggcgtgacaaactacttctccaggtccaagaatggcaagggcgagcagagcatcgtcgtgcccaaacttctataccttcgtgcgaaacataccatttaacaatttaaaaaacgagctaacgaaaactgagatagaatcatatattacacacctggtgcacatacaccggtacattgcactagaatttttattattttttagactttttaattttaaaatagattgtccccaaaacttattttcaaatacgaaccttttaattacacttgcgtggtgaacactgccacatcacccaaaaacttataatgagagtgttagtattattttgccacaccaatctaattgacgtgttgaaagtcgaaaccaaagtggccacgctaaaaaaattcagattgtaaattagttttgcgagcccttatttttaaaatttttaattttaaataagttcagaaaacagaaaaaaaagggtacactggacatatttgaacgaggactggttgtagacccccgtttttataacaggaatcattcgtgtaaacagtaccattttcctggatcaaatagtctggtacatacgagttcatagctgaaataccaaatgcttatacacgagagtctagtgctaattattacatcataagcccgcaggtattgtcttaaatcatcggaccaagcggtccggaatacattccaaaagcagagttaggtaaggcagcggaattaaggcagcggcacgccattgccacaggcaacgaccgtaactaagacctactgggcgccatcgtcttcgtcatcctcctggtagtaagcgtaaggatcctccgaagcttcatctccgacctctgattaagtttgtatattgcaagggtgagtaccaaccgtactcagcaagccaccacagcaataatgcacatgacaggggaatccaaaggatggctatggttcttttgcgcaaagcaagttttataattcttttcacaagcctaagacctagcgtagactgatcaagttttaataccagtgttcacattaaacaacgatggttctgtccaccatccattgtaatcccaaggatagcttcccgccattgagtcgtcatgattttctgaggacgtccatattcccgcctctcaggaagtggctccatcagcataaaaatcatcatgcaatatcccatcccacacaagttaagaatttaaagtctagccaagtgtaatacatgttccggtactcattaaccgcgagcacggctattcgaatagatttggtttactcacactgcagtggatgtacactttacccgcactccgcgactgtccaacacgcctcgtcccaacacatgagacgcgtcacggcaaagcttttcgataacctcgcattggcagtacccgctccatgaacttaaatccttatgcactctaggcgtccatgtttctagcagtgagaggagttctgacgctcccgggaaagagaagtctcacacatattaaattatggttcaagttaagttctctctcacacactcatggcagtcctaccaatggcgacaccgatatagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctctcacaaatcatatcatcaacgtcatggcaatgtggcactcatgtctccacatgccgcatctcaattaccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaaggcatggcataatcacaagtaagatgttcatcattgcatgcaattttatttataaacaaaataatttcgcaattgggatcaatatattcaaagaatagtgatgacttgccttgctcaaagtcttgcggttcttggtcctcgcttggatccgcaactccctcggactctaaaattacgtgcgaagaaacgatttgaattcggttaaaattcaaataaagatccaaataaatccaaatggaagtcgaatgcgaaagttgattcttttatattaactttactattcgcgaactagggcaaatctaatttcgatttatacatcctaaactatttttcgggtataaatattttgttatcataagtttttaatttaatctacccgagcattatatccatataataggttagaaattttctatcgcgagctaaatatcggacggaatcaaaaaattatcttataatattatacgatttaatttaccctatgactaaccgattaaatataatatacgtctaaaattcctagtgattaaatccgaacttctaccgtgaatcgattacttatagagattatccaaaactaatctataatagtctataacaattcatctaattgtttagtcgttaattacatctaaactactaccacgaattgattttttttagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttcgctctttctctttttctttcttttctctctttctctctttttctctctgccggcctctcttttcctctctctctctctcggctctctcccacccaagcagcggcggcggtggacgcgagggggaaggagggcggctcaccggcggcggcagcggcgacgacggcggcggcgatggtggtgcacggcggcgcgggagtggcagcacggcggcacgggaacggcggcgcggcggcacgggagcggcggcgcagtggagagggaagaggggaggaagggtgagatggggtgggggaaaatggagagagggggggggtatttgtagagaagggagaaggagagggggaggggcagcggcgtaatggcgacgcgacggcggcgctcggggcgggacgacggcgacgcgcgggt

SEQ ID NO: 60770 - DNA, 741 bp, Oryza sativa
  unsure (1)..(741): unsure at all n locations
tcgggtttcgtaagaggtctgtatgtgaaattggatttttttttcatgtgggtcataactcatanccaaatagcatgcaaatctttttgcatgtgaacgctcttttggtccgcttgtataaaatagggagtgtgtccacaaaaatcggtttttagtagtgatacgtggacgacagtgatccacttaattggggagacgaacgaatgaaaacggtgggtggaagcagaatttattttctaaaaaagactggaaaatggcccgtgcattgcaacggggaagaaaaaaatatcaaatcatgtgtatgtatatgttcagctttgggaggacaggtgaggtggttggtgctctcagtggctttgctcctgccctgccgtcgtgcaaacaggctgttgacggtcgtttgcgatcagtttcgaccatcaatattaccaaaatagaggagaactagttgattacaatagagtattaaattcaaaacatgtgacatgcaatgttaatgtaatagcttcccttgcccatgcagtagacccttttgcaaaacgttagctttcaataacttcgacattgcactattggtgttagcattatccaaagtgatgaaaacaatttatcttcacaatacaatcttatatggtctctaggattgtattgaatataacaacatccatgtgcaatgtttttaagtgtgagaaccttaanattctttgggtggcgggtacgagtcgcagtntcaaccacgcg

SEQ ID NO: 60771 - DNA, 4721 bp, Oryza sativa
ttggtcatgtggctaatgggcggttgacgacacacggttgaggtccaggcccacctccgccccttttttcggtcccgaatatgttatacatatgtataaactaactttgtagatgtatctataccacttaaaaggaagcaatggtagtggcagattttctgccaccaccacccctatcaattacatgtaagtccctatttgtcagggtttaccttaccgcgggttaccgcggttaccgggcttaccgcgggggtacggtaatataaataccgcggtaacctccttaaatacaaataaatttaaaaaataatttgattttttgataaattttgcacggttttgtacggtttttcacggttaccgcggttaccgcgcggtaaccgtgcttgccgccggggtgcggtaaccccggccccggcggtaaggtaaaccctgctatttgtactctttaaaagaagaagagagtactaggccctctttgtttaggcttataagccaacttataagccaaaaagtctaagcctaaataaacaagcagttttttgtttggcttttttaagccataagccactctaacactattaagccaaaagctaggttggagaagctttttcagcttatataaggtagatgtatgactccaccactaaacttaagacattaaatccactggcttataaatcatataagccaataagctgacttaaaaatctaaaccaataagcctaagcctaaacaaagaggccctaagagaagcttttatttcaactagagagaaatagtaactacatcaaaatttgaaatgtaggatttgatttgaggataaatttgaggggttttttttccaaatttttttcacataatgatatagccatgttaagtttccccatgtgaatatgtaataccatatgattctctttttaatcccgttacaaagtatgggcattatgctagtatatagaaaatttatgtctctaattctactattataaaaattgaagatgtttttgccggtattttgatacgtcatccgtgtatgagtcggtttttaagttcgttcgcttttggaaatgcatatccgtatttgagtcgggttttaagctagttcacttttagaaatacagaaagagtcatataagaaatctttttaaaaaaactcgcatgctaatttgagatgatcaaatttctaattgcagcttatgattttctagaaaaatatagatccaaacgaattcacacagtgaatttcaccttaactaaaccgtataacaataataagattaaaataatcttcagccgttgcaacgcacatgcattttttctagtatgtatatactttgaacatataaaaaatctataactttatatgtatatataaaaaagtttatatatgtacatataaactttgtgcatatatgcattaaaaaattgtaaaaaatagataaatgtatgggcccggaaactgaaccgcgtgcagctaattagcgatttcggtgactaggactaggaggggagcaaagaaagcaaaaaaaccaacctgggcgtagtagtccctccagacgcggcgagcgatccggtggccgccgaggtcgaacgccttgaacctgatccgcccgatgctcagctcctccgacgtcgggtgctgcgtcggctggtgcaccgccagattctgcacacaaacacaacacagcccaaccagccatcaccacacaatgaacactcatgagcacaggcatatatgaatctaggagtagcttttgatatcatcaccatcagcctttgcaaatcaaacatatgtggcctttgcaaatcaaacatatgtgcagcgagcgatcgatctatataggccctatcgtttggcttttttcttaataagctaaaacggcttattagataataaaaatagatttgtaggtaaaatttttatatatgtgttcatggtgacttaaaagccaatgctgaaaaaaaaactacgttgaaaatatcttaaaatcaatctcaaaattaagtttaaaaatttaaaatttggcattttcttcggttgattaggccatccgatgggagcctatacctcttgtgagagcatgtagaagagggtggttttgccggcgttgtcgaggccgaggaagaggatcttggcctccttctgccacagcccgatcgacgccagcacgtcgtagaaccaatccagcagaaacgacatctccaggtatgttatgttcttcttctcttcttcctgttgttgatttgatttcaccagcttttttctagctaaacctatctttcgatctttccttgcgcgtgttctttgtatttgtagttacccggattcacgagatggcaaccgggtgccaaggccacgctgtgaggagtccacggccgcaacgtacgcgtcatctggcgaatctggtgcgttggtttcccatccgacgggagtccctcgattgctttcgtggtgccgccagcctacgatgggtcgttactgcgtcggtctctgtagaccgtggaaattaagcaaacctacacgaaatcatgctagtcaatcgaatttgtctatcttaattggtgtgttttttttaagaaacaagttctagatagtaacttttttttctcgagcatatgggctttctttgttataggggtaggaaatttaaaagatttcattcatatggaaaagaaaatcctatggaagcctttgaaacaaaggattgaatcatatccaatcctttaaaatttcaatggaatagataatcctatgtatattttagaggaaagttagcaagaggtctaacctcttggaaaattttcgttgagtctatctcattcatctgattcctgcgcttttcctatagtccaatcaaatggtcattcatatgttttgcaatcttctattttacaattgtattcctgccagaattctatgtttttcatattcatatgttttttcattcttacgattcaaagggaccctaaaggatcaccgacctatgcacatatgaacaaacacatacaaaggttgttatccatatattatcatacaatatcttagattcaaaatatcttaaattcaggttaaaataggaaataaacattactgagaaaagggctcatgttggtataatttagaaaaggaaaaatatgtgaaattaaattgaaacgaagtacagatagttaaaaaacttgcaaaattaaaaagaaaatttaacttacaaaatgttaaacacatataaaatagaacgaaggggattgtacttaaatgtttacatatttaggtataaccaatatatttatagcgcagagattggagggtattatttggattagtgatgcaaatacatcatggtattaccaaaaaaaaattgttggcagagcttgactggctcttaaattattcctcaactagaaatcacattgggttatttaggaccctttaaatcgcaggaatagaaaaaatatgaatataaaaacacatgattctaatagaaatacaatgatggcaaaatatataaatggttaaattggatcgtatagacaaaggatcgaataaaatagatatgctcaaatcaaaattttcaaaaggttgaaactcttgtgttctctgcaaaatctacctgtaatgaacctttgtatagaaacttcatagcattaagaaaacctcctttgaatcgaaggcccttcaaaaatagtagtatttcacattttcgcgattttacgaatttgtcagtggcaaagtagaaaaaatagcggaaccgcaggtttcctctctcccctagttcgccggcggcgtctgaccctagcgccgccgccgccgccatgaaccaccttcgaaaccagatccttcttctccgcgtccgctcatccagcacctcgctctctcccctctcccctgtccaccgcctcttctcctcctccaccgccgccgcatccatcgccgcagaacccttcgccgtcgaggactacctggtcaccacctgcggcctcaccggggaccaagcgcggaaggcggccaagactctctcccgcctcaggtccccctccaagcccgacgccgccgtcgccttcctctccggcctcggcctctcgcgctccggcatcgccgccgccgtggccgccgacccgaggttgctgtgcgccgacgtggagaagaacctggccaagcgcgtcgccgagctcggtgagctgggcatctcgcgctcccagatcgcgcgcctcatcccgctcgcccgtcagtccttccgcagcagctcgctcgccacgaaccttggcttctggctcccggtcttgggctctttcgagaatgtgctcatggcgctcaaggcgaacggagcgattcttggctccgacgtcgagaaggtggtcaagcccaacctggccctcctccagcaatgtgggatacatgtctgcgatttcccccatacacgcctgcccactgtgctctgcaggccacccaaccatgttcaagaagctgtggcacgcatcggtgagtttggcgtgccacagtactcaccggtgttccgcaatgcgcttgtgccatttgcttaccaaaacaaggagaagctcgctgccaaaattggagtccttgaaatgtttgggtggtcagaggacgatctctcgatgactatgaggaagggtcctgtcgtcatgaacatgtctgtggaaaggctgaggaaaaatgtggagttcttgacaagggatgttaagtacgagacgcgttacattgc

SEQ ID NO: 60772 - DNA, 9950 bp, Oryza sativa
ctgagaagaagtttcttgacaagtttgtgcattcttgcaagtgtagcattgcagatcctgctaatgcttatgcttctagctttgttggggatgttctgtgaatttattgtctgagaggacaacaggaaaatgggctcattcttgtgctgggagggtactgacaggattgttgtgttggaaagatcaagggtttagacttatacttttgctatctccttcgtgctcattaaggtttgctatctccttcgtccattgttgcaaaatttcttataactttgctctaggttatcttgtgttggctagtatcactattcactgattgataaacaggaacactacagcctgtggtcaccctctaggttgatggaatgttgaataacatttccaggagttaacatgcttttgttttataatgcagcatgtgtagctctgttgtttgtattcaggatccgatgttttccttccctaaacgggtttatccatgtctatggcctgctgccagaatcccagtgcatatgcagaagaaagaagacaaaaattaaacactatggttatcatatgtggtgggtttagttagttccataacttgggtaaagtttggacaatgagagatgctcactgcttttcctgggggctgttgttattttcgatcttttccttttctaacaaaaaactgtaatgactgccttagctctaccatgtttccttgggaggggattagtctgtccaaaacgatgctagagattaggaataagtatttacgtatttctcttttcctcaaataaaatggggtcaccaaggaggaacatccaatcaatttaattatcaagaacattcccaaattttaattcaaagaggcctcaaacttgtgtagtggggtactggagagtgtaccaacttccccagaatctttttaggaaattagtggcatgtacccaagtcccttaaaattttagaagtcttaatattaaaagaagtggtagaaatgatccttgaatttatccaatatatgagttgcaagcatgaagtcgtgtcttccccccaagaacaatgtattcatatcttctagtgtgcttcaaagtcaataatctctattcataggtctgacattttcatccgagcaatagtgctgtttacaattggtgactgccgtcactattgtttctccaggaaatttcaactcaagtgcttataagttacttatcactgttttccgatagccttagcccttgagcgatatggttgttaccctggcactgcttgttcaagcttctaaaggcaaagggattgctgaatgtgaaacttagctactacagcattgcgttgcaggtgaaaagaagttaattgacaagttcatgcacccctacaagatccaggcctagtgagcagatatgcttgttctgggaaaaatacctgactgaagttctattctagcagatgaatgagaactagagaatgcgctcacgctccccattgctttgttggaagaacatagggtttgccatcccccttgtacattgctattaccctttttgccattttaccgtaggtgatccattgtagtaccacatgcactacaattgattccctataaaaatgcattaattgattagctgaaggaattttcttttaaaaagttgatgagcagcagagctacagtatggctcccatcttgctaggcatggattagatactgacatttccatgagaaacatgaatgatttgttgagcaagcatgctatttcccaggttttaactgtttgtttttcaaatgccttcatgacactatcttagtttgtctgagattcgtagtactataatgtgttgcatcacatactacattaggttttttttggatggattgagtaattatttatgcatggacttgacatctctttctctctctctttctctctaggattgaattgttacatttcgatatgagcttgctcaaagacaggtttggtaatttgaaactttatattattcatggttccagccgttcaatccttcatatcatccagaattccagggctggggttgcatctgtagcccttcatcaaccccacaaaattgccttgaaaatatgttgacatccaagatccaaccatccgtatcaggataggggatccttgaactgactgttgttcactacttcactccatatgatcaacccctcgaaattccaagaccaaaaccaatgggcctttaattaatcttacattggtcagcctcaactttagttatgtaggccaaaattataacagctaaagacaatttataggccaaagtagataccaggggttcaccttttcaattgagtgctggatcacgagccccaatagtataactttttcagtcaaatttcgatcaaattttactatttccaatttgaattctcaaaaagcattcagattttcattcagaatccactttcagaaacctcaaaattcacagttttcgtaaaaaagaaaaactaaaccctggttggtacccaatgttgatctaagatgggaccaaattactaaatggaaaatggtccgtaattaggtccacactacaaatcagccctaaactgcggacttaattaaggctacagaaattatttaagcccgttacaaaatttattcggcccatttagtttgcaaatgtaatacctcgaattgggcctaaagtttccttgttgggaaaagtacaccgaaggtccctcaacttgtcatcgagttacaaaatcgttccccaaccacaaaaccagatatcggaggtccctcaactaacgaaacagttcgcttgaggtcctctgatggttttggacccggttttgtctgacgtggtggctgagtcagcgtggaccccacgtgggccccacgtgtcaggttgccacatcatcacccttcccctctctctctcacactcttctctcctcgctcacggctcactcgctgcagggcgcgcgcggccgctagggggcgacggcgaggtgggcggtggcggcgacggggatggggatgagaacagcgggggaaggggaggggagcgagtcaagggcggtgagggagaccttgtcggcggcgaggcaatggaggggcgaggtgggagaggaggacgtcggcggccccacacacccgcaaccacccagcacgcgctgcagatgcctggcggtccctcgcgtgccgccgttgcggacgacgacgacgaactctcgcgtcttctctccctggccgaggccgacctcgacgccggccacctctgagccgtgccgcccgcctcgacccggactccccgcgcggctcgctcctcctcaccgccgcccgccgcatgctctgtgaggtgggccgtgacggcgtcgtcgtcgtcgccggccgcgccgtctccgcccagttcgccacggctggcgcggacccatcctctggcgccgcgaccaccgccatcgccaccatggacgcctccgccggcggcgggggaactccctgccgacgaccggcgccgacggggtgaagcggcgggtgtgctacttctagcgcgcgaccacgacctctgccgcttccacgccgacgacccagcaggaccagatccgggcgctcaagcacttcaacgtcggcgaggactaccccgtcttcgacggcctctacagcttctgccagagctacgccggcggctgcgtcaagctcaaccacagccacgacatcgccatcaacgccctcgagctcgcccgcacggcgacgccgccgcccagctcctcccccggcggctgccgcccgcgccaagctccatcccgccggccgcgcacttctccgcccccgacggccgcgcactgctccgccccccacggtcgctgcccagctcctccccggcagctgccgccggcgccaagttccacccctcgccgccgccggcttcctctgggccctcttcccctcatgcctccctcctgccctccccggcggcggcgcggtatggcggagctcaaggatggcgaggacggcgcggcgtcgtgggcgggcgctgggtggcgcaactcgagaacggcgagggcggcgcggagatggggcgggggtcgttggcggcgaccccgacgcggcggcctgatcacgcgtcgcggctgccatcgctgcctcgtcggccgccgctctcaaccctgtcacgccgctcgtggccgaccccttcaaccagtcaccggcgtcggcatcaccggaggaggagaccgcggccatcgcactcgcgcagagaggagaagagtttgagagagagaaggaagggagagagatgactcatccccacacgtgggacccacgtgaggcccacgctgactcacacgccacgtcagacaaaactgcgtccaaaaccaccagaggacctcaaccgaacggttttgttagttgagggaccttcgatatctggttttgcggttgggggatgattttgtactcgatgacaagttgagggacctttagtgtacttttcccttccttgtttgtgagctcaccgagctgagaaatcataaccctgtgatttcacgcggccgccgtcggcaacccttgcgccgccgccgccgacgacgacgacgccatgatccgcctccgggagcgcatcctatctctgctcctccagccagcatcccctcgcccaatcgccggaattttcccgccgccttgccccctccgccgcctcctctccaccaccgcgccagtttcccccaaacccttcgccgtcgacgagtacctcgtcgccacctgcggcctcacccgagcccaggcagccaaggcttcggagaagctctccaacctcaggtccccctccaatcccgacgccgtcctcgccttcctctccgacctcggcctctcgcgccccgacggcatcgccgccgccgtcgccgccgacccaaggctgctgtgcgccgacgtggggagcagcctcgccaggcgcgtcgacgagctcggcggcctgggcctctcccgctcccagatcgcgcgcctcctcccgctcgccggcaggtgcttccggagcagctccctcgccacaaggctcgccttctggcacccggtgttcggctcgttcgagaatatcctcaaggcgctcaagatgaacgccgccctcctcggctccgacctcgacaaggtggcgaagccgaacctggccttcctcgcgcaatgcgggataaacgcctccgatgtcactcgcacaaccttgtccctgtactcctgccggctcttcaccgtgaaccctaggttcctccaggacgctgtggcaagagtggaggagttaggcgtggcccgtggttggaggacgttccaccgcgtgctcagtacagtggctttcttaagcagggagactattgccagtaaaatgcagctgctggatgatcttgggttttcgcaggatgatttcctggtaatcgtaaggagggcgccacaagtgctgcgtttatccgatggaaggatacggcgatctgttgagttcttgataagggatgtcggtctggagcaaagctacatcgcacaaaggccaacgttgttggcgtatagccttgagcggcggttgttgcctcggcattgcttgctcaaggtcctcaaggcaaagggattgctgaactgtgacttgtcttactactgcatagccgcgatgagcgaggagaagtttgtgcaaaggtttgtggatccttttaaggacaaaattcaaggccttgctgatgcttatacctccagttgttctggggaagcaaatggagttcgttcattggtttgcctgtagactgaaattggatgatgttaaagtttatgctgggaaatttggctagattgttgcacaagaatgcaaaatattaaggtttgtgatcccttatcattttgtactacctttgttaaaacttgtgctgaaaaagtatgtaggttatagttgtatgctacatgttgtatcttgtagctctggagattcaattgcaaagatttaatggcaatgggttaggaacaaaaatgtattgtcctgctggactgaatctttagacttccacaattcatttagcacctgtcaagaatatttctatagatcaagtgttgcaaaatggataggaacgaccaggttaggagtacttcttgttcaacattccatctgtgatttggcggcaaccatgacgttctaaatgacttaaaagggtaatatgggctacaactgtgttgggacttgttttgttctctatggcaggattgtcgttaaatgtaattgatttgtggctaaacggagctacaaccttggcaccacgctgaggctaggtatgcaggggatctgtgattatttgccacagctcacacatcatgtgccttcctaaagtggatctcatggtgctctaggtggagcttgaattgccctttcctgacaccttactccctgcttctgcttgaacattttgatgaggtgaaggatcatttcctaccctgtgctgctaccctgcacctgccattttgtctccctgtgcattctcatgctgttgtcatctattgtcgtaagtcttagccgtaaaacattaggataacattgtggccctaacttcgctctgttttaaacttaaataggagtagataaaaaagaaggatacgctgtttccaatgcgatataatcttctggatacactgatgctatttcttgcaagaatttgttgacaccaaatcttgtaggagtatttctctaaccacacttctttcctgagattgcatcttcatatatggagttcctgacaaacttagattttttttctcttgtcagcaggtgcacatcaggaacaggaagtgggctaagggctttcttgcagctaccaacgacagcggcactaacaccaggcggcattcgtcgacacactgcatttccatttcaccctgtatttgttccattcagttccctattatttgttccattcagttccctattgattttgtggccaagatcatcgtcgtaggttgtgatttgtgaatatcattgttctcacgcaatttctgtcttgtttgttctgatttggcgtccaagatggatgaattcggaccatcagttttactctcgttaacaaaagaggcccaccaaagaattcagcccaccttcggccatggagtacttcggcccggatttgaattcggccagttaattcctctcaacgagtttggcccaccaacaaatttgttaatgggcttaaatctggtcattgacgatgcttaattggcccaatcataatgtccactgggcccatcactccaactccaaatgggcccaatattagaggagtttctttccgccggcttcgatctgagcaagagtaggcgtagccctgcgatttcacgccgccgccggcacctggcaatccttgcgccgccgtcgccgccatgattcaattccggcggcgcatcctcactctgctcctccagccagcatcccctcgccccatcgccggcatttttctgcctccttgctccctccgccggctcctctccaccaccgcgcccgtctcccccaaacccttcgccgtcgaggactacctcgtcgccggctgcggcctcacccgagccgaagcagccaaggcttcggcgaagatctcccacctcagctccccctccaatcccgacgccgtcatcgccttcctctccgacctcggcctcccccgcccccaaatcgccgccgccatcgccgccgacccgaggttgctgtgcgcggacgtggagaaaaatctcgccaaacgcgtcggcgagctcggcgacctgggcttctcccgctcccagatcgcgcgcctcctcccgctcgccggctggtgcttccgcagcagctccctcgccaccaacctcgccttctggctcccggtcttcggctcgttcgataagatcctcaaggctctcaggatgaacaaaaacctcctcagccccggcgtccagaagtcggcgaagccgatcctggccttcctcgagcaatgcgggatcaatgcctctgatgttgcccgtagttcaaccatgtactccagccggctgctcaccgcgaatcccgagtacctccgagacgccgtggcacgggtggaggagttgggcctggaccgcagttcgaggaggttccaccgtgggctcgttgcggtggctttggtaagcaaggagactgctgcgaggaagatacgattgatggaggagcttgggttttcgcaggatgatctgttggtgatcatgaggaagttgccaaactttttggctttatccgagaaaaagatacggcgagctgtggagttcttgaagagggatgttggtttggagggacggtacattgtgcaaaggccagtgttgttgtcgtatagccttgaacggcggctgttgcctcggcattgcttgctcaaggtcctcaggacaaagggattgctgaatagtgagttggattactactccacagctgcattgagcgagaagaagtttgtcaacaagtttgtgcatccttatgaggaccacattgcaggccttgctgatgcttatgcctccggttgttctgaggaaggaaatggagttgcttcattgcttagcctgcagactgaaatggatggtgttcaagtttatgctgggaaatctggctagattgttgcactggtatgcaaaatattaaggtttgctaccgttagtttgtctcgtactatctatgttgaagcttgtgctgaaaaagtctgtaggttgtttgttacttgttgtttcttgcagcttgggagattgagaatggcgaagattttcttgttaggaaaaaagaaggcattgtggtattgggctgaaatcttcagatcaggaaatttccttggaaaaaaatgaatagctcacataccatttgactgaaaatatagaacacagatgtggaatttagcacatgactagaatatttctatagatcaagtgtttcaaaatggataggaaatgggcaggttaggagtacctatcaacaatccacctgagatttggttgcaactatgacaggaacgtgctcagaatataatcttgttgggggatataatccaaacattgcaaataatttggaaaggtaatatgagctacagctgtgttggggcgctttttttcttttgggttctctttgacaggactattgtcaaatgatattaattgattatgctggggctaacaatgctggagaggtgtgaatgagctgagctgccacaaatcacacgacacatattgctccttccggtggagccagaaatgccccttcatggttgatccttgcctgatgctgctctaccttctcgatgcgcttatggatcatttcctaccctgtgcagctgtgctgctcagctgcttctgccatgatgtctccctgtgttttctggctgctcaccattgcaagaatactgttcgacgactagctgacccatgttcttctagctgtgccggcaaaatacctaatgaactatattagcagttgttctaaaatatcatattaatccaattttcaagtttgtaataattaaaactcaattaatcacacgttattaccacctcgttttacgagaaacacttaaactttatcttcaacttcatcttcaggagattcaaacaccatcatacattcatactataatcattttgcaaaaagaaagagaatcatgttatacctataaaagtcaatctgctaattcaatgttactggactctatttattcagccatttggaattctttcgatcaaacattcaaaccgtgctcaatttctctctctctctctctctctctctctctctctctctctctctctctctctctcttctttttctttgcttgcctgacaaaaaaaaaacatcagccgctgcccgtccaaaaatgcaggccttcgcccaacgggctacaattgcggcccaacaacttttaaggccatatcgaaactgcagtatttgcaccctagtctctactagtcgtagcttgcgatttcacggcggcg

SEQ ID NO: 60773 - DNA, 3568 bp, Oryza sativa
tccgaggtagatgcttcggtggccgcacacttccccttcgtcttgaccagcggcgaaattgctggctcgcacgcagggctcccgaaaaccctcgccgcagccgacacgatccgatcgacggaggcggaagccccggtggcggcgctaccgcctgccccagcaaccccgagcggagcaaggggagcagtcgaaaagtccaaactacggccagcaggtgaagtcggagtctcgtcagaagactcgtcgtcgctaaaaacgcgagcgatgtcgacgagtcccttcttttttgagatcttcttgaccagacctcctttcgccgccttgcccgacgagaacgcaactagggccttcgccccttccaaatcctttcgtcgaaggggggagctgttcgactccaccccggtctcgttgtgacgtggacttggggtaggagtgtagccgggggtgtcgacgcggtcttcgatcacctcgttcgcagccttatcagccacagcctccacctcctcttcttcctctccttcgtccttgccgtcacgttcttcggcatcatcctcgtcgtcggcgtcggagtccaacgaagcaggaacccttcgcttcctgggggcaagcttcacttatccacgcatcgctttcgcgaaggtcctgcatcgtcgtcggctttttggggattcgcccggggaggcagttcgccgttgtaaacccggttcgcccgcccagccgcttgtcgtgttagcagctggctatactcgacgaccgaaacgtcaccgatcatcctgcgggcttcggcttcagcctggtcgagggtcgatactgcaaaagtaaagggtgtagctgcgttaaaggtcagacaaggcaaaataacaaagcacaggagtgtatagcaaaaggcggtcttactgttcgtcccctcaggaagaaccaagttcggcaaaccgtcagcctcttcgcattgctcgactgtgacttgccatgactgggagaggggaaagatgcgaagcaaacagaactcctccaccaagtcagggcttttgccgagtcagaaccacctgcgaaggggatggtgtgatagaaccacctcgccatccaatggcggtcccacttcgacatggcagcgttcaccggccagagatcggaccgctcgaggcgaacgttaaagttcatgctcccgaacactgtcttcttcgttccagccggggtaatcaccatcttcgagttcacggtggcgaaaaatatggcaccgaagagctcagcgctgggctcaaacccggaagtccggcatgcccagtcaaagatggagatccgaactagcggcgatgggctcaactgcggaagctccacctggaaaaggcgaaggatatccggcaacaacacgttgcacggaaaccgtagccccacctcaaaaaagacggcaaacaccaccgtccgattgtcgacaggcttcggcaccacggctttccccggggcgaaagcctgccccttaaccaacgccccagagctgaccaacttcgccagttcgacgtcgtccatgagagaaacccccaaaaaggcggtgctgtcatcatcaacccgaccgggatccggtccttttgccgaagctaggtttggcttgcgaggggccatggcgaacggcgtgtatgcggtggcgaaggaagagaatgggcgaaacacctaaggggtcaagaaatgctgtggaagagaggaacggaagaagagagcgcacgcggtaaaaatggcaagtgtaccggtgaaaaggaaagaggggtgggaatatatagctcacccaggcgaccgttcgtctactcaccagtaataaagcgccacgtgtcgcaagggtaggcgaaacggtaaattcccaccgtctgagcggcacagtaaaaagcctacgatgggaaggcccaatactgttccgttcggcccaggaaaataaaatatataaccaccaatcgcacgaggcgaagcgcggcaaaataataccagccgcacaagtaacaaacttcattcgcaggaataatgtaggtttcggcaggagcatcggtcgaaagggggcgccgcataccagaccacatggtttgcatggtctcggccgaagctccaatctcacccgtgcccatgaggggcttgttggcggatggcatgaggcccttcgaccaagtctgcccaaacccgtggcgaaggctatggagcaagaacgacgtgaggcgaagagtagtacgagtgccttgccgggccagaggcgtctcaggcgaagggtgcaaggcgaagactatccgccgaaggaagacgacttcgccatgacaagttcgctcccgcgagggccgaagaagcctttccggcccatcaagcctaggggctatagggccggcgatcgcctgacggcccatcaggggcctatgagcccctataacattatgtacccctgtaaatgtccctttcgtaagggtaatcatgtaaattcccctgtacaacctaaaccctagtagtaggatcctgtaatggggctataaatagtcccctagggccatgtaatggggggatcgaaaagaaaagaatttagaaatttaatacacttcgtttccttccaaccactgttgagtaaccacgtctttcgacgtacgcagttgtcatttcgacaacataggtcatcacaagatctgatcccccctcacaagtgtcgaaacggcaaaagaagatgtagcttcaggccgtgcacaacattgtctcagcaggtgatagcgttccaagatacttgtcacagccaatatcttttggaccagaacatgccgaaggagttctattcctgcaccaggacccgttggtcgtttcagcagaaatagccggttttgaagtccggcgcatcctgatcgatggaggaagttcggctgatgttatgtttgctggaacatatgccaagatgggtttgccaaccctggcactgtctcaagcaccgacttcactcagtggtttcagcggcgaagcagtgcaagttctgggacaagccctcatcaaggttgctttcggctcacaagaaaacagaagagaagaagagatactgtaacaccctgaaaattcgaccgacaaaatcaaaactctaaaaatacggattttcaaaaactttttaaattaaatgcatcatgccgatcttattcgcctattttatttggatttaatttcgaagttcattaatcgtgagtaaagaatagttaattaggaataaaccctaaaaacaaattgataaaataaatataatttaaaataaagattaggtgtggatagaaataaaatattatcgcgaccatatttggatcaattgaatttaaatgcgatggaataagaattaaccctaattaaaaattcaaataaattatataaataaaatatgagtaatattaatctagagtaaatccattggttggaatgacacaaatattgagtaaacttcatttatacaagatttaggatttatagaatcaaatttaaataataaataggctaaaatcgggttaaataagaaaagtcactattcattgccccctaggtgttcgatcgcgccctagcccctcctctgcca

SEQ ID NO: 60774 - DNA, 14794 bp, Oryza sativa
cctagaatggtcatttcattcataccgctatatgcgaggatgacttggcatgctcatgtggcactttttttgggtctaaggactatattaacccaaatgattaatttggaggacttgtttggatgatttgaaatctcaaggactaaactaagtctgaagcgaaacttgagtgaccatattagctattcaccctaaaaaaaagtaattaaggaaatgtacattccagaccgccccagggttattgaagctagcacacagcattggcgatctctgcacgcacgaaacgatgtcagaatcagatctcatcacgcacaagaactcaactgctaaaataatcactcgcagattgcattgatgatgccaccactatgaatttatctatgcatatattcaaaaatgaattttatatatacatgtatgcgtacgtactagttaatgacagtcagagagaatctcaccggtcacgtagtatacatatatatgtccatgcatatagtacaatcgtataaaattgactttgcacgcaaacaatataatgtcctacctccatatttttattttaatgtataacgtcgttaactttttatccaacgtttgaccattcgtcttatttaaaaattttatgtaattatcatttattttattatgacttgattcgtcatcaaatgttttttaagcatgacataaatattttcatatttgcacaaaaattttaaataaaacaaatgatcaaacgttggtcgaaaagtcaacggcgtcaaacattaatatacggagggagtattcaagttaattaagctagccgacaaacaagtttgcatatataagctgacaaggatgacacatgaccaattaatttaattgaaaagaaattagaccgatgcaaaagtaaacaaccgttgcattttcaatcgacagaacctgagcaccgggggtgagcgctctgaatttgatctgaaggtgtgaaaagggtaagaaaattattgtccgtatcgatattgtttccataaaagtaatagaaaaaataggaaaaaaaaagtacgaattaccctgccgaactattgcggtcgaccggattatacccctaaactcaaaaaccggatattttacacccttaattattgaaaccggacaaataacccccctaaacactattttgagcggttttgactagaaatcacacacgtgacgccaacgtggcaatccagtcagcaaaacaaaacaaaataactccctgggcccacttgtcagatttatccctcaacccccctgctctctcttgcgcatgatcttggactagtagccagcgacaggcggcggaggcggacctcgcccggtcggcagcaggtggcggaggcggacttcgtccggtcggcagccggcggtggaggcggacctcatccgggcggcggtggcggacttcgtccaggcggccggcggcggagacgagccttgctcagtcgttgggtggcggagacggaccttgtccaggcggcgggtagcggacctcgtccgtcttggttgaagtcgatcctctctttgtcgtggtcggagaagatgcggtcgccggggcggcctcgagcccatgacgagctccacggagatggaggcgtgccagtgctctcctctcctctgcactcctctctctcctctcctctgctctctgctctctcccctccacgcgcgccacggagccggcgcggccccttctacgactcccgcaaccacctccccaccgttgggagccgcggcgggcgagccgatgcaggaatggtccgtaaggaggcagtcgtgcgaacaggaccgtgtcggcgcctcgtcgacctctgcccaggggcgaagctacatgcagatatgggggttcttaggaatccgggtaagaggagagttttagctatggttaccccggagccgcctgcctgcgcgtgcacacgggagagagagagagtgtgaccggggggagagagagaggggtattacaggtgggcccaagggaggcattcttttttttatttgctgactggattgccacgtaggcgccacgtgtgcaaactcaagtcaatattttagaggtgcttatataaggtgtgcatattttgtattcatatgagtgagtgtacacatattataagtgtctataaactttatagacgtttcttttaaaaaaaagtatgcaagaatactcgaagaaaattggacatgttgtaaccataggaacataattcctaaagtattgcataagtatcaattaatcttatagggtaaacaatactagtaataatattaattttgtctaaagtgtgacgatgattacttcagtctgatatcaacttcaaaaaataaccaaatctagtttaactgcccaagtatcgaggctaaagcatctcttgcatatacattgacacggatcctctgtcatactatatctaaagtagcagtggctaacaagtaaacccacatatcagtgacaactattacatatgtcaaactacatacaatccttactggtacataccacgtttgaaattcttgtcaagctgaatcattttttggttagctagctaggtatggtagcttcaaaaaattacttcctccgtttcacgatataagtcattctagcatttcccacattcatattgatgttaattaatctatatatgtatatatatatatatatatatatatatatatatatatatatatatatatgtctagatttattaacatcaatataaatgtgaaaaatgctagaatgacttacatcgtgaaacggagagagtaattcctcaattcagccacgtcgcatgaaaacttcaaattttataggtatatatgtaatgaacgaataataatcagctttacctgactgattattgaatatattgattgattcgaagcttaaatagcgtacacgggtgaacagtgtgggatcgtgtgctgcagctgcatgtcccgatggatgcatgcacgcatcgatcggcacatgaaatttcgtgcctattattagatcacccacaatgataaagtaagttgctctctataaaacatgtacatctcagcaatagactagattaatagtaaaccacctcaatggtatgtctatatgggtatctatagttctctaatacattgtcccgtttttctctatagactgtcttcaagttagtagatagttttgctctctctttatttaatctcttccaagtagtaaaatatgctgacatggatctcttgtagagagcctatagataaccattgtgggtgcctttatacttttatttttttccttatttttttcatagccgggaattaagcagcagggcacgtgccacgccacgccatgatgcatgcatgcatcgagcaaattaaacaaaaattaatatatgcatcaactcgatctcactctgccttgcaatgccctgccttgcagtgttagcaaccctaaactgatctttactctacgtttcttcttccattaatttcttctcccaaaagcaacgtgaatacatacatcttaattaattaattaattacaattaacaacaagaggagcggaaaagcagcttactgacaactaatcacatcaaattaacaagatcatcgcttaattacttttgccaattggtttgtattgaacgttgttttgatcatgagaaaattcattggcagggaaagcaagcggccattaattagggttctaagtttggggggtgacgtatactaattccattaattacccacccccaccacaagcactttaaatatgttatcttgctgccataaaataatcgccttccaaagtagggattatacgccagtcatgtgtagtaatttaatttacaccaaaccaaaaacacatcacatcaggacaaaacagaagaggagaatacttaatcgattttgctatatctcactcgaaagatttttttcttatctctcactcgattttctcactcaaatttacagtgcattttcttgtaagttacagtgtaatttataaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcgaattttaatacaaagattaaaaatctgtgtgatacgattataaaaatctttcgaaagatgtataggtactcccatacttaatttaaccgagagatatgcatgccatgcatgcatgggtgtaacactaccagccagaagctgctgttaaaaaaaaggttgaaataataaaaacagtaaaaagataaacattgaactagtagtactgtttaataatcacatttagatccaggaattttctcacaaacccctttgatttccagaagaacacatgagcccaaacaaaatttagtattatttcggcgtggaatttttcaccccaccccctctagatttctgaaatggcggagataacccagcttatgtacatggaaggcatggagctaagccatggtagagaggataggacggaggaagacgacgatgggacacgtggcggccccgcgggctaggtgcagagggcgccgacctctctgaggcgcgggacgaggcggccgctgaggtggaggcccatgaggccctcgaggccgccgacggggtcgccgccgacgaagagcgcggggagcgcggcgccgccgcccagcgccgcctcctcctcctccgccgcgccgccctccagctcgatgacggtggcgtgcgcgccgacggcggcgaggaggcgcctcatgacgtgcgccatgtagcacccccgccgcgcgaacaccaccacggggctctcccgcaccagccgccccaccctctcggccggcgcctcctcctcccccgccgggtctatcgtcaggctcccccgccgcatcatccccgccgccgccgccaccgcctgcatctccggccggccaccgcgcgcaccgtgaaatcaaaaaacacgaaaatagcggcggcggcggcggtggcgcgcgctgtctctcacctcgccgtcgatccggagaagggggtgtatatataagctggagaggggggagacgacgagagcacatgggggagggtgacgtcacgggaggaggaggaggtggggccctgggtggcgtctcgtggccggactatggaagcggccattaataacttgtcgaggtgacgacgacgacgcattgagctaatcgtggaggagaaattaaaatagtttaaatttgatttagagattgacctgacccggcctgattaaaattttcttatctctgtcctgtttgtttcgttagtgacagaaattttatcgtttttattattgggatccacagtttcgtctgtttatttttaatttagcgaggaagagagatggaacaaatctggtggctgatgtgtatgctgggcgccatcggaattcgacgacggcaggtagagtagattgttcctcagcacatggcatgcaactgggggtcatcatctcgtcaaacaaagaactgtactgtgccacgtaacgtccgtgtcactgcatgctcagtagtacatgctagcagagctggagctgaggtgaggttagcaattactctctccgttcaaaaaaaaacatgattaatattttatgtgtccgtcttatataaattttttttataattagtattttcattgttgttagatgataaaacatgattaataatttatgtgtgaattatctttttaatttttttcatattttttttaaataagacggacggtcaaatgttagacacggaaagcagagtttgtcttttttttttttgatggatagagtaattaatggtcggctggctcagtggcagctagctagctgacgacgtcacacaactggagctgggctagctagcttagctgccgttgacgtcgctgtttccgccgctccggcgagggatcgagatcgatcgccgacgtcagggcatatatgcatactgcatacatggaggtaggtcggcagtggcgacgacgacagtggatggatggtccacgcgctcacggcaacaatggatggaacagaagctaatggaagtagttttcttgtgatcttatcccggccggccgcgccactgcagtgatcaatcgacgatcatatcatatcatatcgatttggaggcaagaataatgcgagtgcgcgcgagatccacgtttcgttaattggagggcttaattaattgcattactgggatggagcttaatttgcaagcatttcactgatagatcgatcggtactagcttaattagtttgccgtcaactttactctttcgttggtctagcagcgaccggtcacgcttagtggcggtcggttcggtgctagccttcttctgggtctatgtattagtgttgtcggtacgtgggtcattttttttcttttttcttggttatgatcttccatggttataattttgtaattttttttctgttctatcaatataaatttcacactgtctaatacaagtcattagaaaaagagatagatagatagatagatattgtgcaatttgattggttgttttcaggaaatgaagtggttatgtctcagggtctcattaattgttcactatatgggttataaaccactatactaaaattcaaattttcaattttaaaattgattttgatgtttcttacatattttcagtacttatttttaagtcgctaagattatatatataaaagttttatctataaaatacttttcaatcactaattggttatggtttatactaaatcataggcaatcaatagactaggtcctcagccatcaatagtgctacggccaagctacacaacccaacgaatcacagagagatataattcttcttcttcctcctgtcctgcgagaatctccttaattgcccacaaataaatatgactagtacgttagtggagcagtaacaaagatttattcagtgaggttctagcttgtgattcgtagattaatttgttctgaacatgttttggaggtcaacgccaactttatgtgtgtgaggtcgtcgtacgttttaatttcgagattctctgcttcctttttatgctaccagtacaagatcaatgcgtctcatcgatatatcaatgtatctcgactagaaattaatcgcaccaatcatggactttcgtcatgcacggtccatcgtcgaattattgcgtttctagaggtcgatcggctttcgtcaccatgcacgtactagcaggccaccaccacgtacaccaccatcttcttattgtgtggggctactgactactcactccgtattttaattaatgtacgacgtcgttgtctttttaagtaatgtttgactattcgttttattcaattttttaaaaaaaatatgaaaatgtttatgttatgcttaaagaacatttgatgatgaatcaaatcacaataaaataaatgataattacataaattttttgaataagacgaacggtcaaacgttgaacaaaaagtcaactgtgtcagacattaaaatatagaggtagtaattattaagtgcatctatatattttctcctgcatgtatactataattgtaatagaaaacggcggatcagcaagcttttttggaacacaaattaatgactagtattttcaaatttcaatgtgtgttacagtttccatggtcttcttcagcgctgagcgagcttccagataggtcggcagccactcaaactcatcatcgttgatgtatccattagatagacatcaattaacattcagaaaacttatcgatcaccgaataaaactattagttgttcaggtttgatggcactgctgtggcttcgccattggatgaagacatgcctgtgaacgacaaaagaacttaattagacgtggaaaatattgtaagtaaaggatatataaagtactgcagttaatttcaacaattttcagtcggccatacagacaaattaagttaatgtgatggcattttctattacgaaaacaaattagcatcaaaattcagttaggaatttcggccactgtttttcatcccctcatccatacatagaaaaatcgtcggttaagaaaacttatcaaatgttatcaatttcttgtcatagtcttctagtacatgcccttgtgatcagcgattatattacttagaagttggttcttttttccttttttacggagaggggacaaagagaatagtttcattttgaagataacactagtaactacaactaatcttcccaaaccaagtatgcgcattgacattatcaaatatttgggaaatttaaaagtaaataacattgaaaaacatcattggtgtggtggtggtggagtgattggttcgatcgggttcaaatctcagtgtttataaatatgtcagtgtgcatccttaataccacctccattccaaattaaacataacaacctactagtactactacgaatctggatatgcttcatatatatagatagtactacaacgtgttttatccaatattagattaatatatagatagtactacaacgtgttttatccaatattagattaataggttgctatattttaggacggtgatagtattgatgcagaggctagaggccagaagttatatttccattaaaaaataactcaaggatcatgatcttaattaggaatacgagtcgatgggaattttatatgtggtgggttgtactctcactattccataatataaggcacgatcaaacttggtatggtttacaaaattaatccttagcttataatttttcatatattataagatttgtaataaccaaattataaccatatagaagtacattcaaataccaatccaacgataattttcagcaaataaaattcagttcatataatactaaccgttgatcaattcttataaaagttaaattttaaaatatgtacgcatcttatgttatgagatggagtagcacacaactgtaacatgtacaaagctggcaaatgcacggcagtcaatctgcatcgacacaaatgttggagagacttaattagctggatccctatcagcaggacctcctttggggggggggttatgaaaatctaaatcagaaaaataatatgttcaatcttgatcttgaaaaaaagaggaaaaaaaatcactcagttcacaaatcgtcccaagtggaactctggaagtaggccttataagctgttggctatcaaatgagttggaccgtatgttgatccagcagatatatatgggctgaaaaatactggtattgggctagagaccatacaactgttaaccaggctccaagcgaccaagctgccagcttttgggtttaaggactggtattgggccgaaaattatctccactactaaagtttggtaattcgatctagaatatttcactcacaaaatcttggcaaaagttgttagaggtataatatgttagttagagataagagtcaaaaataaattatagagataagatatatcctagagaagtagagatagaatcctatagataaggtacagttctagagatagaatcctagagataaatctactcttacttgtattgtactataagtctctatcacatatgtactcctatatatatcccatgagataatagatgtaatagacgagaaaacatcagaatacaacatatttgaaaaaaattcctagattaagtaatgattagcattagattagatcttcattagctccatgatcctcatgagcagaagcagcaagccaacaaccacaaccattgtcatgcgcatgcatgcatggatcgtgtggcacatcctcgggaaggcacgagaaggtcaaacttcggtgcacaggcgcacggacctccccgcgcacgacttcatctacaccgacagtactgatcatcatcagccgtacgactgcgcaattgtcttcgccgatgcaacatcgccgatggtcttcatcaacaagggaaacacgccgccgccacttgtccacaaggatggacatcccgcgtcctctaacagattaatctgcaagacgcttcatcaataacatcgaccgcgttctttacgatggcaacgaccgcgtcaccgacgacggcatcgatcacgtcatctacgactacaacgactgcatcaacccggcatcactattgtgatgaccgctacacggcgcaggagaaccaaccaaagtggtggcctcatcgccaacgatgtcctctgacatatgcaagacgtttccaatggcatcctctgacatctacaaggtgcaagatgctaacaattacagtttcgtcttcacaccatggcgtaaatatttttttcgccttcggctatatgcggctacaacaactaccacgactacggctactacatgatcggctacattgacgaacgtctacaccaaaaatcattgacggaaactccagtcaaagtgtctgtgtcatcgctatcgtccatgacactcctgctatgactgcgggagggaatagaggagagtcaagcgacgacacagatggggacgcaggaatcaggtggaggaccgtccatcagagatgcaatcgatgatggtgagtcgatggagatgaagaaatagaagatttcaaatacagtcgcaatcgttcgcttcgctcccgttacgactgagggagaatgttagaagtataatatactagttagagataagagtcaaaaacaaattatagagataagatatatcctagagaagtagagatagaatcctatagataagatacagtcctagagatagaatcctagagataaatctactcttacttgtattgtactctaagtctctatcccatatgtactcctatatatatcccatgagaggatcgatgtaatagacgagaaaacatcagaatacaatatattagatttttccacaaaattaacaaactaaacataatttacacatctcaaccttatcaatattggtgatgccaaaatttaacagtactaaattttggtaagttgatttaagtatcaaagtgaatagccccttaatttgcactcatttgcgtggatttcaccaaacggagagcgagagggattgagatagcatttcgtcttcatttttcagtacagtgataacttccatccaacacgtgcaaaaatgccaatctgagagaacacgtacatataaaaacgatttttttttgaaaattttaattttgttgataggaaactaggagctctctagactataatcgctaaacctatcctcacagctgtcattaactcattattacagtactagtactagcttttaggccgcaaaagctacagaagaaagaattagaaaaagttcagcattttaaacatggataaaacataatatactacgtattttttttcgttcatctcactgttacatgttgggaactttttgtttggttcgtttgtttgtttatttttgtttacagagcagctaaaaacgttccatcttgtttggtgatgcctttgacaattgttactagaccacgtgccattaatcgtgctagcttctagtacaaaaatatctctctagcaagcgagtatctcgccctgctgtgttaaccaataatttatgcaaatctcaacttagaataattatataattaagattctaaagacttctaaatttttggaaatttgttagggggattgctggagcataattttctgataaaatatcataattttataattggggatctatttaatagatatgttggtgatgctcctaagtattaaaacacgtgctgctcctttcgatttggaaaggctaataaaccgggcattgactagagccaaattagagtctgggattaggagagaaaagtatgacccatcgcatacgcatgggcccatcaattgggccatggctcgagtcatcatccagtgatcgagacaataaacactactttgacctagtagctttgtgttgactttgactttgaccttgccgaccatttatgtttctttttaactttgtcactcctctttaatactaactagatgacaccccgcgttttgctgtaggatatatgttagataatagagaaatgatgaatgatttggattgaaatattatgaaaatgatttgagaacgatgatttaacatgtgtatgtttatttttagaataaaataaattgtagatataattactatgtgtttgcatgttgagtttcgtgagcttaattggttgatgtgatatgcttgcatataggtcttagtagtgctaataaatgctatgcttgcatgttgagctttaggtgtgtagtgggcattagttttatagaaagaagagatatgattatccttttatccacgaactgaaggaacctgatcctatttgagttgtgcctcagggtttcagccacaaatcaaaccagtgttacaaaatgaattagcattatatttttatcattaattaatcatctcgtcgcgtaagggcatgggtcaacacataccctagttatattctctatagagttttggataccacacgaggacatcctcagtcctcgttcgactcaaacaagtcacgaaagacgaacaaatctttgattcggtagaagcagcgttaatgccaaattgtgggacctacataaataaatctttctccaatcacttgcgtagttgcctccgtttgtctctccgctgcaactaatattttttttatttttcttaaaggcaccttatgaactatcacgatagtacaaattatactctcggaccataaacgggatattttacaccctgaactgtctataccaggtgaataaccccttgactcaatccgaaactgtctgtcctacatgacgtatacgtgacaattcaatcatcatttttttttaaatggtgggccagcctgccagacactctcacctctctctttccctcttaccgaccatcagcggcattgacgatggcgaggcaggcctcaattgctatcgccaccccctcttcctttcttccttgttctcgacctcagcaggcgacgataccaacagaggcgaggtcctcgcctgttttcgccgcccgccacctgtttcaccactacgccttgtctccgttggatagagagggaaggaaggaggtagggaggagcccaacaaccttcgtaggaggtgcgaacgaccagcggcagcgcgacgcagcgtgatggtgtagacggtaggggcgaggctactgttgcagctctgatgtactcctcttcagcttgccagacctggaggagaatcccaccggcgacgggttgtgggattttttttctgacacttaacaatcggcgtcacattgtgctctattcgttcatctttgcccattatttgatttatgctcaattggagttgtcctaaaagcaagttagtatcttgtggagtgtcagtgtttcatacagagaagatggttacttcaaatgagatctgagtgggccaagtttgaggaaatgatgagtttttttttttaaaaaaaagaaaacttacatatttcttcaatatatggagttcacatacagattgcataattgattttaacatatctcaaacaaagagagattaggttgctcgcaatggaacaagctgatagacgtacaacagaacttgcaaaaggcctccaagaaatacaagttacagaagacccctgaaatatgcaaaggactccaaaagaaatagaaaaagcaactcagtccttgatttgcttcttctcccgattgacccaaatgttgaagctgacggagaaatgacgttgaccataaaagatggcatccaaccacaaactcaacagggacctcgcgaaagtgaaggttgaagcagactcaatgaacttagtaagtttcagtttaatcttgaagatgcctcgtcgaagacaaggaagggcaccaaatcggcagcagcaacctcgccaaagaggatttgaacggccaacgccaccttgtcattgtggaggaagaagacttcccaccacatggaaaatctgttgtgcttgacccaaacacaggtgaataactccatagcaaccttgcagacaacatgaggtgcaacaagctctagttgagctcaagccatccatggaaggaagcatcctagacgaagaagacgagcatcgacatctccttcgagctatgtacaaaaggggaataggaaaacctacaatgagataaacccgacatctccttggaccctcccccttcgtcagtgacaagcagccgtcagaggcgaaggggagagggccttcgacaaaggggaaggaagttgccctttcacttttcaccggccatcgatagggagagaaaggataatggttcccgaggaaaataacagttaagaatattttgatgaatataggaagaggaagttgacgaaatgatatctacatttcttaaattattatatttacctataaattttaattaaaaatatcacaggcatacgagtgcacataaataagtttatgtttagattcaattatagaatttgactttttattggatgagtcacggatgatgtactccctccgtcccaaaaaaaaaaaccaatcctaggtttgaacctgaacccatgtgtggttcaaacctaggattaggttttttttgggatggagggagtatattgtaaggggaaaagggtaaatgtgagaagtacaatacagtgaacactatccacaattgcatagcaaccgatactatcaatgttctcaaaaagaaaaaattgatactatcaagggggggccaccggacactgacagaagtagggagtaaccatcgg

SEQ ID NO: 60775 - DNA, 869 bp, Oryza sativa
ctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgcgcaatattaaccagggctgacgtcagcacgggggagtgcggcgccgacaagcggggcccaccggtcagcggcacggggaggagagagggcgccgacacgcgggacccacaggtcagcgacccggggaaaaggatggggcggcggcgccacgtggcggccggaccgacggccccgatctacccaagggtaaattggacggcggcgggagctcgcggccgggatgcgcgggcacggcgcaagccgaaccggcgaccatggcaccggcggcgcggcgctcacgcggcggcggcgcgcaggcggtagcggcgcaaggcgacggccgacggcgaccgaccggcggcggagagc

SEQ ID NO: 60776 - DNA, 822 bp, Oryza sativa
  unsure (1)..(822): unsure at all n locations
catcagcttcgtacatgatgaatgcgggcagcttcaccatcctcttcttacacaaggcgaccagcccagcggtaatcacttccagtagaagcgctagggaggatagtggtaggtcgttgcgccgcagccccaaggtcaatctgttctccgagctgagctcgtcgccgtgtacctcatggcaatatctggcgctccagacaagggttgactctatcggttgacgcttttgtatagggggtcaccgaaatcccgaaattttcggaaatttcgatatgatatttccgaaattttaagcaaaatttagttgaatttgaacaaatattacccaaattcatgaaaaaatgaaaaatttcggtcgaaataatatcgtatcgggggtgaccgaaatgaccaaaattttcgaaatttcaaaaatttcagtccgaaatttccaaccctgctccggtccttggccggatctggacgacgggatggttaaggcgctaggggcaggggatgaggaagggagacccagatgggaaaggtggagtaggctccaaaaggtggtggaggagcgactttggtccgccacctttgcatatgagaggtttctcgcggcctatgtgcaactccaatggccgccgcctctattgtacgaaaggaaagaggaggtaggatagttcgtcgggggcaccacccccctgcatcggcccacctctcgggaggtagccgccgctcgggaggtagcagcataagccagacgctcgtggccactctagggttgccagttttgattcaataggtcnnncngtggtttccaccagagcatcttacgttccacat

SEQ ID NO: 60777 - DNA, 731 bp, Oryza sativa
aatgcaagtatatacagagacgatctacctaggactttactgtaaagaatttaattgtattacaaagaatatttacaaaaatcaaatgtttgtcgcatatgcattgcaaatgttctgccatttcgagacgagctaactaggacttcactctaaacatccctttcggtgacaagatatcatctagtatgaattgtgctatctcctctctaatgatttcgaagttgatttccggaatacttgaaataaattcctgcatgttcggtgccaagttagtctacatacttgtaaatttgttgtcctatgtgtgtataaacaattgaaatacacacctcagggtcgagcaatgtcaccttttctgcgaagctcctcatgttatggcagacatggaacccgcactggtcgccaacttgttgatgtattgggaagtctttcttgtgaccaagtttcggatgcccatccttatgcctcccgcctcttgccacgtattggtcccatgcctcgttcaaggcagattcgatggccgaccaatcgtatatttctggcttgatattggagttaaggtagtgtacccggctccacttcggcgttattaccagaagaatccaatgtcgcttgcgaaattattaaattgccagttacatactacagttgtacgcgtctagtatttgagtataagtacggtacacggggactgttgattgtaggcacacataatgaagtccttgtcttga

SEQ ID NO: 60778 - DNA, 17602 bp, Oryza sativa
  unsure (1)..(17602): unsure at all n locations
tgttctcgtcgcacacggtggtatactggccaatgtatatgctagggcgcttgtggcctgtgttggtatttcttagcgatattactaggaataaaatttcaagcaatgacgtagaaatactcctgatatattatagttacagagttcatccgcaagcacactaatatacctttgtaacattttacccgagagtattccagcggtattgtatttatttaatcccgtcggaagatcatagtagagagaaccagactaataatttatatgttacttataataattatagtctaagtaggggttacgataaattaaatgatagagtgatatacaagtagagaaatactcattctcatactaaaatatctaagctaagtggaaagaaaatagaaggagaatcttttcctatacttctagtatacatagtatacgtacattctagttatctgattaactagtttaataccctctatccgatgccctcctggtacatcgagaagccatccctgactgtcgagttccttacgacagcctatcattaccatacaaccggggctaaatacggaggactaccatcctcagtaaattaacttaggactatatacacgcgcggaggaatatccgtactgaggtgtcactatcagtggcccacctctcatccgcagcatataaccccaaataatgatatcccgtaatctagacaccatgcctaaactaccagatactactctaatatcatcgtcatatcatagagtaattgcataagcaaacattgcccgtaccgatgcatctcccagataagctagcagtataatcagtataacatgaacataatgtaaagctggcattcatatactcggaaagtattcaataccataaatgtataaagaagagtattctaataaatgtacaaagcttacaaaagaggaaaatagagctactagagccatacctgaactcttccgaaggctaccggacttcgatttctactctatttctactccactagcttaagaacactaaactaaacttgacagaatatgagagagctttgcttgaggtgtgtgagtgaagtgagaagaggacctccttaaataggctgccaatgacggttgtggcatttggaatggtcggaattgccctccaaccgtcattggggagtgatccacaccgtccagaagaaatcctgcatccaacggtgctaggggggttcggccgaactaggggccggcccaaccagcccaggttttggctggtggcatcctctgttgcttctcttcgcagacttgttaattttggctcaattcatcttgtcaattatgagttttttgcctattcgtgcataagtctgattctcgacatcatccgattgatttatcgtctgatttgatgtcgattctactccactttatggttattccctgcaaaaggttagtgaaccaactactagtggaatattattattctaacgtgaatatgcattgcaagcataactagttctcctctattttggtaatattgatggtcgaaactgatcgctaatgaccgtcaacaaaaccccctaagcttgaacctttggttgtcccgtgtaaaggacgaaaggaaacaaagacttagttgttgatcaagagttgctactatgctgtatatctcaaaggtacaggtgcaagatatatgtactctatctcaaattaaataatctttggcacggtggcttacccttatccctgattcccacgagatattgcttctccttgccttgaacaattgaaaaacagaacaacaattagagcatgaatcacccaatctttattcaacttttattccagaagttttcaaatgattttgtaaaagaaaagccaagttcctcaaatgattcactcattctctctaagtgtatcaatatgaattcctcaccatttttgcctttttgattcctactctaaggtttgatatgtggagctcggtagggattaaacatacttgcattcatatttattactaagtaaaaaactcagactaaaatagataactaaacatactcaagataaagatcgtgcaaagtgtgtgatatatggtggaaatgtaatatgaagaaaaataaagaaaatgcttctcttttgtgcttacttccttctcccaaaaatccttcttttattaataaggagagggcacagctatattctctctttttttttctttctttcaatatcatgctcatgcttgagagagcataactttatttttctttcataaccatgcctttccctcccttcttctttctttttttttcagaaaggattttctttttaaggagaagaaagcacataaaagcatggagaatttattttggtggtagtatacaaatggaatggaatggataattgctaactctcagtgtaggagtttagcatttgcatatatgtgggtgtatgatcttgatcatagagcatgagaagtatctacacaagtcacaagaatttgataaagttcgatggaatagcaagtaaccaaaatttatatggtttaatcaatgaagcatatttttggctctagtaggaatttatatcaaatgaggaactttcaaatttatcatttcgaaaaacaaagcatccggaattcaagtcaaactaggactaggatcatagcaactcttatttactatcacatatctcacaacaacttagactcagattagcaagtgcagctcatttacctcaggttcctagataattgttggctacttatatttaatttttgagagagcacttacctatgaacccatatatgagagatataaaacaaagcaactattcatcatttcaacaaagagaactagtttgtcttacctagcatgacaaaaccttacctatctttttggtattttctattttgcaagtttttatgttgttttcaggtttataggatgcaattagaaagcaaacatgcaattggaaagggaaatattcaatatgatacaagttacctcagtggggggagagatgtttccccacaagcttggctttcgctcagggtccttggtaaggattgaacccctgaaagcggaagtatgtttgaaggtcatcgggcttttgctgcatcaggttgttgatgttggtgaactgagcatcagtagtttgttgccattcttgcgcttgtgctatgtgttcctcgaggttgtattggacctctcccatatgcatatcaagggtattcattctccgggtgatttcacccaagtcccaacgagaggaacttgagcgccattcacctggagatagaggcataccacttgatctgggggttgattgctcatgtccccccactgtatgtcatgaggcacatgccgtaggtcctcattggcacttgcccattttgagactccgatgctgtggcgtggagcttggctccatccggttacatccccagtcagctcccaacctgcctcatacgtttgcacgggtgttgaggatgatgaaccttctcgttcattccttgccatgttgcatatctccctgtatgttcgacctacacaagattcttctatggtctgcaagggaatggttagttcatggcagttgtagaaatgataccccacattaggcaacgggaattcatttgtacaatcgggaaaaaagtaagtcaaagatccatctactccatgtttaagaatatgcctttgcactagataattctcatcaatacagggacgagcggctgagatataagcaatctggtcattgacgtcccctagtcccttggctatccgagtaatcaaagaactgcactcaacaggagcagaaaatcttatactttctaaccattgccttatcatacatttcacagtagcaactttgatcttcctaaccatggcaaacatgataattaattcatccccctaatgggtctaagatcacttctaggaaacaaagtcatagcaatccatttgtgcataagcctaagtgtaggattatgaatatcattcgtcctaggtttcttgcaaattggagaaccataaatatcttcccaaaacctatttttctcaaacgcagaaattcttttctgaagatcgattttacaggaatcgtgaaaatcaagaagtatacttaatccttccatgaaagtgtgtattccttatggaaaaagcgaaaggaaattctatcttctatttctttcaaagtgcacatgaatcgcaaagtaagcgaacaataaccaggctcatctaccacagcaaatctctgccaaccaacaactttccagatagcacgaaagttagtatccatacctatcttttccaatagctccagagagtattctcgcgtgtgagtatactcccggtctcttggcatgtagtaggcttgtctttcctgatcgtcgacaaggtcgaagtcggcatcgctcaagagacgttgcagaatgtcggcatcctccatcgagacatcggttgatgaacgagcactagactcatcatgatgacttgatgaagggctggatcccttgcacagacgaggcaatcgcttcattctgcataatgaagcaagaacagactaactcggcgggggttagtatagcaagaatttcacccgccggttagttttcaccaaagcaacttttatgtatgcgactaagtatttgaatttgagggaaactatcaaagcttgaatgaatttacgagcaaagtttgaagagggaatgaaaatgaattggaatggggtgcattcccctctcacagctggccggcttatatagggcagccacaacggtcaaaaatgacatgtgggccccttagccgttaccctgtcaaaattggtaggtagccgttgcctggctggttcggccgaacctctggtgggcccaaccggccccacttttggccattggaatccaacggttagtggggtcgtggcatagtgaatttttgttgaaaattttattttggtttgctctgaaaaattcatttgaaagaatttcttcaaaattcaaaatcctaaatgcaagttttgaaattcaaacatgtgttgatgcaaaaattcaaattgttgaaaataaatatgcgaattcataccaatttacctgttggcgaaggtcgcgtcattttgggtccgacgtgcaagaccgtacctcctttcagtttagttcacggattttccacccgtctccggaggggatggagcgggtgtctttggcttttccttccacaccttctttggttttggtgcagaagacggcttcttttgagctggctgctcttgctttttggccggtgtactgggttttaccggcgtcttctaataacggttcctgggaaacgctgtttcattttccagcaaattctgcatgaacttcaccaggctgtccgtctcgggtggctccacttcgacctcttggatgttttgcaggtttggcccatacttgattctgacactcaaacttttcttccttcccgttaatatggaaacggatactccccgttcccacgtcaatgttggctcctacggtgctaaggaacggatgccccaagatgtcgcgtccaggtagtcacgggacatgggagtgagtccattatagatgttttacaagataagccagtcgtccatcccatgatgaggacaggcggccacatacttctgaagtcgttcccacgcctcaggaatggactcatcccccgtctgctggaaacacgatattctcccacgaagggcgctggttttgcccatcgggaataacttcgataggaatgccgtagaacatttatcccaggtgtagatcattgcacggttggcatagaaccacagcttcgctttcccaagaagggaaaacggaaacagccacagcctgacggcgtttggactgacacccttcatggtgtatgtgctgcaaatctccaggaactgttgtaagtgagcattggcatcctcattaggtttgtcgcagaacaggctagcctgcgccatcgtgatgaggctggacttcagatcgaaatccacttctcccaggttgatctgcggcccaatggccacgttgtcagctgagggagcaacaaattcatggagggtcttgtgactcttgtcagccatattctggaaggtcggtggcgctggtatggctggtttctttgtcgggagagttttctgcggagcgacgactcgcggcttgacgctccggaaaaaaagcttctggattttctttaaagttttccggcaagttgaaaccagtcatgcaataccgtgtttccacaacaatagtgaaaacaaccaaggttagcctgcaaaggatagtgattatgtagaggtaaatataaagtattagttctggtaatctctattataaatcttccccagcaacggcgccagaaatgattgttggtatttcttagcgacattactaggaatataattcccagcaatggcgcagaaatactcctggtatattatggttacagagttcatccgcaagcacacggatataccattgtagcatttcaccagatagtattgcaagggtatcgtatttatttaatcccgtgggaagatcatagtgagagaaccggactaataatttagatgttacttgtaataataatagtctaagcaggagttaagataaatcaaagggtagagtgacacacaagcggggaactactcattctcatactaaaatatctaagctaagtggaaagaaaatagaaagagaatcgattcttatacttctagtatgcatagtgtacacacattctagttatataattaagtaactaataccctctatccgatgccctcttgttacttcgagaagccacccctgactgccgagttccttacgacagcccgtcgtgaccatacaaccggggctaaatacggaggagtatcgtccccaagaatttaacttaggactatatacatgcgcggaggaatacccgtactgagctttcaccatcagtggcccacctctcatccgcagcatataaccccaaataatgatatcccgtaatctagacaccacgcctaagctaccagatactactctaatatcatcgtcatgacatagagtaattgcataagcaaactttatacccgtaccaatgcatctcccagataagctagcagtataatcagtataacatgaacaaatgtaaagttggcattcatatactcagaaagtatttcaataccataaatgtataaggacgagtatattctaataaaagtacaaagtttacaaaagaggaaaggagtgttactagagccatacccgaactcttccgaaggcatccggactccgatttctactctattcctactccactagcttaagaacactaagctaaacttgagagaatatgagagagctttgcttgaggtgtgtgaatgaattaagaagaggaggtccttaaataggctgccaatgacggttgtggcagttggaatggtcgatattgccctccaaccatcattggggagtgatccacgccgtctagaagaaaccctgcatccaacgttgccaagggggttcggccgaaccaggggccggcccaaccagcccggtttttggctagcagcctcctctgttgcttctcttcgcagacttgtgaattttgacccaattcatcatgtcaattttgagttcttggcccattcatgcataagtctgattctcgacatcgtccgattgatttatcgactgattggatgttgattctcctccactttatggttattctctgcaaaaggttagtgaaccaaatactagtggaatattattattctaacgtgaatatgcattgcaagcataactagttctcctctattttggtaatattgatggtcgaaactgatcgcaaacgaccgtcaacagcctgtttgcacgacggcagggcaggagcaaagccactgagagcaccaaccacctcacctgtcctcccaaagctgaacatatacatacacatgatttgatatttttttcttccccgttgcaatgcacgggccattttccagtcttttttagaaaataaattctgcttccacccaccgttttcattcgttcgtctccccaattaagtggatcactgtcgtccacgtatcactactaaaaaccgatttttgtggacacactccctattttatacaagcggaccaaaagagcgtccacatgcaaaaagatttgcatgctatttggttatgagttatgacccacatgaaaaaaaaatcaaatttcacatacagacctcttacgaaacccgcatggagaaagaactttctgggcctcctcgttttcccttttctttttaaccgtccccccgactcccttctcctctacttatatctcgctccctcacttagattttcttcccctctactcctcccccctatgcctcctctacttctccctccttcagatccacaaagggagccgatggcggggtagcgatggcggtccggtggatgtggcaacgacagtagtgggcgggagggcgaagctcgaggccagtggatctggcggcaccgccctcgagagggtcggatccgtagcactcggtcccgctatagctcgagggcggtagatctagtggctctgcccttgggaggggcggatctgctgccctacgcccgggggtttatggcgaggacaacagccttgagctcgagtggatgagagtgggagctagggttttgggatttcggtttcttttggaaatttttttgttattttttcttttcgcatgtgggaggtttaactgaccgcccgcgaaaatcatttttttgcatgagggagcgttgcccgcatgtaaaaactctgattttcacaaatagttatgtgcatgcggacgaagtgcctgtctgcgaaaatacattttggtagtatggaaaaagttttctgtagtagtgtatacagccatgtccgatacaattccatcctctttctcatcactcacgacctcattcgtacgtagactaagaacaaaccaaagtcacaatcgatctgcccagattgacacggctgcacatatgagtatgtcgagtaggaggagaagctgctcatggacgggttccctaaccaatctctgctctgcacgcatgtctcgcaagaagccaagcaatggccgcacatcgcggtatcacctcacaccgtcaagcattcaccccgacaaacatcgagaatctccctttgcttcacatcatgtaggtaagttctttttgcacatcgacgtggcacggccgtgagaattaacgcaaagcgtggatgaataagtgcttattttctctgtagagtatgatgggtttcggaagtttgtgtctaggttgaaccgactatttaagatgatttcccgacgaactttaaagtatgattgcctaaaatattttgaagagcagaagctagagctacaagatatgtccagaaactgtacttctaatgtttttgtgcagaaactgtacttctaatgtttctctaacaatggctatgtggacctcaaaccagactagaggatatatatgtataacgtggcactttattgatgctgattggaaggtaaaaaaaagatttttaaggttctcacacttaaaaacattgcacatggatgttgttatattcaatacaatcctagagaccatataagattgtattgtgaagataaattgttttcatcactttggataatgctaacaccaatagtgcaatgtcgaagttattgaaagctaacgttttgcaaaagggtctactgcatgggcaagggaagctattacattaacattgcatgtcacatgttttgaatttaatactctattgtaatcaacatccatgggagcattaagtatattaaaggataacaagcttggattggaaggtaaatttttaggaaattgtggcacaagttattgtaataataaaaaaaaacgttgttattctgatgtgcgtactaggtggaacaccacctgtttgatgattcaaactgcgccatttagacaagctttggagtcctcagacttgcaagataagaccacacatacaaatatactttagtttgctttgttaaaaaacagttgtagagtatggaacattgcaagtgttgtatgtgacaacaaatgttattttaggtcagctatatggtacctcaaatcttaattttcataagatttgggatgtgaagattctagaaaagtaagtttcagctttgttggtatatcttacgttcataaataaaatacgcaagcgcacggagatactgctgtagtacttcacgcaaaagtattccaaggtttcgaattttcacagggaacatgtgtgtttagctattctttaggtttatgtaaggacacaaatcaaatatagacaatagtgtagagatgattttctaatatggtacatagtcatttagaaatcttaactttaatcctatcgctatgcttcaggtactggcttctaccagaacgcgctctactccctacctagacagggaggactacgatgatctcgagggctgtcaacacctctacaccaaactgtaacatactacgagatacgcaacaagtacaggtaattaataacctagacaccacatctatgattgtaattactactttaatatttataactcactaaagtaatcactatctcttaatgagcaatgatcagccaagccaaataggaactaaataaaaagtatacacacaaaataaatctcaattacttaaataaaataaagtaattgcttggctacaaaaggaaagtgggagaagaacaccgacactccgggacttctcgtcttctcttattcctcactctctccttaatctaagtgtacataagaatacaaagagactcttataatttagctaagtcttggtgtgtgttggacgagaggaagaggggtatttataagggaggttgcttggaagggtagtgaagtgccatggaatccaaagggtatcttcattctcctcttgccaagtgtccttcttgatgatggttggagcgcaggaaacaaccacaaccttgtcattggaagttagtaattactgacctagagagtttctggaccagctgggctggtcctgggtcggccgacccctaaccggctcgcttggccctaggccttctcatggatcttgacctatgggtcccgacttgtattttcctgaatttattgttggatttgtaggctcaagactccatgggcttggatatggaattgataattccctccttagtgtatatttttttctcaactctgatagtttgccacctgtatacaaatatacatcagcactcgtggaatttgttagaaataaacccaaccactatattggatgttttatatttttagatttatgctggtattgacggcggcgtaaatttggtatatttaacaaccgttaacaagcttctcaagtgaacactgaaatatctaagatgatcaagtccaggaagaagaaatttgagaagtatttgaagatttcttggttggcactatctctacctgttatcgtggaccctatatttaagcttaagttctcgagttccgtttcaggcctgcatttggtaatgataccgagtctatgattgtcaatgtcaagaatgcttttcgagaggctttcagtgagtgctaatatcaacttcactacggatctaacaggcagtgctgatgttgatattggagtatctacaagtgaccggttggctgattgggatcaacatcttaaccatgacattcagatgacggctgaaatatgttctgagtatgatggatatatgtataagccctcgaagtgatgttttgacatcctaatttttttttttgaaacggacatcctaaattggtggcaagctaacgcttctgagtatctaacctttgctcgcatggcctgatctatcctagctatatatacccgcctccgccgttccgtctctgaatcaaccttcagagtataggaaagagagttatatcgaattatcaaagctggttaactcccaagacagctgaagcgatggtgtgcttgctatattggataagaggatctggcacgtattctttcagccattttttgttaaattggtcctaacaacaacatctatacatcattgttctgcttgtaggttcatcaaacttgagcacatcatcaatttatgattttcccgaggaagatgagttaatagatcaagtaacatgttgcttctcaattattatcattttggtatagttcaaagatagatccataaattaactacatcgagccaaaagccaaaagtgactggcagtaatgctccgtgcaactatgtgcctttgttgcctcttctgtgtgacttcggtagttgaatggaagatgtagctcattaagataaatagattcaagtttgtttttgctgttgtatccaaacaatctgattggtaattgagtttttagggatttgcattcatactcagttgcatggtggatttttctgctacaatcgagcagggagctgtaagtaatctcatacagatgtctcattgaataacaagtcttttgtaccagaaaaaaaaatgttttgtcatgtacattatactcaatctctgtgatatattattcaccatgttccagaaaaaaatgttgtgtatttatggattgaaacttgagatttctttgttgtccatggtctaaattgtaccatgttataattcttgtgcttctgagttattctggtatttttaagtggttggcatagtggaaagcgttgtagttgcacttgtattttcatccttttcaattactttttagcttgatatatataccactaatatgttctattgaattattttatacatgtgcagtgaaaaatcttgatggaagcagtggtgcatgtgtggtgtaatttttaaaagtctagttgatgacccaatgtttctgaaaatcagtgctattaaaaaagtctaatttttgacgctgttgctcttctccttggcactgtcaagactggtgtattttttgaagctatattgtaatttatcatgtgctagcacttatgtatcaggtggcaaagaaaaataattttagtgtgttgctgttaacaccagacaccagtagtaatatattattaatttttgtaaaagaaagatacaatattaaatgtttgtgtatgataaaatattaaatgtttagggtttaaaataatcctagcacttatgattctttcctattagcaacatactatcatataatctgaacaaccatatcgtgtcttaccatttttatacttcaaaacccactactacaaaaataattattatggatgagacattatttaggttgcaagcggatcataactggtcacgtctacaaaaatcgacctccatttttgcatacggctgcttaagaggactgcacgtaaaaatcaattttcgcacgtagacttcttaagagtacatatgcaaaagtaattaagtccgcagaactcttaagaggccatacgcgaaaatatattttcgcaggcgtgcctcttaaggatccgcctaagtctgacttacctcctcatttccctcccgacactttaaatttttttaatccttatccactcatctctctctcaccttttctcctcattatttcctctccacttcgtcacctcctttcctctcctctctcaccttctgtggacgagacaggcaatgagcggcagggctcaggccaccaccaccgggcccgtgacggcctgatccgccaacgttgggcctgtgatgactagatccgcaggcggcgggcggcgcaaccgatggcaggctcccccgcattgaaggaagcgacggcggttccattttctttagataatggaatataattccggcctttgctcaagagttacagccaattattacataaattcacatacaagctttcacacactaaaaggtccacaaaaagcttacataattgaaatgaacacaaactgagaagcaccaacacaagacaaaagatccacgattattaattgaatcatattagtgaacctccatccgaaattggcgaagatttgcatgaccgtcgactcaagtttacgacatacatcatttagtagtttgatgtcttcatcacacctttttagctgggcctaacattggagccaatatgctaccctgaaaattacctgcatataatattttgatggtgatttatcaagaactatatcattcctacaaagccatagagctcaacataatgcagatgcttctacaaggataagtttcttgttttttttttatcaaaacctacaatccaattcctaaagatataagatgtactgtgtggagggtataactcaaaagtaatttgtaatgctctccaaagaaatatggaataatggttatccaagaaaagatgatgaattgtctcatttttcatgcaaaaacaacacctcttgctatcatttcagttcctcctagtcaagttgtccttcgttaacactacatctttaagtaggtaccactcgaaaacttacaaagcacaattcacaggcccgatccacggctactaacttcaaccctatcgtttggaatcccatggacacaaagaaagtacaagctatagtatggacggcaaatcgactagcaataacagtacctattggcctaacggtcatgcaacttataaattgagagagccgattgcacgtgttaattcaggtaccagtcatgacttacaagaggcggacgacttttgagagaaggtggacggggcagacgagatggaaggacagcagggcattatattcggaaaataagtcaaaacacctacattatacttacctataacaaaagaaaaaactaacatatccatataaatttatcaaaccgtccgacttaattatgttacagtactaccgtactaacattagtagtgaaaatgtgccgttaaagcactcttcgatcacgaaagctagaggtgtcagaacgtccctgatacgtacaaacgcacggtcactttggttatttcagaagaaaaaagaaaattaagggaggaaaatttcgatcagtgacgttggggattagtgtgtgtacgctgctgctgcgcaaatacatatttacggcttaacgatgacactcgtacgcgcgtacgctacgtgcttaatttatactccttcattccctaaatatttgacgccgttgatttttttaaacatgtttgaccgttcgtcttattcaaaattttttgtgaaatatgtaaaactatatgtatatataaaagtatatttaacaataaatcaaatgataggaaaagaattaataattacttaaatatttttaataaaacgaacggtcaaacatatttaaaaaagtcaacggcgttaaatattttagggtcaaatattttaggatgaagggactagttcctcgcgtccggtccatcgggacgagtttgtctaggcacatatatattcacctgacaataatgacagtataataagtattttcaaaggctagccggcctacttcctagcctttgaaaacatgaaatgcaatgatactgcaactagcggaaagctgtttttatccgtagagatggtattcctctcgtttgtttaaaaaaatataattataaaaaattttaaaaaaccgacaacatgtatgcaacgtatatatatcacttcatcctatggcgaaactcaacataggaaataagataaaagaaagacaaattaacgtatgaatattgaaaagtacttgtactattcaaacctcaatgagtcattttcttttctctcggtgtcatttttttttgttaaaattctttctacagcgttttgcattgaattggaaagaatatgaggggatagcctatcgggcgattagaatccgtttctccgcaggtttggttcaattcgttgtctgaaatgcacttttcaaacatcgggcatagccattttgcccatttccatgctttagcatccagcttattctttactgctcacaccattgggcctaaaactgatccatcgttcagcaaataaaaataacacaggtggagaaactctctttactcccggtttgcaatggcctttaatcccggattgcaaactaggaagctcagtaaatctttagtcctggttgatataattggaacttaagattgatctttagaccggttgataatagcaaccgagacgaaagatggtaatgctatgtggatggcgctaccatctttagctctggttggtgttaacaagccggactaaagttttttttctttttctaattgtttgttgctgcttgtatgttgatttcaaaccaaactcaacaacaaaatcatttacattcaaaaaaacatcacaaaatcatccacaaattcaataacaaaatcatctacatccaaaatcactaaaaatactaaaaataatctttagtcctagttgataatactaaccgggactaaagatcaaaaagtttcattgggcttttgagccgaggctaaacatattctttagtcccgtttgtaacaggaaccgggactaatatgatttttggccgacacacgaaaagatcagttctccagtagtttaataatttgttgacaaaactttgtcctagagatttcaaagccaatgctaaaaataattattgtcattgtcatagtgtacccttctgcaagctcctcgtgtccatctgtcaataaacagtacaacatgttccatgataacagtataatacgttccatggcaacggtaaaagtaaacagcttgcttcaattcttggacttttgtttttgagagcattaaattcttggacttacgtgctctatttcaacatcacattgcacagtttgacatgcattcaggcatccagcatcgtctttacgtgttctcaactaagcttctttacgtgtttttttaagaagggtattttttacccgtcctctacatccaatcggatatatacggccattgaaatagggaacttagccccgcaaacaacccaatctgaaattcgctccataggagatttgaactcaggaccttggggtactactcaggtcactataaccactagtctacatgtcctttcataagctgcttacgtgttatttgcacagtttaaatttctccttgaaatttcaccttaatttgctcgacgtgctatatatataagtgcccatttctttcctcctccgatggctgtggctgcaatccgattcaggtagatcgacaacgtcggcgggatggacgatgccggtgagatctgctcgttctcgcggtcgtcgtcttcggcgagggaggacgacgaggaggaccagcggtgggcggcgctggagaagctgtcgacctacgaccgagcacggacggcgctgctggccatgccgccggacggcgagctgcgggaggtgaacgtccagcggctcgccgccgtggagcggcgcgcgctgctgcagcgcgtcgccggcgtcggcgacgaccatgcacgcttcctcgccaagttcaaagaacgcgtcgatcggtaaggcgatctcatattgacatggtgaattttggtggttttatacagtggaaaaggacgtcacaatattctgctcgagcactactacacgtaatatttttttactaaaagtcatctcaatgtanggcttttgaagntagattttat

SEQ ID NO: 60779 - DNA, 2655 bp, Oryza sativa
ttaccagaagaatccaatgtcgcttgcgaaattattaaattgccagttacatactacagttgtacgcgtctagtatttgagtataagtacggtacacgcttactgttgattgtaggcacacataatgaagtccttgtcttgacgggcaaataagcagtccttgatataacccatcatgtttgctcgatcgtttttcagcgttgtctcattgacgacagctggatcgagtaaggcaacatggggtgctttacgatggacatgcttccaggttaacctacaagcaagacaatagtcagggtaagcttaatttgtggacagtcactaccatatcgcgtaccaagaaatacttacaaggagtagcacttaaggaggttggtgtcgatcgctcgcaccctgtggaggtcccatagatctttgaagtctacggcgatgaaggcagtaggcctaaggaacggctgaccatcgtgctggcccaacatggaggtctctctattcttcctccttgcgttggacttctccatgtagtacacgtgcaactccttgcatgcagggcccatcttgaataaggcatcgtttccaaccaatggcattttagggtttagggtttagggtttagaggctttggaggagctactagcgccttaccaagatcaagcttctttggggctaatggcacatttatttttcctctccccgttccagcaggcttttctgcgtgtgtcaagcttgggtggagaagatttcgccctcttgctccttttggcaggaggggggaggtgcggcttgctgtcaacctccataccgtcgtccccaaaattagtatcatactgtaattggagatcttcatctctttgttcaacggcaggagggagagatacaacagtttgatggggatgcgtcggcggcggacgagaacttggcgctagccttggagttatattgatctcaatgctgtgcttgggccatcgaataaaggtcccacatgcagccccaagggtcaaaatctcatcattaggtgggtgtgggatagtgtagccaacccaatcgggcttcactaagtccacctgaactttggcattgccggcttgcagctgcgccccatgcactcgagtctccgaggtaggcttgaatacttgaccctctgcggcaggaattgcaaatcctggtgtcaccctaacgactagggtacacgatgtgggttccggcgatagattcattagtgtccttagtatatgttgcaatgtattgtggtgctaatacaatatatgcgttattaagttgtttttaccgttatgtggtccaccgcggcggggccttcaggctgttctgccggagcctcagttgatgcgcagctgctacgcctctacgtggggctcacttgtactatgggaccgggagtggcatcggtcgacctatccctgatgcgtgcctctatccaagcctccatacctaacagctcggcagtgagctcttctgtaagctcttctttaagctcctcccgaagttgggccttaatgcatgcagctttctacgccttggaaagcttgtgcttcttgtactgccatgcgtattggggaaacccaaacttccatggaacattggagccaatgccccttgtttgtccacggtgttcttcgtttcccaacgctttcgtgaggatgtcatcctcgcgtttttgtgagccgacctcttgggaggcctgtctctcagcattcagttcgacctggggtacagttaggacatgttagacgaagaatacaatacaacataatgaaacctattctatgtgttcaacttacaattttctggtacaccacttgatcttcgggatttaggaacgaaagaattccgtcactattcttcttcacccttgcccttgcccaattccttgcctgctggaccgggatatcagcaagcacttgcggggtgttagattccgctgcagcttcatcctccttgtcccattctgcctgtttccccgcgtagcctccggtgccaagccggtgcgggtgaaggttccttgcctgcagatcacggtaggcctggctttttgcccgagactctttcgttgatttggcggcatggaactcatcccacatgggttgggtgatgaatggatatttcccaaatggttctggctgggcggggttgagaacgtactccgtgaccagcattgtcttgaaattttttcaacaattccccatcttgcggatagcctgccgcttgagtcctgcctcggcctctgtagggtatcggaagctttccttgaactgcctccaagcctcttctttttcttcttgagggaccagatcgatgtggtcctatagaatagtgaagattcgcctccctagggctctgcatatcgtagggaactttttgacagctttcgtcggagccgtcggatatccaacatcgtccacctctgttatggtgtaaacttccttaggaaccttattctgggtcctaggagtccggctcgatgtagtctcagtagtggtcgtcgacatcggttcgcgttgctgcgacatgtcctatggcactgttgtatggggagaaagtactttttaaacacaaaattgcatctacacacattctctgattgtttgatatacctctatctcatacctgcgttcgcctcgtcgacggaaccatagc

SEQ ID NO: 60780 - DNA, 20041 bp, Oryza sativa
ctgaaaaatataaacggttagcatttattctaccaccaagtgtgatacctcccaagctcctcgaggcagcatgtacgtaagaaaagacaccacacctttttttactgtgtactaatcaagttgcagggacaatagtcaagagagcaatgtataaactaattaaactaccaaaacagtagtaatcaagccgctatatataaattgtagcacattttttttattattcaggctgttctcacatcacgtaccttattcatctacactgaacttattaatcattttggtcccattgtgaaagatctcaagaacaattaaattcgcgtcactgcgtacccactacacacagtcgatcgagcaaagattgtgtccttttctagtggggtttggtggccattttttaccggccacggattcttggatcaggttcagaaaccagtggcgtgcaaatctgaatctttttgacctgaagaacaaaggaattcagtcagagtagggttgctttgatatgacctaaatgaatggagacttctaccagctggcaagtatacattattagccggtgctgtgcctaatcaaatcgcacgtagaaattctacaagtcatcactactttcacctgcatgggataactgataagattactccaaatgtctcatgcttacctttatcagtctgtcaatggtgtttttacaggataatgtcatcagtgggattagcacttatcagcactgtcagagcaaacaatgaatccagatttgttcatgaatattttaattggttacctgttcatgaatggattccctcttgcaagctcatgctgataattaagttgattcatggattaataacctacagttcctttgacgttatgtttcatctctccaagcatgtacagatgtgctgacattatatttcttcagctaatccacgtatgaacaattagggactaggctggtgcaccaacccctatgatgtggggctattttagacacatggggccgtaccaacacagatagtcaatttttttgcatttaaattactccttttttgtggcgcaagtaagcatatatagtagcttcagagatacaaagcatctgaattattagtacaacatagcccaattaaataatcaacccatcgcgatgaccgatttattacgcgtgcacggcatcataatccatcgagctagaaaaaaaagattaccgatgggttgttttcatgtagttatcatctagctaaaaaagttgtatcgtctaactaacaaatccagggaatgattgattggccggtttggcagaaatgtgatgacaatttgacccttgggtccaacctgaccgaagtcatctgaattttaaatattatatggttgctatgatatggcgtcggcctcgcatcatcgcagacgcgatgagcaatgcaactcagtgtcttgcagttagcagccgtgttatctcaaagcttgcacgtaatatattttcatctcaccaaaaaggtgttcagtgaagttgctgaaaagagatggggttccctaatcaaggttcagagtttcagacgttgaagagtttgtgcagacagatcaaggttactatacctcgtcttcttgattatcccgtgttaaacttctactaaaataaaagtattttatagtatttaaattttgagggcagctacacaacgggatattttaagtgactctcccttttcctttcctctatccacgtgtgctccctggtacctgatacctggtatgtccacgcgtgctccctggtacctgatacatggtaccttaggtaccggttggtacctggtacctggtacctttggtactgactaggtatcgaccgatgcctgatacctggtaccttacctggtacctgatacctttggtaccgactaggtatcgactgatacctaatacccggtgccaaggtaccgggtggtatctcggtatcagcctaatacttgtggggcatcagagggtaccatcaaaaagaggaggagacgtgggggagggagggccgcaacggcggaggatggcgtcgaggacgcacggcgagttgagggtcgaggcccaagccagagagcgtgagaagtctcgaggagaagccgaagaggaggttgacggccatacctgttgcaagtcgacacaggctgccggcgtccatcccggaggcgcaaagcaataggctgcagcggggacgacggtgacgccgaggccgagggcgaggacaaggggagctcccgcttctgccctccccggggcgacgactccctggcgcacacccgactgacgagggcggcgagctagagcggcgcagcaaggggaggcgagctcgagggcgaccctgttgagggttggtcgacctcgccaacgcagtgccgtcgtcgtcctcctctgccgctgaagacgacgacgacgaccccttcctcccggccggcttcgtctccgctcggccttcttcacacagagagagagagagagagaggagtggagtgaggcgagagtgagatggggattgcgtcgggtggatgaggatgcgggtcggatggataaggttgaagagctatctcgacaccacgggataccggggagtagattttctcttaaattttatgccacaattttaatattcacgcattgattctcatgatttaaatgattccaaagctaatcacatgcttgaaaaggaatctaaaaaaatcaaaattcaaaaattaataactgaagtaacttaaaaaaaatattttaactagtatttgctaaacaatctaaaaacattatattttagaacgggtggagtaattttaagttaaaaatatgagatgctttgatcattttagctacaacttgaaacctaaatgaaataaaaaaatattacggttaaatatatgtgttattagctacataaaaaaataatgctagaaaatagcctaagacaaaaatcaacttcaagttttgaaatttaaatttaggctgtgatttagtataagctaacaagcacatgataatagacgaattttattttctgtttccttttctatcgaatgttgatgaaaatcatggtctagactctagactagaatgaacatggctcttagcttctctccggatcttagactctagacaggatgtcaggatctctccgggtttccgccttcagcacttctcgggggaccgctaacccgattagttagcggattacctgaaatacgtattctttaatggaacgcgtattttcttagttagttatcggttccactcttcttccccaactcgctcctgtctccgcgcgcgccgccatggatgcatactacctcgtccgcctccatctccctccaccactccagcttccacccaccctgcctctacctcgaggccgccatgaccgccgcgtcggtggcgccgtcgcgtgccgcgccaccgccggcccagtgggcagccaagagcggccgtgggagtcctacgaccgcggcattcagcaccacgcaggctccgacctcgcctcctccctccgcctgctcgccgacatgcaggccgccgggctgcgccccagcggcgcggcgtacgcgcgcctcatccgggcgctcgcccgcgccggccggacgctcgaggccgaggcgctcctcctcgagatgcgccgcctcgggctccgcccggacgccgcgcactacaacgccctcctcgaggggctcctctccacggcgcacctccgcctcgccgaccgcctcctcctccagatggccgacgacggcgtcgcgcggaaccggcgcacgtacatgctgctgctgaacgcgtacgcccgggccggccgcctcgaggactcgtggtgggttctcggcgagatgaagcgccggggtattcggcttgacaccgccgggtacagcacgctggtgcggctgtacagggacaatggcatgtggaagaaggccaccgacctcatcatggagatgcaggagctcggggtggagctcgatgtcaagatttacaacgggttgatcgatacattcggcaagtatgggcagttagcggatgcacgcaaggtgttcgacaaaatgtgcgcagaaggggtcaagcctgatattactacatggaattctttgattcggtggcattgtcgtgtggggaatacgaaacgtgctctgcgattcttcgctgcaatgcaggaggaaggaatgtatccggatcctaaaatctttgttacaatcatcagcaggttgggggaacaggggaagtgggacgaaattaagaagctgtttcatggcatgaggaatcgagggctcaaggagagtggtgcagtgtatgcagttttggttgacatttatggacaatacggccattttcgtgatgcccatgactgtgtagctgctctcaaagctgagaatctgcagctttcacctagcatcttttgtgtcttggccaatgcatatgctcaacaggttagtctagttactggatatagatggaatcaacttcgtctaatggcatgatagttgttattaacatctgatgcagactaacatagagtgtcaaagtgataatataactttggaaaacaacaatttgcagtcattttagtattaaatcacagttctatctctggattaaaatatccatgaataattcagtgaatcctgaccattttgtttatctgttcaatgccgtgctcattgttcatttgccacccattctgtttagttctagttaaagggggtggcaatgattatatcccacccatgtgtcacacatgggccctaaggcacatgtgttcttgcacactctagcaaggcatggcaagggtatcaagagagtcaaaaatgtggtggcattactcggtagtctctactgtagtttcaaaacgctctggaatcttcaattatcattctgccttcacagttttgttttcttttggacgaaggcttaattggtctaaaaacatcaatatctacatgtcactgtgcatacctttcagtttgtgtggcttgtgcaccatttcaactctctcttttcagggtttgtgtgaacaaactgtaaatgttcttcaattgatggaggcagaaggaattgagccaaatcttgttatgctgaatttgctaataaatgcttttggtactgctggaaggcatttggaggcacttgctgtactccagcatatcaaggatagcgtacgttctttctccagaaatgagagaagaaaagtgttttttttaatgtttcttttttgggttccatgatttaacttagtttgagcaatttctacctattgttgatttcattttttcagggtatgagcccagatgttgtgacttacacaacacttatgaaggctttcatgagagcaaagaaatttgaaaaggcatgtccactatttttctactccttagcatttagtaacttaaatatcatggattgtagcaaatcctcatcctaaatttctgttgaaattctgaatacttatttgttttgctcttcaccataactgttaaaataagtttttcctcatgtatgcaactatctcacattatattatgctattagatcatcttgatgatacaaaatattgtaacaaagctttatgaaacatggcttattaatctaaggttttaggagattgaagtaattctgattattttcctgcataggtgtcagaagtatataaggagatggagggtgctggttgtactcctgatagaaaagctagagaaatgctgaatgacgcctctattgtactggaacaaaggggaatgttacatttgtagccacccttttgaattccagggatggatgctttggcgggttatcgaaattggaatacctacaattctgaagtggctcaagcttcaatttctataacttgaagaataccatatcccttttttgcttgccatgctgaatgtctgaaacagatacgatatatagtaaacacaggtgagttttggcttgctcaggaatatatagacacttctgcagttctttttctccctcagtattgtaagatgtcactcaataaaatttctccaagcctccaattatctttttaatttgtttactgcagagtgtgccaaaaaagacagaaagcaacattatttagaaagagaaggttaggctcctttcaagaaaaagagagagagaaagttaggtcacaactttatggaacatatcaacgtttgaaatcttgtatagtttatcctacaactgtaagatgacctcttgctttaaacattgcaatagctcggctcctctattcgcttcagatttacctattactaaatttcatgggagaaaacaatgaggcatcaagccctcaatttatcttaagcatagaaataaggttctcatatttccatgtctatctctatttctagttagaaatccatcttacttggttcctcctcaacatatgattgttgatactcttgcactctttcacagaggaagaatatcgaactacattcagggttcacaaaggaatccacagggtgcaatttgtgggatattcaacgaatcaagactccagagaggccctctgtgttattctaccattggatcacctgctgttgacaaatgctgtgtctgcaattgaagcttgttggactgacacaatggcagcaattctcttgaattgctgaactttggaattttgaggttggacagaacattggaaatggtcatccgttgatgctttcataagcctggttccacaatgctggtacgcactaaaacagtcaggccctactacattcatttcagtatgtaggatcagtcaaacacaaatgaatgaattaggacttcattcattttacatcataggatcaattggtacacttgtgtgtttgtacttgagcatgcaatttttgtagttaaggcaacaagtaggtaacacttacaggcatcatgataaggaggaatcagaaatgttcactttctgtttatgatacataattttctaccccacatatttccgtatgtttcagatgaaaaagattatatttggagatagtgatatacacgaaacatttagaatttcctcatgttgctttcttgctgaatcatacatgagtagctttgcacgataaagtcataaggagatgttgatagtatcagatggtctgatattgacttgtgtgttacaagattcagtgaagtataaaatgacatgtaaatatgtaatcaatcatcttgtgatatactgtatgacagggcaattcttttgtgataaagtgttcgttttttctttgcgttgatcctttttattttgtaccaatagaccataactcaaaataaaatagaatgaaccaattaaatcaaataagtgtgtccgtttctgtatacgttcatgtactgcaaatgctctctgagaaaattgcccaagtatgaactcgtaatggcgtgagcagtggcttgtgaatttagatactagaaaaaattgccctagtgttgttactgaaatcatgattttcacatactggaccttaacgctgttcttgagttcttctatttagaaaattgtcaggatactattactgaattcataatggcatcaggaaaggctgtgtaaatcagtaaatggtttaggagacatatgggaggggcaaaagacgaaattttggcaagaagtctgtacttcatttctacatctcctgaccacattacatatcccattcatatatctttcttcgtctatctcatgcaaaatactagaaaacagcaggatttatatccttttccctgaagtttgattcatatgactcttctatgttgtaacctaaaacattttggaacatagataaagcagaagcagcagtgatgaaatcttttgttcacttgagctcgtcttcatcgtcgcagtcgctgagcaagtcgtcaatggcagcggtgtgcgtcatccgcgcggacgcctgcttcacccactgcgccatcttggccgtctccctgctgaccttgacctgctcctcgagcgccttcttgagcttgcgctgctgctgcttgagctcggtgacgatcctcctgttctcgtcgccccactcgccggcgtcgccgatgccaaggacgtcgtcgtcggcggcggcggcgacgccggcgcggcggctcttcctgccgctcccggtcggagtcctctgcagcgtcttcttgggggagaagccgaagcagcacgcctggcgcggcggcgacggtgagccgtcgtccctccccctgttcctctccctcagcgtcggccggccgcgccctggcctgaacagcttctccaggtcctcctcgttgtcgtccgccgccgccgccgtcggaacggtcacggccggtggaggatgagcctgcgacggcggcggcgaggagttctccttctcctgggcttccttggcggcgtcttctggtcggcgttcttgtgccgccggtgcagggggcgcaggcggagcagggtccggcgtctccgatggcggcgggtcggtgtggtggggcggcgcggtggcgctgcggcccagggacttggcgggcggcggcggaggcaacggcgcggcggggagggacttgagcttgcggaagcgggactcgaggctggaagggagcgcggagtcgccgtcggcggcgaggtgggctgtgttgagcttggcgatctgctccagcgcgacgaggtcggccgcctcggcgaggatcgcatcgacggcggacagcttcccgccaccgccggagtacgccatgaccggtcgccggagcccgcggccgcacgacggcgagatcagccacgggaaggggggacgcaagtgagggagtgagctagcgcggtgcagtgtggacgggatggtcagtggttcgagccggatttgtcgttgcgtgggaggggaaagagagagagagagatggggggcagtttcgtcacgtcgggcgcgtggtggtgggccagcctcggatgctctgcgcttttgaccgttgtggccgcatgaaaaggctgccgctgttaacaccggcggtggccggccgctgctccggcggccgcgaaagggggtcgactggtcggggcttttatggtcaccgccagcggcaggctgatggagatttgggaagatcagaggatgattaatggttataaatgctgtcaatatgacaaaatatggcagtataaatgctagtattccctccgtccctaagaactgaatggacattctactgcaacgaatatgtatgaattcgttcaaattcgtttatccaatcctagattacatattttgggacagagagtagtggtagtatggtaaatgatcctgtaggcgatccaccatccatggaattagatcgttggaaggagtttttagtacgtgacgggtcggttttatggcaagatggggtgtgttgtactgattccatggggttcgaattcgcatgatcgatgattctgcctgcggaataacttcacccctaccgtcccttcaactttacaccgagtttgattgacatttcttatctttaataccaggaattttcacccaaccatacaatttaagtcacatagcagtacaaatgcttggtttcactgatgtggcaaataaaactaaaaacaatgtgggtcccacatgtaagtgaagtgagaagaaagatatggggcccacatctctttcttttttcttattttctcctcttcaaggaggttgtcagtggcaaattggggcgaggcagccggtcgagctctgtcgccgcaccaacgcgcacatgccactgcggccatctctctgccccctttcccactgcccgctaccacgctcgcccgccgccgccccgcgcggacatccaccatggttttgtactcctgggttgtggtagcggcggcgtgcggagtagctagcgaggggagaggcggccgaccgcgccgacgggagaggagaaagaggagggctgaggggcggagcagccatcggtggagagccaaggccggcgcatcgggaggagtccaagacggaagcgacggaggaagtggtgaaggtccttgggcggaccgggcgaggcagatccagggtggcgcgtgggggcggcatcgacgatgaagacggagcagatcggaggatggttgtgggtaaccgtcggcctcgacagggtgcttgcggcggcggagctccgccgctgtcgcctgcagatgaagatccctccgcacccgctgccttgccccctccagccaccgccgctgttgccacctccttatggctcattccctgcgctttctcaccgccaacgatgtcacgccggtcgcctctctccccctctcccaccgacgcggccggcatcctctccccactatcctgctggcaccccccctccccttgtcggcatcctctcccccctctccggctggcctccccctctatataagatgatggggctgataagtgggtctcacattttttctcctcatttcacttacatgtaggactcattttttttaattttattttgctgactatgatgccacgtcaacgaaaccagatatctatggaacctaaattgcacggttttatatattttaggggtgaagatttttaatactgaggataagtgatgtcaaacaaattcggtgtaaagttgagggacggcaggtgaacttaatccttctgcctacacatgctataaaaactccgtcacttcgtcaaaagaatagtccaatatggcctgttcagcttctggcccgattatttgttcgggtccagatggaaatgcaactatggccttctgggccggaacttcctatacgggcttacgatcagttgggaaggcaataatgatgagacaaacactagccaagtatacacaaccccactactcaataatgatgagttgtgaaagaatcactcaatttttgtactagtaccaacttttgatcatctggtcctgcataaacaaccacatactccagtatgctataaattctgagccgtgcaactgtgagtacagtagagtaggagttttatgcatgcaaagtggctcctctgtactgtctgggtcttttattactcggaactttagtggttgaactcttatcagcacacggtacactgccggccttgcacgagagaagagaagagacaacaattaaaacaaaagcacaccaaagcaccactctatccgtagccatccatccgtttcgtcacgctggaaacacaagagatcgccgtcggctgtgctggctgcaaagtgcaaacggaaaacgtgacagttgtgttgcttcattcacattttttttacaggtaccatatagtactatagtacaacaacaacgcgttaggtagagaaaaaaaaagttcctgtcattgataatacttattgtttgtactatcatttttattataatacatatagaaatatcatcaaatatattattttattaaagtacttttttaatactaaaatatgtatggttaatattttagaatttaattatagttaaaaaaataaaatttgatgttagcttttgttcaaaacgtgagcttttgttcaatacggcttgttagggaataaaaacaatttatagacaattttttttatacatttgttcgtagtgatttaaagccaatgttgaaaataaattatgttgaagtatcttaaaatcaactttaaaatcaagtttaaaaatttaaattttagggctacgaattattaacctgagggactacttttctgtatctcgatggtttttggaggagaaaacgatcagttgacactggggagagcttggaaattcagtggaaacgaagcagccacggatggatcgagtagaagagcggtccaaaacagtggtgctcctccgctatttggttccttcctcaactcctccttccttttctcctggaagcttccagtcttgcagacattgaaagtagaaaaaaacaaaagttccttactagccgcacgcacgcgcacacgtactcgttgctctagtcgtctttaaacaaaaaaacagttgttccgggtttcgtagagtacatggctgtactttgttggtttagatcagtgattgaccaaaatactgttcacatatcagaccaataactttattttggccttcacgtgtgcaaatataaaacaacattaaatttttttaaaaaattagtaattcacttttcattaactattaaactagaatatatactccctccgttccataatataagggattttgagtttttgcttgtaaagtttgatcactcgtcttatttaaatttttttgaaattattatttattttatttgtgacttactttattattcatagtactttaagcacaacttttcgttttttatatttacaaaaaaaatttgaataaaacgagtgatcaaactttacaaataaaaactcaaaatcccttatattgtgggacgggggagtattatgtttgtttgatgttgtgtatgttgtatcgttaaattcgcatttaaaaaatatcatcatactacgtttcttgtataatttgctgataaaatcaaggaaaatcaatggtattacgagttacgactgcacagccgcaacactgctaaatcgttggtaagtagtactggtacgtaatatagccgcaaccagctctactgcgcagagctgtcatgctgttaatgatcctcataaatatacaattaagaacaggtggaaggtgtgcgtctttacggttctcttaaacctgatttcgtattgatacgtcttgacgagtataaacatgaatgcaccaaatctcttcccctgcaattataaaaattaaatatgtttttactaatattttagtaatttcagtcggtttataatttcattcgcttttaaaaatataaggcatagtataaaaaatcatttaaaaaaactcatgctcatttcagatgagagtcggacttctaattgcttcaaagtttctgccgagccataagaaaactatatatatggctcggcagaaactttgaagtccatcatcccaactgaaatctgaattaggtaccaataatatttttcctatatacttttaggaaaaaaaaatgattacgcatgaaatttatatagtaaaaaaaaaacagaatgaagacgactacacgaggcgagcagattggaccggcctgaccgtttggcgccgcggctgtaccagtaccaccatccacagcagttgttgcgacttgacctcttcccttcctcctccatttccaacgccctcctccctcccttgttaattcctcctcctcgtcgtcgtcaacctcccgatcgagttcccaccccagccaacgacccaaccccagcttctcctcctcctcctttcaaatcacacccttcgtcctcggaattctctgcgctgcagcaccagcatctcgcaagtcaaaccatccttatttattctggttttcttgccttgctgctgctgctgctgcggttgattttgatcttggaagaggaggaggaggaggggttgggttggtgggggtagcagcagcagcagagccgccggtgatggaggaacggcaggcggtcaacccggcctgccccaacgccgccaaccccttccaccgctgcgccgactactgccccgtccctgctcccgccgccgccaccgccaagccgcccccaccgccgccgtcttcccgaccggcgcagaacgggaccgcggcgccgcagaacgggacggccgcggcgcagaacggaatcgcggagcagaacgggagcacgcacagcgacggcgagctgcaggcgaagccgcgccgccgcgacagggccggcggatccgggggcctccccttctacgtcttccgtgagcacctcccttcctttgccccccatctcttcgcagcaactttcagaagaaagtatgagaattcgattcgatttgggttttggtgctgtagtgcgcgagggagccgacggcgacggcaagaaggtggacccgcgatgccccaacgcgcccaacccgttccacgtctgcaccgagcactgcgccgccaagatggccgaggtcagccgctcgtcggagggcgggaagtcccccatgtccctcttctcccgccactcgcgccgctcctcctcctctgaaggtttctgtctttctttgctcgattcgttacttgctactgattggtaacatcatatttgggatttgttgttctttgtattatctgtcataacaattgttggatggttgcgcagatggcagcgtgagatcggggagcagcaagaaggtggatcctaagtgcccaaatgctggcaatccattccatgaatgcactgagcattgtgctgccaagatgaaggaggtgggtcagcagaataagactgttaagaagtcgtcctcacgcaagaaaggtagcatatactagtggccttccactgctgattgtttatggtttcttagcttccccaattttgatgttagtgtagattaggggataaatggttagttgttttaaccctaaacctaactaaacatatcccttaaatgcctctaatggtacaaacaaattgatatgcactgtaaatgtagtgattggtatcatggaagcaaattggaaaaaagaaatgtgactgagttttgctggtttacgggaaaggaaaattgaagggaccaaccatgatcatgggaagatctgttcaccataatgtttcgcagttcatgtagtgcttgttggtgggaaagaagcagcaacacccttttgctttattacattattgtaataattattatgttcctccctatattaaatgcaaaattataagaaaatcttaaatgatttgttccactactttgaaagaattggatcacctacaaacaattgttggtaccataaaagggcccatgtcttaatcttgtgaatttcgaatggaatggtggcattatgataatgatgctaccaacttgcttatcctgaatatgctcaattcagattatattttgtaccttcaactgccattcttaattggttttgtttacgcctacagggggaaaggagatctctgttgtgcagaactggaaggtggatccgaggtgcccaaatgcgtccaacccattccatatatgcgcccaatactgctttgatcatttgaatgaaacgggtcagaaagatacaagcaaaccaggtacatctagttaacccaatgagttatcatggcatgtgtatatatacgagagctttggcagacattttaatgcctactatctctctgtttacagactcaaggaagggcaaagctgttgtgaaagcagagcaaacaggagaaatcaatcctgattgtgtgaatgcgtccaatccctaccacaagtgtggggaacattgtaagagaaagggtgacaggtagataaggtaatgaaaattctcttttatgttcggttatccttgcgcattgaagttatctgtacttcattggtttgatgtgtatattaactgaacatatttcacttaacatgggtggcatgttatcaagccatgatttggtacttgtaaagttcatctagctaaactttttggaccaagtaacccttcatgaaagatactagttcaataacattgtcatttagtagttatatattgtcaactagtcagattcgtttttcttgagtcacatgcatcatctagtaaaaatctgtcatctttcaacaagtttctagatttcattgtgcacaactagtaactcagctgtcatgacctagctatgggcacatcaacttacatgatcccaagaaaaccattgaagctctgtaactacttatatgtattttttaggtgctgattacaaacatgtaaggcaagacatatgacggaaaaaaagtttttcgtattagttttctttggtcaagctttgaaaaatcttatgagctgtaagcatctggtcaacatatgtttttctttcccctagccagctaatccagtgtgttgtagatctgcaatgattttgaggggaaaaaaagatattagttggatacaaaaaaattaacttgatgaacataagcagcagattttctttaatcatacaagtgatttctttttttattattttagttgacagtatctccttttgtggtcctaggctggcgatacaaggtttcctctccagatgatgatggtgaaaaaaaaagtatatcccgacaatagtcctgtaggtttcaatagaagctgtgtttccatcggctccgctttttattgtggctgcagcatcacaatctttgctgtattatcatgtactttctacacactttcttaccgccattcactcctataaaagagtcccatattctagatctagtagtataatttattccgtgaagattgtaaaaatagaagcgtgttgtttctttttttcccccttctttttgtaagataattgcctgcttatataagttataattttgtcaccaaccaagtggtccacaaaccagttttttcattcattttctttccatcactgtccatatttgttatataaaaagatataggcggatcgatgtttgttatagcagggaggttcttctgaaccaagatatgtggccattaatttcccttttgttttatcatcaatgaacaagggaaacccatcattgatatcaactctttgacaagtatggctgctctttctggttggcagggtctggttgtgaatcttctagaatggagatggagccatttggtcagaataatacagcatcatcagtattcagtactactgtacacgtcatgttacttatagatgaggaatgcctggggggcttggaattttcagactcgtcagttgtttggtttgagacgtccaattcgtgcctgaaaatgtcttttgacctgaaaaaaaaggagaattttccagtgtttgcagcatagctgatgtgcgtgatgatgtgatcgacattcaacaaaacgggtggttgcacgttctgattatatttatggttcacacgtaggcgacaaaaggacgaaaatgaggtcgctactcaaaaccttcgtgaagaaagtaggcgtcagaagtgaaaaactgcaccgaaccatacgaccaatcaaagaacctgggaaacaaaaacagaacaattgcaagttcatgtgtctgttccaagagaattgggatccgggagacaggtgatgaaattctactcatacagaatttgacgtaaatatgcaagattgtggagcggaacttgccaacttggtagaattcttcaggaggttggttgatgagttgtcttgtttgaaactttttgagttgaattgttgaacgctttaaaatagaagtaagccgtcctccttttttcatgagtttaagcatcttgagttcaaatcctgactaacacgcaattatcaaataaaagtttgcagcctaatcctattccacgcttaagatttagagcgtttcgcgtgagagaatgagtgttgcaacattagtgaattacccgtctctactcatcaacttaagctttcgggttaatttggttattacataggagtatatttcaatagaccaattgaagcacaagcatctccgaactgctgagtgctgagtgctgactggaagcagacaagaacttctctagaaccaccatttccattttccaatcagataggtgaccgtcgatgtcgtcgacgaccgcgcgtcgtcgacgcagaaaggacccgtaatcccgtattgtgcagggcgcacttcagaatcgcacctccggccaatcaccgccgctgtcgttgcgttcgccggcggcggcgaagggagaatctcttgtgcttgtcgatctcatcggcggtggagaactggagatcaatccgggccacgctgacgagacgaggaggagctcttcgactctccgtcgaggagcattgtacgactacctgtggctccgcatctcgccgtcttcaactccggcatcgtacgtacgccgccgccgccgccgtctcctcctcgcgcagtctcgccggccgcgaagacgacgcacatatcgcggtcgcggcgatgagtgggccttggcccaacggctcgagaaaaataaatgggcctcgcccgcaagcccatcacctgctcggcccagttagaatcttactcgcaaacgaggaggagaataatactaataatgaagtcaaatagagaaacccaccacctcgctcaatccaaaccccaattcacacgcgttgcggtctccgacgagggcgaggcggagctaatcgtcatctagggcaaggcggagctaatcgtgggtccgatggagaagccgtcgccgccgccgccggggaagtcgcggccggattgcgtcaactcgtcgaacccgtaccacgagtgctccgactactgcctccggcagatcgtgaagtccagggaagataatcatcggtggtcgcgcgtccatccccactgcatcaacgcctccaacccctaccacgcctgctccaacttctgcttcaggaggatcatccacgccaaaccctcaccttcaggtagtaatcctgaccctgtatcgatctatcatctatcgtctgcttctgatcaattacttctgcttctgatcctgtttctgatctgagcaattttgcgccacggatcgtcgtcctgagctagcctgtatcgatcgatccatcgtgtgcttgtgtagtttctcactgggtgttattcgttttagggttggagcgtccggtgcaagagccgcctgcgtccgaagctgttcctgcccaagctgacgacgatgatgatgcccaaactgacgacgacgacgaggaggacgctgccgcagacgacgacgatggttacctgaagatgacagtgacagagaatcagaagctagtatttgagcttcgggtgcggccatcgacgattctgcggtttgtggtagctgctgtgtgtgcactcctggttattcatctcctcggcgtatctctagttgtcgttgctcacgccctcatttgattagacaaagagaagcatatataattgagggaaaataggaatcaaggtctattgtacaattttgatactataatttgatacgtatggtataggatgaaatttacttttcttatcagcatttcttaaagatatgtttgttgtagcagggggtgaccaccgtccctccatattcggcccaaaacactgtagagagagattgggtgagattgagtcattattgtaagtatccgagtggaaatgaccattcgaacaaggaaacgataaaacactattcgagtcggaaaataccgttcgagtaaattcttgtcactaagtcttattatccgttttgaatgtttcctaagtcagtaacaggtcagctaccggataagtcgaaaagggtagtcgaactggaaaagactatttgccatggaaaagacccatggtggtggaaaagaccatcggtcgaggagaagacccatggtggtggaaaagactcttgatcatgaagaaggcgacttagacaacaaagatgccaagagaatattcccgaggaccactcaaccacttcatctagctggcaccaaaagactataatgacctccataatataccaaaatgcccttagggttagctgatatagcaagggcataattgtaatttcatgtgggcccaacaaagggtgcaagtgtaatctcacatgtaaagctgtgaactatataaagcagacaaaaagcctgtagcaggcaggatatcttggaatactaaaagtcttgtcacttagtatgtgtttatttggtatttgggctcatttcttaggataggcgggaaaagggggttttcccgtctatccctaatcttgtccgtgaccttgggtcaaggtcacgacagtggcgccgtccgtggggacgtgtagtatccttggagtgggcttgaatagtaaatgaaacgttcccaaaggcaaaagtcagtgccaatccgctacaccgacacttttgcaagcgcagcagcagcacttgaaagagagtgggaagagatgactggacaatcagcacaaaccggagtggagaaagcaatgccaggcagaaagactgccggtccaacaagagaagaaacaagagaaaacccgcctagtgaagtagagctcgccgagatggtgcaagcacaaggggctattatggtgaacaaagaacaatat

SEQ ID NO: 60781 - DNA, 17414 bp, Oryza sativa
tatgaacttattccgaatggcagtgtagaatcccatttgcatgtaagtacttgaagaattaaggccaccagcctgtaaagtttaagcaattgactgaaagatctgcctttgacttttgtaggagtggatcttgagacagcaccactcgattggaatgcccgcatgaagatagccttgggggctgcacgagctcttgcatatttacacgaagattcaagcccttgtgtgattcatcgtgattttaagtcaagcaacatcctattggagcatgatttcacaccgaaagtgtctgatttcggactggccaggactgcaaggggggaggggaaccagcacatctccactcgtgtcatgggaacatttgggtatgaatcatatccctcatccctctgtgttctgatggaatcacaatttctaatgcataatatgactatgtctttcttctcagatatgttgcaccggagtatgccatgacaggacatctccttgtcaagagcgatgtgtacagctatggagtagtgttgcttgagctcctcaccggtagaaagccagtggacatgtctaggcccggggggcaagaaaacctagtttcatgggctcgcccgcttctgaccaatgtggtaagcctacgtcaagctgttgatccacttcttggccctaacgtacccctggacaatgtcgcaaaagcagctgccatcgcatcaatgtgtgtacaacctgaggttgcgcatcgcccgagcatgggtgaagtagtgcaggccttaaaacttgtttgcagtgacggtgatgagggcctcggatcaggaagtttcagccaggaattggcggcacaagctgcagcaatctatgatgtaactggcatggaagctgagagggtgctgttatctgagatgtttggctcaacccctgtcttcactcccgctgcggattcaggttctttccgaaagcagtccagctcaggtccactgatgacaggcaagaacagaaagttctggcagagattgcgaagcctatcaagagggagtatgagtgagcatggtgcctcaccagattttgagacgcgctcgcagtgtagtaataggtgaggtttttttctgttcccttttcaatcttgcgaagataaatattcagttgaatggaaatagagagttttcaggcctagtttctgtacattactcatgtggagataaaaggctgtatagttcagaaatcaggatagtagcagggcagagcttgagctgtggagtattcaaggatttaatgagatgagctcagatttggttccatactaggtttgtctgcatttggatttgtgatgtcgtctctttttcagcttgtcagtttgagttcatttgtgattttctttgttttctttttggtttgagttatgattagttgtttggtaggaactgttgatgtatagattcagactacatttagaaatgcatttgttgcaatgaagatgataagcttctttttttctggctagttgcagcttctggctgattccacttgtttcagaagaaactgccatgtaaatctgacagaattgcttctgttcttccatacctctaacccagtggatgatgctgctgcatcagcaacttgcgagagttgatatgctttcttgagaatatggcataagtgctctgtttactacaaagtattttttttcagagaaaaagccgctttagggcctgtttagatccatttggaatagcaaatggcaaatggcaaaagttttggcattgcaaaagtactagttggtgtttagatgcatgttaaagttttaccattctagcaataaagtgagaaagagaaagagagatggagtggtcccaaagcactttttggcacaatttgctactatggactagcaaatgccaaataccaaattgccaacttttactactagtgtttagatccaaaatggcaaaaagtacaacaaaatagcaaaacttttgtcattttggaagatctaaacagggccttagtttatcatgccctttttcttcagtttggggatgaaaagtttcggcattgatggtgcaatcttcctacccttttgttatcctttaccagttacacatcttccattgaaaggtgccaaattgctatcatgtagtgctaattaagaaagctaaatcatgtatatcctttattccatagtcctcacacggattggaagaacgggaaaatcctaagcttttttgaggatcaaaacctgaaaaattcccttatgaagatcaaacaaacacaagggctcaatgaaaaatacagttcagagaaaagagtaaccttcgtgtaggtgctaccggggtagccactgaatccggcggcggtaaggtcaccacggtggcgcggttgtcggcggtgccatcgccggcggctcgccggaggtcggcggcgccaccgggttgatccgctcccgtacgtggatgagcaggcaaaggcatcttcggccttccaactaggctgttatattgggcctaaatgggcctattgggctgttagataattcagcccggtctagtgagaggtgttttgggccggccctattacggtgtctcctaagtactttttttttttttttgcccttcgtttacctctagggctcctgtcctctcaccgctcggccgccgccggcgacggcgaagacaacatttccatcgccatctcgccataataatccatggcttttcctctggcccgttagccctagccacattacgttgtttggggattgggaattgggaatcgggagagattcagagatgggagatcacctggggcatgccagatcgatgtgacgccgccgagcgccggcggcgagcggagcggcagggggcgaggattggcgctgcgttctcccctccctgaattcttccgccccgtttctggatttctcggtcgcaatccaggtaaattttacttgatcaacagcatgctgcatttcgcttctgttcatcgtgcatcgagctaggtggtagagaaggggaagagacggggatcgccgggaacgcgaaacggccggaggtcgctggccggaccgagctcctccggccgccggcggcggcttgagccgttacgcagagaaatgttgggccgccgtgagctccctggtacctcgtcacaggagtcaaattcaggcccatcgatttttgagagggattcggcccaatcaagtagtggatgattgagccgtatttctggattacttaggtgatggtgatgaactgatgatcaggtaatttttgcattttgctcgctgatttcgatctttaccactaggaattttacattttgtcctctacatgcaccggaattttcatctctctcttgtttccggccacctatcggccgtcgctgcaagaacataagcattggcagacgaagaaagaaatcagagatgtgcctcatgaaaagtgagactagatgggaaaaatatgtactacaaacctttatatgtagtagtacaaacatgtaaactaccgtaaaaatcaagaaataggatttatccatatcacgatgagtaaaacttttacttatgattaaaaaaatattagaagtaaaatatttactcatggttacatggataaattttgagtaaattccctatatacccatgaaaactcacataatctctttcatatccctgaaatttatttgatcccttctatacccttaaaattttgatcctttccatgccctgccgttacatttttcttcttttcactgttacgtttggttgcaaatgtctgttatgcccttgatgattaatttaggattgaatataagcatgaaaaagattgaaatttttgtttgagtgcaaagtgtgtgcattttatgaaactaatgagactataaataattatatatcagaaaatattgacataaattttgaaaataaaaaaatgtaataaacaaaaaaatttatttgcaattttaataggataatggatttttttttatcgggagcattcataaaaatagtatcgtgagcattggtagtcatatctttgtatgaatgctcctcattattttatgattttttttaaaaaaataaaataaatacatattttttatttcattatctaaaaataaattttatcataaataatgtatcgtacagcaaactcataactataatagtttcatgcgacaaacttttacattttcaataatgtaattcataatttttttatgttcatccaaagggtaaaatggatatttttatagaaatcagacggtcaactgacgggattggcatggaagggatcaaaatcaaattttgggtatataaggaagtaagcaaaattcaagagtatagaaggaattagctaaaatttcaggagtatacaaaggattttgtcattgttaaacgtctgtttttcgatcctaccgtcagtgttcgcctagaccatagtctagatgctagacgatcggttatcatcgagtttagagcctaaaccgagaattagaccgtttgaccatctagttagtcaaagacggttctagttctagactgtctcgaccacacaattagacagcatcgagatgagtgtagaacgtaaaactgtcgcttagactatagcctaggcaatggaccaatgcattttttttgtgtggcaggacatgaaactttgtgccctccccaaaaccaatatgttttagggttttcatcctattccatactcttcttctctgctctaagccactcgcagccacgaaatcgcaatgcttctcctttgctagttgctaccgtggaccttactcccacctccctccgacccacgactctacgagaggggctacatcttgggacatgtgtaagtgtgtttagtgtattcatttgtgtgcaaaaataatatgtcgatagtagatgtattgtctagaccatgtagacttgcatttagactagctagagtctacaggtggcggcgttgggaaggtggtgctcgaagaggaaaaattggggcgcgctaggaactttgtgctaggtaagatgactgaaagggtatttcggtcattaaaaaaaataacagtaaaaatggcgtgtagctgatagactgtggacggcgatagtaaatcgttgaggtcaaggaaaaagcgatgacatattatagatgtcgataaagtcagtagcatattgttgaactgtgacgaactcagtggtactgagcagagaatctcttaaaaaaataaaaagaaagaaaggaaagtgcattgcctagatctcctaaagtacctatatgtaatttatcttttatgggtgtgtctattttttttggcaaattatctatatatctattgtctacaaattagctatcttttgtcgaatctttattttgtcgaggtattttgctatatccttccttactttattttccgtatgtcgttaattgatcttagctattgtcatattagatgttgacttgctgggtcagtgctccaaaactcatatcattaaaataacattttgttatgcacttgcttcgtcctaaaataagcgcagcatgagtttccgtgtcgaactttaattgttcgtcttatttatttttttttaaaaaaaataaaagacataagtcacgtataaagtattgttcacgttttataatctagtaacaataaaaataataatcataaaaaaaattaaataaaatggacaattaaagttgaatacagaaactcatagcagcgtttattttagtacatttccatttttccttcctccgccgttggtgcggagggaagcgacaagatgatcaaccatagtacatcctatcctaggcctccatcggttggctttttttctaataagccaaaacggcttattatggaataaaaataaatttgtaggtaaaacttttatatatgtgttctttgtaacttaaaagccaatgctgaaaaaaaactacattgaaaatatttcaaaatcaatctcaaaattaagtttgaaaattcaaaatttggcttattctttagctttagcttattgtaccatccgatgggagccctactccagtgcagtgttaaaacacagatcctgtaggaaccaagcatcattggaggggtttaattagagatagtaaacgcatgcacatcttttcattagcagagaaaaagcgaggctagtacgtacgttgagctaagggcctcgggcttggggtgctatttcatgtcaacgggccgggcaacaaaagtttcggctttctccctccttcacctgtctcccccatcatcaccatgcatccatccatccatccatccaaatttctctctctctctagacatggagatgcagaggcatgcacggccatctaggctaggaggaacgagctgggtgtagtagtgatggcctacacaaagtttagattggtccaaagtttaaaatttggttaagattaaagacgatgtgactgagttgtgtgtataaaaggtttaatgtgatggaaagttaaaagtttaaaaaaaaaaactttagaactaaacacacccactacaacctcgatcgcgatggccgccaacatttaccgcaactttctcttctctcttcttcttcacacaggatcaatcgacgcgacccccgggagaaagttactactcgtactccgtcatctcatctctctctctacctcgtcgtctccatctgctattctgcatgcatgagccaatcgatatactcctacgccatgaccatgatcaagcaaagcaatgtacacctgctgctgtgagagttgcaattctccacggtgcatcatcgatcatcaattactgctgctgctgctgccaggtaacccagcagaacactactactacgagctggtacaatagcagactattagccagctataaacatattttaatgagataaacgataagagagaagaacagcgggctacagatctgtagcaagctgcagcatgaactccaagacattgtgtatagatgaattgaagctaatagtgggctatgctattaaacttgctctactccagcagagtagactagtgtatggtgtttctctctcatctgtgatggatggaagcatgcgcacacagaagaagaggagagaggggtactcactcctactgagaaagggacacgtgacgagggggggattgtccggtagcgcttggcggcgagccctgactttgatgcgtgggaatatttggtggcaaagtaggctgcacttgtctaccaaatgtccatgctcaattccaaacttgcagcccctctactaccaagctcactatgcacacacagcacagcttgcattgcatatatatttttccagctgctccttgcttaattttctctcctctctctctctctcttttgatcaggctgaggctcagcagcagaagcagcagcagtagtaccccatcatcatgcatccatggtgagagatggatggtcactcacatgtgagcagtagtgccgatcttgccggactctgcagggccacccactgcccaaccatttcttggctaacttgctacgactacacatatatacctagcaatgacatgcatgaaagccaaacacaaactgctccaatatctctatcttcttctttagtttctgaaaatgcacattgacatcatttcctcttcaatggagtagataaactagataagctatgtttgagggataaatttaagtatgacacataaatgggggctattgctaataatataattatactctttccatccaaaatatgaaaacatttctaggccactgattctaatgcacaaacaatgtacatttttaaccaatgagatgcttgggaaaaggaatactataagcaattcaaatatcaaaatttgactactgaattgaagtgactagaagagaattctttttccctccacctttgtttttgctgaagaacctaaaaatgtttatattttcaaaagatggagtatttcaagcttggtctatggtgtttttttaatatattcagggattgtttcctgtttctgctgccatgaaatcatgaggattccctggaacaagacaagggggaaatacaagcatttgagatcaccaaggcatggccaaaaggaaagaaatggatggcatggctggcttgctggagctctcgtctgtgtcgtctgtgatcaatcatgattccgtagaaactaccaaagcatgcaaaaggccaattggcataaaaaaaacccctggttattttaattacctacagcagcagttgctcctatatctatatatgcgtgtttcttcatgtttgatagtatatgaattatgagtatataatgacagaatcaaataaaacttttatgtgtcatacttgaattatgagtatataatgacagaatcaaataaaactcatcgtgcaagattcactgatttgcatgaagtttaaaacgactgctttcttgcaacaaaagatcttagcattcaaaagcctaaaattgtgtaagatgcagtgtaatacagtacattctactattcactttccagaaaagatgtagccagtaggacattctacggaatatcttgactgttctgtcttgagggaaattaaagtagctaactctacataatagttgcaattatgcccattccatgcacctagctagaaaaaatatttatattcaaatggaagaacagtttttctctaccatgcatgaagctacagcacacaccatgagctagcccatgcatgactctggagggaattggcaactttatctgacattctgcctatatatgttgttaaatgcctaatctaataactgcagagtacacacaattaagtactggtgtgaagaagaatatgcaatggtccaggcagggataataatacggtttattcttgtcaaaagtaacatgcctaagccctaaggtatgtctattgattgatgttcttacatttgaaataggcattggaaactattttatttgtataaccaaaatgtgaaatgaataaaaagagtactccaatattaaaaaaaaacaaggcattaactttactgataatgtcacaatactgttacggctgagagagtgagattacactgggtagtgtttatttccttgtcaacgctttattttaaaggcggtttcagtaactataatgacatagtagttctcagcttacagccttacactgctgcattgattaaagttctcgaattactgctacggctttctgaagcagtaccgtgttttcttctgaaaaatgtttcataacatttcacttccaatttcattcattttagcagagaaagcatttacatgtactccaattcagtttatcagaaatgaaggaaacctgtgcagttacaactaagtatatacgggcaacaacatgtgcataacatatgaaaaccattagcccataattaaacacagattttgaaaattttacttcatcacaccacatttattttccagataagttattaattaagtgcacccccagctcaaaatgcatgcaaatccattcttcaggaactagaaatttaagggaatgattaatggtaacaactgattacaaatggagctctaatggcagtagctctacacagctttatgagctgagaatggctaaaaattttattattacagtaggaagatgaattaactatgatatatagctagcataaacaacagtatataatttgaaaagttccatatatatgaattgaacagcccataccctcccaaaagaacatcgaattattaaacctcaattggaacatcaaaagagagagagctgggtaaattcgactcacttacccagctatgaaataatcttgacatgatcatcatcatcaggcagttcttgtcgaacgatcgatgagtagcccacgaacaaaatttgtttggatttgcttgcatgattcattcgctattcatccatggcggccgaggtggttactagctatgccatggcttgttgctgtggtggtggtggtcgtacggcgccgccgacgacgccgacgtcgtcgacatgcagggatcgaagccggccatgctcattatgttgccgtgggagaaggctcggagacccaagaagtccctggtgaggccgtcgttgccggctccggcgacgccattgccggtgtcacgatcggacctggcgcccctgctgctctcgtctgctgcgatgaagtgggacgcttcgaaggcgagcccgtagccgccggcgccgacgcaagtgctcgacacgttgctggtaggaggaggagggggagcattggtggtggcggcgctgctgctgctgttgtgcgtgctcgccgccgccgccgccgccatgtgggcgtggctcgacgggcggctcagcgtcgcgcccatctgcgccgccttctgcagcagcgcggtggcggacatgtgcgccgaggaggcggcggggtgcggcggcgcggatgacgtcgacgagaacccgaagctgaggccggcctgctgcgcgccgccgctctccggcgtggagctcccgatgaactcctggtccagcctcgccgacccgtacatcgccgccggattccccgcgccggccatcgcctccagctgctgctgctgctgctgcgccgtgagccacgacggcgcgaactgctgctgctgctgctgctgctccctcttgaggcacagctcttgcatcagcccatgcccccccatcgccatcgccgcctggtgatcaagcacatccgccacctgcgagaagagcatcccgccgccatgctgctgctgccccgccaccgccgccgccgccgtgaccgccctcgcgctctcctccgccagcgcgtcgcagaacgccctgtgcgtgatgaagctgtcccgcctgcacccacaccgcaacccgatcatcagaacctccgacgacggccatggcggcggcggcggcggcggccacgagagacgactgaccgggagaagagggtgccgcaatcgcagcggtactcgcgggtgccgcagaccttggagtgggccttccagtcggagtggacggcgtagcgcttggagcacttgtcgcacttccacttcttctcgccatgcttgcggctgaagtgcttcttgatgccggtgaggtcgccgagggcgcgcgccgggtcgtggtggacgcagccggcctccgggcacacgtacaccttcttcctcaccacctccttggggttccgctgcttcagcttccatggcaggttgtgccctcgccggtgcagctgcaggttctggtctcgctggaaccctttcccgcagatctcgcacacgtacctgttcgtcgccatcagcgtcctcggcgacagcgcgatcacctccgcctcaggatctacccataattagttagttagttcatcctaaattcgattaactcgatcgcgatcgaagaattcggtgctgacctgggttgccggggaggctgcgcttcttcttggcgggaggaggagcggggtgggacgagacgctggcctggtcgccggacgccgacgtcaggttcgacatgttctcctcggcggcggcgagcagctgctgctgctgaatttcggccagatccttgagcatcatctggacgaacttctcttgaattctaccagctgctgctgattatgatatctgaacgtatgatcaatcgatcggcgatggatcaatatcaatcagatctcgctgcgccggtggcgatcgatcgcacttgcaccctgtaacttacaccgatcgatctctgacggcaaggccggccgggacgacgactagctccactgatgctgctgctgctgctgccactagctatctactggtgtgcaccttgcagtgtcactaccggcatagacggaatcatggagcttggctataatctcagcaagaaacgaggtgatgatcgaacgatctcaaattctcaattggcttctcatcacccgatcgatcgagagaagaagagaaggggagatcgaatatattggctggttgaatcaactatcaagctagggttgatgagagagaggagaggagaggagagaggaatgaggagcaagtgtgtgtgcaagtgcaacccctccacccattggatgacacccacaattcacactgaactatagctttctctctctatctctatcactatgtatttctttctttctcttactagggtagtagtagctttctctctctagctagctagctagctagctccgtgtcagcaacaccccacaaggatcgctgggcattctgtcttttcctttgcctctctctctctctctctctctcttcagactgtgatgcactggactcaagaaatcccctgtacatgcctgcctgcctgcttacctgctgttactgtgctctaatcccattatatgctcttccaatggatgttaattactgcctccaaagctagctgggagattagattttagggtcctctttggagagctcctgaagcagcacctgataaaacttaatatctctaggtattagatatctcaagttactaaaatttttacctgtgaatactttctttaaggattgtaaaaattcttcttccgaatagtgcccagatatacatgagctaaagtgcaaagacaagtagtggacaggtgggacatgggtcacaattgacaagtctgaattttgcttatgatcaccattgccctgattaattgtgtagggccctgattaattaaagctaatggtgttcctgtgcaaggattcatactgaataattgaatcttttttctacatctgaaacaaagcatataggtagtgagtgttaactaacttcgaaatgttggaacagggcgtgataacaccaatacatgagacataaaggtcgatctgagatcatccacttctctttttttccacattgttctgaattctgatcggtcactgtgcatgcatgtgtatctttcagcatatgcacatctctcctccagctttgggttaggtatcttaattacaactgttaaattagtggagataagtgagcagtccatgaatgtttgtttgcttcaggcagggcaacaaaattagggcacacacaaacaatcagctttggcgatcttaaaagtggggaaggaaagctagcagctagctagtatggcctgatgaaaggttggtatgatttcctggagaatgatgggcttcttcattcatttatgctgttaaggaagggagaaaagtgtgctgagttagtgggtgaagcaggctaagcaaaagggtcagctttttgcatttacacacacatcattggcccattgattgaatttcacagctaagtagtacagaagtagtagtagattgacatgcatgcatgcttgaaccctgatgcaaaattttatatatgttctccttccatgaaaatttttaaaaggttgtgcccaagtagcttccaaccattcaatctcccctcaagttgattgggggcttcacaagttatttaatactcctttagagcttaaacatgattttttttttcatgaataagaaagatggtgtgacatcccagcccagggcttaataggattaatagaatacttatatcaataagttgcaacttttttccggaagccgatttccaaagaactccggggttaagcgtgcttggcttggagtaatttgggatgggtgaccgaccggaaaattcttcccgggtacacacgagtgaggacaaagtgtgtagaaaagacattgtgttattccagagtagggtagtctacgacctatataagcaggcccggcctgggagcagtctggcactggatacatggacgtggccaagttgcaacttcttttccggaagccgattttcaaataactctagggttaagaaaatggtatcagagccgactctcgtggtttcacgggcgcgtgtatcgcagttgcgcaggcatggtgtgcatggctggtgtggacccggagtggtcacacagcatggcacatgtgctggcactggacaagcgtgcttggcctggagtaatttgggatgggtgaccgaccgggaaattcttcccgggtgcacacgagtgaggacaaagtgtgcagaaaagacatgtgttggtctatgaaccccgcgcattacgaccggatatatagataattaaggatggttgataaacatataaaaaaatagttgtgctaaaaacattagaggaattaagatttgcgaggtgagacaaggcgaaaatgaggtgaagatccatctgaacctaacctctagtttggaccttattagccatttgtatagacgtaataactaatctaaccgcggatgtttgagggaccaattgatccaataaataataaaaatatattgatgatgtggctcagcggggatgaaattctatagtaatttttatttactggcttgtaactctatgttagaaagtagaacgctgctatacgtacgatcgcaacgtccgactttgttacgacgtcagcagcacatgtcagattctattaccgaagtgagacatttatcgtccaagtgattgagccttccattgtggccgtggtcgtatacggtagctagacaataaggacatatgtatatcattttcctagaaagtattatgtttgctggaatacacatcttttttcctgagtaaattgtgctcgatgaagaccggccaaactggaaaagtaaaaacaagctgaaaaattaaagccaatgtcaatgcagatgcagttatggttgtcctggtgtgtgtcatgtgtggcaggggctttgtactgctactcagattaggtcatccaacgacaagagcacaaccacactttgttgcaaaagccccaaatttaaagcctgatcttgggtcccctaccaaagcaaaaatctcatctctggcctggccttctgcatgcaccccaatgctttcctttcatctctgcagggccacaccaccatatgcccatgcacatccatccatcgtccggcttcacctatggtttttcagattcacttcacacatccctagtttgtgctactcctagctacaaattgaaattccatattggcatctcattgttcatttcaggccccaatattgggccctccagccagccagtacgtatgtcctagtcaacaatgacaggacattggtaagttacccagctctgtctgttctgaagcacacagaaattttacagcatttttacacacaagtccaatgtccatgaaaatttaacctccgaaattcctatgttccaaaagaggcatgaatcctgaaatccgtgaaaaatcaaatgaatcagttcattgatatagggattgggggaaactcatgttttaaaatagggcttcagtaagatttgttattcaaggcgttcgcaaaaacaaaaaatagtgttcgcaagacttgttatgcaagtacttaaaacctatatatatgagaggagtaactaccaatgtttattaagaggtgatgaggcttgaagccgagccagctagcccaccaacttgtgctatacagtaaaactctaaggccttctttgtttaggcttataagacagttatgaatcgaaaaatctaaggctaaagctaaacaaataagtaattttttcgtttggcttttttaaagccataagctactttcgctattaagacaaaaactaagttggaaaaacttttttttgacttatgtgagagagatatatgactctatcattaaacttaggactttaaatccattagcttataagtaacttaaaagtctaaaccaataaatctagacctaaaaaaagccccaagtctttctctagactataagattcaaatggtggagctggtgctgctacggatttatggaattctttaccactccaggctaaagaaaaccacacgagggttttaactagctatgacccactgagcccactaaccagtacatttgttctagtgtgatgataagtcaacaacaataggacagtgctaaattcaccgaggcgcattttcaagaatggtaaatttacagtattttcacacctatcagctcaatgcccgtgaaaatcctgcaaaatccgtatgttgcaagagagacctaaatcctctggtataacatataaacttgtgaaaaaaaaaacttgtggattaggaggaaatcatcttcccaataaggcttaatatatactccttccatcctaaaataagtgcagccggtgaactacacggctgcacttattttgggacggagtgagtaattcaagtacttcacctatatatgacactccactcaaatggtggagcaggtgctactatgtacatatggaattatttaccaaaatatgagctaacaaaatcacctgaggatttgaaccagctacctgcagctgcaagttggtccctgcaggcatagatggatgcaggacatgtagaaagaaacaaaagaagatgtcagcaaatgaacagtttatagacccgtgggttagcatgtccttcactcaaaaaaagtgaacttttaaactacgcatagcttggttattctttcatctttgctaattagtttcctttggagacaagcaagggatttgatagatagatagatgggtcaaatattgttccacgtcagcttcactttgcttaatttgataaactgctcttgatttgtactggtgatccaaaaagcaaaacagctactgcgccaaaacattgtacggccgatacatattcttatagtccatgaatataatatgattgatccgtgaaattgaattgagttttctaaatttttggcaagttgttgatggagccttcttgagaggttggtctcgtgggctactttttccaatatgttccttcggtgtagccaggtacagtggatgtaacaattgatatcgacttatggtacagtgatcatggccccattgtctggaatccaatgttggtttttttgtgtattatgatgataaaaataaatttcttccttttttttttcaaaaagatccaatgggtggatggcatggcgcgctatttatacattttttttcatttgtccacaaagaatttgtttttagataatcaatgcattgaaatttgagggaatgggggacaaatgcatattagagtttgaaaatataacggacaaatacattaaagttaaaacaaagtttaagggcattctagtttttttttggctttctattaggtccaatgattgttccccatttccaacttacaccatcaacaccttcgacaccattgcattgttcatatggtctggtgagatggtgcataatggttaactaggactgtggcaaccttaatgttcaagattttgtttttttaaggggaaggcgggattattgcctgatcaattaacccaaggcctgataattattctaaaaaaaattctcctctttcgctcaccaaaagatatatactactacattaatgtagtgtatattagaagaccaacgacatttttatctttgaaatgttgagccatcagccacca

SEQ ID NO: 60782 - DNA, 22097 bp, Oryza sativa
cggactatgactacattactatagggcgaattcgagctcggtaccccatcatccggagcggcggcggctgcgccccctccacggtagacccaccggcggcgacgccgactgccgcgcctctcccctcccccatctttcgtcggctgcctcccctctccctctctcctcctcccgtcgcgaggccctcgaggcagcggagctcgaccgggctcactggccgcctctttcctttctaccgccgccggcctatcccctctttgcagcagaggagcctagcgcggcggcggaggcagcgcccacgatgaagcggaggaaggcgcggccgtgagatggggctggttgtcatgcatggcgtcggccaccgcctcccctcgccgccgccgctgcctccttcaccgtaccccgccatcgcctcgcctcctccgtgagcagcgtgagctcatgccaacgcctcgcctcgccgccgccgctacctcctccgctgcgctcactgcctccgccatcgccgaccacccgtccccgcgccgtcctctccgtgtgcgcagcgcgagccgcgagagagaaaagagcgagagagagagaggaagaagagaagagtatggcaggcgggtctcacaattttttattaaaaaaaggctgactggattgccacgtgtgcgccatgttggacaaaaccgctctaaattggttcgagtggggtaattcatccggtttgcatagttaggggtgaagaatgtccggttttgtggttaggagggtaatttggacgaccgcgatagttcatggggtaattcgtactttttcctaaactaaatacaatcaacactaccaaaatttggtagtgctaaaatataccatgcccataatctttagttagcggatattttggagaacggtcggtgctcggtaaagtcattattttgtcttctccagtagctattctacatcccatgccatgtatacactccacagtggcccactttagataagcaacaaaataaaaaataattacgtacttttttttaaaataggacaaatagatccgttatgagtcttctgtaggataagatcggtttggtcttgtgataggggtttgaggaggaacaagaggggacttctaaaaacataaaatggatctccttatttacagggaacaaagtgagtgatatcttttgtgagtatccaagggttacttctcagtggcgtagctaggaatttttcgttgggtagtcctattgcccatgatggaggatgcaaaaatttaggtgtggccaagtaactggtagatagcaaatataatgatgcaaaagttatactacgaaatttacaaaatttgtccttggtcgtgcctacttatgctacaatttttaatatcaccatacaatataatatgcatttacaaaattgttaaagaccacctaatttaaataaatcatcgtaacataagacacaatgataaaaaaaaaaagacaatgaacaaagtgagtgatattttgtgagtatccaagggttacttcattacttctttatgttctaaaagtgctaggtatgatttttctagacatttctgataggatacgtacacgggagacatgtaggagttcttgccaatggatacatatgttgcatgttactccctcctttccagaaaaaatcaacctagtactggatatgacattatctagattcgtagtactggaatatgtcatagtcagtcctagattcgtttttcgtgggaatgagggaatatatggcttattttcagcaggacacatggcagaattttagagatgtctaacttaatttttagagactttttacagtccttgaggggaggcagtaccatatcttggccattggtttcgcccaatctaacggctgaaaatggttggtaccgcgcggtaccgtgccttcctccgagccggtaccaaatgacttttgaaggtgggagggcaaaattgtacattcgcataccgattaggagtggaacaccgcgtgtctgccccagtcgtcgccacaaactgagcaaccctagaggtggccacgagctcgtggctgatgcggcgacctcccgagcggcggcgacctcccgagaggtgggccgatgcagggttgtggtcccgccgacgaactatcctacctcctctctcctctcgtacaatagaggcggcggccatgggagttgcgcagaggccgcgagaaacctctcagatgcagaggtggcggaccaaagtcggctcctcccaccaccttttggagcctcctccacctttcccatctgtgtctcccttcctcatcccctgcccctagcgccttaaccatcccgtcgtccagatccggccaaggaccggagcagggttggaaatttcggactgaaatttttgaaatttcgaaaattttggtcatttcggtcacccccgatacgatattatttcgaccgaaatttttcattttttcatgaatttgggtaatatttgttcaaattcaactaaattttgcttaaaatttcggaaatatcatatcgaaatttccgaaaatttcgggatttcggtgaccccctatacaaaagcgtcaaccgatagagtcaaccctggtctggagcgccagatattgccatgaggtacacggcgacgagctcagctcggagaacagattgaccttggggctgcggcgcaacgacctaccactatcctccctagcgctgctactggaagtgatgaccgttgggctggtcgccttgtgtaagaagaggatggggaagctgcccggcatccatcaggtacgaagctgatgccagcagcagctgtgagcctgcaagcgcatcaccgtccccatacttggggtcaccagtcgatgtcgtctatgagtgtatgacttgatctgtaatttttttaggctgtacatagtggagtatatttcgctgtaggtgaaatctaatttttttttcctcccaatatctcaagcacggaccttttcttcagcaaattaaccatgatcaaagaaagggtaaaaggatttgtaagatcttgtagtcttgcccttgtttagttccaaactttttcttcaaacttctaacttttccatcacatcaaaactttccaacacacataaacttctaactttttcatcacatcgttccaatttcaaccaaacttccaattttggcgtgaactaaacacaccctttgttcaggcacgatttctacctctgacatgccaaaacctggcgattcttgagtgctagaaggaacttgcatggtggaatatgtcttggtctattctgtcagttactatgttttgttgcagaagctattttgtcagttatgtatgtggttgccggaatcgatattgttggaatctgtcttgagctattttgtcaattatctacaaataggtaattgacagaatgacaatctgtcatggatgtccataaatattggggagattttgccaagatattaaagaaattcctagtgaactctcttattcatgtaaaactgcatttggttgtgaggtttagctgagattttctgagttctgaaaattttcgaaccttttcggaactagtgaatcgagccatgcacagggagttccatcacgccaaaggaaggtcaccctggagacgtctctttcttctcctacaagctcctcccaaatgctgtgtttctccaatcactccatcgaatggcctccgatggccctgcaagagagagggcagggatcttgagcggagcagggctggctgtatcgacatgacccggagagaaatacgaggacgaagacttgggaaaggggtaaaaagtcatggggacttgttgtgtcaacaaatgtccccataccaatcttacccctgtgaaatcaacggtgggattgaagtggtacctcaaggtacctggtacctcgtatggcccgtttggttggagggagtttttaggagggattgggagtttagagggatgaggctattaagtgttttgtttggttgggagacatgaaaattttagtgggatggggatggggaattgaggaaggaactcccttcttttcaataccttggtaggggcaggtaattgggaggaaattcctcctttactttatgtaagcaaatctcagccatccgtttttattaatgataatctccaactaaactctctatcaatttccatcacctctatcaaacaagatattgggattaaaattaaattcccatcttaatctcatcatcaattctctcgtgtaaactcccaatcccttcccttgagttaccaaacaagccggtagtacctcctcaaggatggtaaaaactctcagagatatgtttagtgtgggagtttccggattctcctctcaccctgcccgtttggttggagggagtttttaggagagattggtagtttagagggatgaggctattaagtgttttgtttggttgggagacataggaattttggtgggatggggatggggaatcgaggaaggaactccctccttttcaatacctgggtaggggcaggtaattgggagggaattcatcctttattttttctaagcaaatctcagccatccgtttttattaatgacctaatctccaaataaactccctatcaatttccatcacctctaccaaacaagatattgggattaaaaatcaaattcccatcttaatctcatcatcaattccctcgtgtaaactcccaatcctcttccctcgagttaccaaacaagctgacagtgtatcttcttctccttattaatcaaacaatgcacagatctcctatgtgttcgaaaaaatatattcacatggttacgacattaatttggaaggcatggttaaatataaggaaaataactaggtttttccttttcatggataaccatgctaaattcaattggaaactttgattgctaagtctcctatttgaaagatgtttcctctgtgcagggttggaattaagctaccgacggttgaagtgcggtatgagaatctgaacattgaagcagagtcgtatgtgggcaggaggggacttcccaccattctcaatacatataccatcataatggaggtatttgcatgaatgaactatgagaaaattactacattcataagaaaaaatgtctccatctatctgttataggacaaaattataataatttagatgaaaagaaagactctatcggggttgatcaatgagatggttactactttgtgattatcagacttcttaagcccgcacaaatcaagaaactgctatgtaaactgatcaagctagaaaatttcaacatgaaattcacaggttttcattgataatagagcggtaatcacggtcactaggaagcaattttaagtgacatcttgtggagcacggtctccatgtttaatacaactttgtaagcattaattcaaaacttgtaaaacaattctgtgtttgttcaattcaattataatggtttctatgaatcttaacaaccgaaaactagtttttattccatcaatgaactttgcgacatcctagaaagttgcttcccattatccgtagttaatgctaattctctcctctgttatgaagccacatcaccccaaatggtttttttttttttgcaccatggtcaatcgtccatgatgagcccatcaacattttctcacttattcctaacattttttactacaccacatcaattatttctgaacttttggataaaaattcactttgcatcatcatgtttacttgtcgccatgcaacttttctattccaatgcacaaagtctatgtagtttcaatgaaacaagaaatctatgtggcagagagtgcctgccaactacgcattttccatgagttccatatgcagatctaactcatggaatttgtaaatacttgattgcttttagttaccagatgacattaggcttgtgctgacccatattttattccattttttaatattacattaggtttcccttattttacatagttcaatgtatcacacaaaggtgcaactgacaactagctacctctaaacagggcctgacaaatgctctttgcattacaaaaaagataacacacaaaataccaatccttcacaatgtgagtgggattatcaagcctcacaggtaacttcttagtaattgttagtttacaaaatatgtccatgcaaccttgtccatgcggcatataaccttgtccatgttgttttcagaatgaccttgttgttaggccctccaggttcaggaaaaacatcactattattggccttggctggaacatcaaccttaaaggttattttgtttatgtttttcacatacaactcttctttagtacattgcaatatactttaagtattaatatgaggaaacattgcaattataaaaggtatctggaacaataacttacaatgggcattcaatggaggaatttgtgccccaaagatctgcagcttatgttagccaacatgatgtacatatggctgaactgacagttcgggagacagtcaatttcgctgcaaagtgtcaaggggttggccatcattatggtaagataggagaaatggagagattgatactcatcaacattaataaaatatcatattaaaacattaacattttctagaaaatgcttagacttgctaatggaactgttgaggagagagaaggaacaaaatattaaaccagatccagaaattgatatatatttgaaggtacaatgcagttcttaaatcacaactaactttatccagtgttgagctatctctagtacggttgtttttaccatttattgatgttccactaaaaggtttgaggaattgcactttatcattttgcttatgcaggcagctacaacaggagagcagaaagctgaggtggtcacaaatcacatactaaaggtgtatgagcactgtctagttatatagttctattgtagtgttacaataaatttcacaattgaaatccgtatgccatttcccaataattctttacttttctaactatcgaagattttgggattggatatctgtgccgacacaatagtagggaacaatatgctgagaggcatatcaggagggcaaaaaaagcgactaacgacaggtaatgtatcattggagttattagagtgcatgatggttacaatttctgatccactccctaatattgatgccacagctgagatgattgttacaccaggacgagcacttttcatggatgagatatcaactggacttgatagctcgacaacattccagatagttaacaccatccgacaaaccattcgcattcttggtggaacagcagttattgctttgctacagcccgcacctgagacatatgaattgtttgatgatataattctactatcagatggtcaagttgtctacaatggccctcgtgatcatgtgcttgagttctttaaatcggttggattcaaatgccctgagagaaaatgcgtagctgacttcttgcaggaagtgagttttaccatggtttgaccttagcattatttttggtcaagtgcttaactatgactaattataagtggcttattttaggttacatctaggaaagatcagaaacaatactggataggtagtgatgacacataccaatatgttcctgttacgatgattgctgaggcatttcagtctttccatgtcggtcaagcaatcagaagtgagttggcaatcccatttgagaagagcaagaatcaccccgctgcgctggcaacatctaagtatggtgttagcatgaaagaactactcaaagcaaacatttatagagagatattgctaatgaaaagaaattcgtttttgtatatattcaaggcaattcaggtgattcttaaaaaccaaaggttgtttcattatagaaagataactcataagctttaaaaggtcaaagttaattggcctcttattatattatttcccttaattgttcagctaaaactggtcgcaataaatgcaatgactgtgtttatccgaaccaatatgtatcgtgactcgatagaaaatgggaggtcatacatgggagcactattctatggaatgatgatgattgtgtacagtgctttggcagaaatgggaccagctattgcgaagctcccagttttgttcaagcaaagagatctattatactacccatcatggacatattccttgccatcttggatcattaagatccctatctccttcctcaacacaacagtttgggtcttcctaacatactacgtcattggatttgatccaaatgtactgaggtaaggaaaacaaaatattaccataaataaattcttgtaatgaatacactataagattaatgaaaacaatgcaatgctacagatttttcagacagttccttgtactttttgttttgtgtgaggtaatatatgcacttttccgcttcattgttgcccttacaaggcatccggttattgcaagcaacatgggcccattctgcatcctcatttttatgctttcatgtggattcatcttgactagaggtatgcaaatagtttaatgaattaccatatgatgcttctgtaagttttgatactaattccacaatgtatgtagtacttttatctctgttatatgtctgtatgattcaacagatgatgtcaagaaatggtggatatggttgtattggatatcacccctaatgtatgccttaaacgctttagccgtaaatgaattcctaggtcaaatctggaacaaggtaaacatatacttatggaatcgattaaaagccatatatttgaatttgcctggctaaaacattttgttattgttaaacaacagtcaatacttggttacaaaggaccacttggaaggctagttttaggatctagtagttttcttcctgagaccaaatggtattggattagtattggcgccttgctcggatatgtgcttttattcaatgtcctctacaccatatgtctcacatttctcacacgtgagttattaaaaaaagccaattttttcattagtaaaatttattctttcaaatgatctataaattctaattttatgcaccatgcactctatagtatttagcaggagccaaccaacaaagcctcaggaaatgttgcagataaaacaacataatttaactaatgaagttttggaagcatcgtctggagggcgtgctgcctgcaatacaatatgtaaattttttgattcacctatcaaaagactaaacatgtcataacatgatgagatgccattcaaaagttaattttcatttgtgctgtgtctggtagatgctaaggaaatcatcaatgatgaagcaaattcgtaccatgcaacaagacattctagtgctggaaataaaggaatggttctcccttttgtacctctttccatcacctttgaagacataagatatagtgtagacacgccagaggtacaaaaatattgcaaaatattgttgagacatgcttgctctctctctctgcataattgcctatatttgcaccatttgcgagcaaactctatataatagttgttctaatcctgcaataaaacttgtaggcatttaaagcaaaaggtatgacagagggtcgactggaactattgaaagatatcagtggttcttttaggcaaggagtacttacagctcttatgggtgtcagtggtgcgggaaagacaacactgctggatgtgttggctgggagaaaaactagtggatatgtacagggtagtattaccatctctggctacccaaaaaagcaagaaacttttgcccgaatttcaggatattgtgaacaaaatgacatccattcaccaaatgtaactgtctatgagtcccttatgttctccgcatggcttagattacctgttgaaattgattctgcgacaagaaaggtaagtcaagtacaagtaataactactctctctttatttgaatacaaagtagtatataagaatgtagattttgtgaactgatctatattgtctcacatgatgctacaaatgaaaaacaaaattgatagagatggaatttttatgaaaaatacgcgacgatgtgttgctttttctttatcttgtagtagtttttaaaaggaatattcatgtatctttttgacatggtttctagatgtttgtttatgaagtcatggagctggtggagattctctccttaaaagatgcactggttggattacctggcgttagtggattatcatctgaacgaaggaaaagactaacaatagcagtggaactagttgcaaacccatccattatatttatggacgaaccaacatctggacttgatgcacgagcagcagccattgtgatgagagcaataagaaatacggtggacacaggaagaaccgttgtttgcacaattcaccaaccaagcattgagatatttgaatcttttgatgaggtgaatgaaactataacaatattgtgcatttgatctttcaagaaaagaaaaagtaaatcattggtgagtaaatattgtttgcacactcactcaatttattctaatatggttctttgttgcagctcttcctaatgaaacaaggaggtgaagagatttatgtaggtcctataggacgacaatcatgtgaattaattaaatattttgaggtaagaaaaaaacacataaaacaatacaattttgcatttttgctgtacgaaacatgctattgaactccttttattttctaaaggctattcaaggtgtcagcaagataaaagatggctacaatccttcaacatggatgttggaagtgactagtacaacgcaggaacaaagaacttgcgtggacttttctcaaatatacaagaattctgagctatataggtaggtattgggtagtgctttaattgttgtcccattaacatagcatctatgtgcaaagccaactttctagtatgtacagaatatccgtgatggtatgtgtaagaagtgggttctactaatgataaaaaaaggaaataatgagacaatgtagtggcgaaagcaaaaatatttcctatatgaattgcagaaagcgatgaaatcataatatcaaactggaaatgcctcaaatttattattcttccacaattaatgtttccatttatgaaaatggtaataggaaacatcattgtttcacaatgttactagtttgctttcattacaggaggaacaaaaatttgattaaggagttaagtgcacctcctgaaggttcaagcgacttatcatttccaactcaatattcacagctttttcttacacaatggttggcttgcctatggaagcaacatctatcgtattggagaaatcctccttatattgttgtgaggtacctcttcactattgtagttgcactcttgttcggaaccatgttctggggtattggcaaaaaaaggtaattaactgcaataaacaaatgcaagtaaataatatatatatatatatatatatatatatatatatatatatatatatatatatctcaagtccatccattgcagtttacaaaagatattccattgctgcagacaaaatcaacaaaccttgttcagtatcatgggtgccatgtattcggcatgtatggcaatgggggtgcagaactctagttctgttcagccagctatctttgttgaggcgcacgatcttttacagggaaagagcatcacacatgtactctgctttgtcgtacgccttgggacaggtaaagtttgttggcatcataatcattttgtaaatatatgcatgcgagtcttgataaaatgttttaacatactattatttttttatacaaaaccaaggctctcagtaagtggaaaggaatggtgaaacaaaaagccttcttgacatctagtttcattgcaggttgcaattgaatttccatacatttttcttcagaccataatatattgtgtgctagtgtatgccatggtagggtatgagtggacatgtgccaaatttctttggtacctcttcttcatgttcttcacactatcatacttcacattttatggcatgatgatggcgggtttgactccaaacaatgccatgtctgctgttgtttccacggcattctataacatatggaaccttttctcaggatttctaataccacggattgtacgtataccagcttttctcaagtatctaattgtacattgttcgtggctaaattatctcacatccactaatttttctaatatggctccgtttactacagagaattccagtatggtggaggtggtactattggatgtgccctgttgcttggacactcaatggattgcttacatcacagtttggggatgtaaatgacaagtttaataatggcgtgagtgtatctgactttatcgagagctactttggttacaagcaggacttgttgtgggtggccgctgtggcagttgtctcctttgctattctctttgccttcctttttggactctcacttaggctattcaacttccagaagagataagtaaggaagaccatgtcgagtttcagactttgatcaaatattggttatcatagatgttttacagtatgtgcataatggcataatggcatataacatgcttacaagcatctgttttgccaatataaaatgcagccgtgccgagtgagtttgtttaatggctgtttgcaaaattggctctcctatacccctcattctcaacttttatcctttatttttcctggtagtaatcaggtgaaaagatggttttttccattgcatgtaatttatatgaaccaataaatcttcttgactactagtaaacaaataatagattaaattttcacaataaaggttaatatgtacccaaaacaaaagaagaaacaaaaaatattttgggggcaagattgtaaatttgagtaaagtgcatagccagttcctattcttgttcgcacctatcatctcgatccccaaactcttaaaatacatatcttggtgctataaattgttaaagtgtgttattctgatcccaaattgccatgaacccccaaatcataggtgacatgccatgtggatgctgacatgtgtcacactccacctttgcatcatctaatagtgacactagaggggatgagctgcaagagatctgcgtgaaccgaatccaatggaaccactcttccggtaccagcaataggacacgattgctcatacatgcggtcaactaagatgaatctattcaactgaatatgataccttatagaaggtcacaccttcaaaacgactccaaaagtgtcacgggcaagtagagaagcagcagcagaagttagcgcagctagaccctatccacgagcaatggtttgggattaaaaagaaaccctaaccttcaacttcactcttcttgggggaggggaaaataacaatggctgagtaaatacatactccacaagccacgggaaatttgagtatgcaggctccaaatgacagttggttttgttttgtaaacttttaaaaatatattttgaaaaacaaactaagtgtggcgttgtttaccatgtgattggatggagtttctcgcttccatcctgtctacgaattgctttgcaacaactcaagtggatgaaaaaaaatttagttgatgaccactattatgtcggctgtcgtaccatgactctagcacataaccttctatccttaggcagttcccaactcaatcggtgtccattagtttcttttcactttttaaccactgggcatcatcccatctaatcatctcatctctttggctcccagagccaaccatattctccaacacactagtgtggccctacaaattgggagaaatataatcaaagggtaacttccttctgatttcttgtccaaaataatttccaacgacatagactatgtgcaaacgaaagagaaccaaacaaaaccctaaaaataaaacaatattattaataacaaatagtacgattggatagatctcatttttagaaaaaattgaaggccttaacatggtcgattcgagttacaaatagggagtatgatttttggatgattatgattttctgaaatataccaaaaatgatttatttggagtataaggggaataataatattcccatgacaggttggctcaagggtcggtgagaaagggaagtaaaatagactttgtaggggtgagatgttggttggtgcactcaggcaggcccattggctccaacccatttatgaaagtagccagttgagggagagatagtggacttggaaaggtggaagaatgaggtgggccactacctgtgtgggctaccaggctggcccataaggcatcgacctggtctacggctaacgcaactcggtggcacggagttggcccgcccatcgcagccgcatcggcctagtacgggagggtttgaccgtccccaatcaacggctggtgacagcaaggagttgcagggatgatggtgactcggtgagtgtgacaagtggcttggatgggtaggaaggtcaaaggtgcacgatggcagtgagagaaagccaacacacggcagtggctgattgtggcaatggtgccgttgcatcgaagtgggagagagaggatggattagagagctcatcggagggagttctatagcggtagagacaaaacagacctcgcagcgctccaaattgtatggagcgcagcgagaaagtgattggccgagggggataggaggcatgactgaggcagagggaggacaagcgagaatcctgttacgcgcgtacgcaccggcaaaccaagtcgcgcgcacggggctaggttttcttttttcttttcaggacttttttctttaccggatatgcctatattaacgtaactaactaatctgattagttgattagttttagataataacgataattaaggaaaaattaaggacgttctttttgtattactaatagattgaaaagaaaactatacatgcagttaaattttgaaaactttcaacttttcatctcaaatttgaaaaactttcaactcaaatttgaaaactttcaacccagatttgaaaactttcaactcagattcgaaaactttcaacccaagatttggaaactttcaaactagatttgaaaactttcaacccaaaatttgacaactttcaactctagatttgaaaacttccgactccgattcgaaaactttcaactcagattcgaaaactttcagctcgagatttgaatactttcaaatcagatttaaaaattttcaagttaagatttaaaaactttcatctcaaaacatattgaaaaaataagtgtgctaaagattaaaaaaagtaatcagaaaaaaaaaacgcaaaagaaacagcgaaaaacaaatcaccaaaaaaaggaaaaaaaatgggctggtgggccttttgggttgggagcagctggcgcacgcgcgtgccaactagcaacccccgaggacaagggggcaacgtgctttgcatgaagcacggggtgctgtggagctgcaataggtggaggcaggaactcgacaatcaggtgtggtttctcgatatactgggagggcataggtagggggtattgactgtataattgtacaattataggtgtagactaaaatgactatatactagaagtacagaaatgatgcttttcttttttttctccaattagcttagattattatttgagtgagtgtcttctggttagttccttatgtgtgttaatcgatcctaacacctgaattgattaacccccgcattagactttgatctacatatatgatgaaaattattaacatagtactctcttatcatattttcccacaggattaaataaatatgataccttggaaatacttccgggtgaaatactatatccatgcgcttgcggattatatctgtaataaagaataccgagtaatatttcaagagccactagagggaattatatttctagtaatgttgttaagaaatatcaacaccacgcaccagatctatgcgtggggagggcggccagccaccggatatgtgaggcacacagccgccgctaccggttccttgtgggggttgtccaccacccgccgtccatgcccttcaccgccggatggggccaccgggtgcgggggaggatagagaaggccgccgcgcaccatcgccctcacccgctggtgcccacgcctgccatcgccgtcgtccacgcccgccgctgccgccaatgctcaccgttcaggacagaggagaggggaaaagaggagccgggaaaggaagagattcggtgaggccgtgagagaggagaggagtggtggagatgagtgggtggaaggggggccggtgaaggggagaccaaataaaatgagtgagaagagaagtgttgttgcgtacgggtgagttaagaccccgcatgtgaaaatccttattttcgcgtgccgatgttttaagtggtccgtttggaaaaaaaataatttttgtgtgtgagtctattaaagagccgtatgcgaaaattggggtcaatttttgcggacgcagacacttatggcccgtctacaacctattagggtgcttgtccatgaaaatcatttttgcactagtgtaattcaagttccaagcgtagtcatcggagtgtaatttagtttttccctgctgattctagactagtgcttatcacggttactcaactgatcggtaatgcaaaaaagatattcacgtctgctcaggacgggaactattatttaatgaaggaaaaaatacgaattaccccctgaattatcgcggtcgacggaattactcccgtaaatccgaaaaccagacatcgttcaccctgaacttttaataccggacaaattacctctctcgacccaatccagagctgttttgttctacgtggcgtacgcgtggcagtccagtcagcattttatttataaaaaaatatgggacccacctgttatacccctatcacaaaagcataagtccctatgagagaaactaaaatttttgtgagagggactatagtccctccttcccaaacaccactttttttccttcttccttcctaaacaagcagtgatctgatgacattttcggcccagggccgtatatggtggatgattctactctacttttaattttatttgacgcgagtggtttctacagctgacgtgtatgtggtcaacgtaccgtttcaaattgagagagtttgtagcatggacatttttgctactgtgccacctctgtttcgtacgggctaataagtcactactattgaaactcagcttcgtcagttcacaaccgtgctaagctctatattgccacgtgctaagcaaatttaagtattttttttagaatcacacagtacaacgcaaacactcacaatcactcacaacgtacacgcactcgctcctatgaacgcacgcacgcaaaccttacccctatgagcatcttcgaagactgggccggcaaaatataatttaaagcgcatatatatatatatatatatatatgaaaattatatcctactaccgagagtaaatatacatgtattacaattcattatgtgctcgctagctacgacttcgacgccggtgttatatatgtcagaagaagaaggaccggcgttataaattgtcgatccgtcgtagtagaattcaccgtcgggatcaagaacttgttcgttgatgaatcgcatcaagttgttcttgagcagccacgataaatttcttgtgtgtgaggttgtccctcatgtgaataacctatgaatatatgaaattaataaacaagaaattgatatgtacgtaatgaaattttgaatggtttatatgtacattgtgctctcttgtggtatagatttgggttgataggatgtgtatacagtcgggtacaaaaatttgcatacggactttttaacaaacagatccgcatacaaaaacagacttttttttatgcctcttaacaggttcgcttgtgaaatgaattttcgcatacgggcctatattaattggatacatttcaaatctctttacatataggtcttctttgcatgtgataaaaaaggtgtgttcacgaaaaaacattttctttatagtggcatcctatatatttgtaaagggtgtgtttccactaattgttatagtattatttctgttttttctcattaaaccacatcatctcaagtgttcctaatgcttggattattgatctatggtacaaatctttattatgaagtcatatcatcttaatcttatatttggatgattcatctatatcattatttttcatctctaattgagccacatcaccttaggctatatctatagatggccatatggcccgaggcccacggcccggtccgaagcatgcaattttggcctggtccaagcatagcatgactcgactagggtcgtgcccatgccggcctggcccgacagccgggccgtgcctgggctgcaccctcagcatggtaggccggcccggtacggcccgatcaaataaaaaaatataaggatgcaaaatagacttaaataatcgtataaggcaaggcccaagacaagatatacaagatagatttattttccagccatttaaacacagcgcacattgttgagggaccaaaaatagactttttctgtgaggaagcacgatagaccgtcgtgccttcgggctcctcggcccaggcacggccgggcttgggccgtgccatgccgggcccagatggccatctatagatatagcctataggccggccacaggccagcccctatcaggatatgcgtttcacaacgattgacagcgaacactggtggtgtactgtgcacagatatgcgagatgtgtgtgcatattcttcaacgtaatcgatcgaaaattaacgaccagtgtggcctcttggcgtacgtgtcccgtcccacccgctcgctctccgggcccgggtcggtccatcgccgcgcgaccgcgagctatccatcgatagacgccgcgtcgctcgtgtctcgcgagctaccgcgcgcgtcaagcgcatcgcagcaggcgcatgcagcgatccacccctcgcttttcagttttgtccccgtaatccaccgtactatacggacgacgacgcggtgcccgccgtgtactcactcgcgcgcgatcgccccgcggacgacgcagccgccacacggacgacgcggcccctgcgcacgcacgcgcaccccacgggaaactacgcgccccgcggtccgatcgacctgcctatatggctatataggacctgcctagacgtggtcgcgccagccttcaattgatcgatggatttaattaacagcaggagtagctaccaagcatttgcaggggtagtagtgaccggcctattggctattgcatgagttttccaaacctggggccggccggttttgcaaaccagccctgggaaaggccggacagctgagctaccccaaagttcttgcacaatttttgacaatttgaccctctgcaaaaactaattttgcaaatgaatcgtgaccaaaacttatttaaaaaggaaaaagtacgaattaccccctgaactattgaggtcgaccgaataaccccctcaaacttgaaaagcagacatttcgtacccaaaactaataaaaccatgtatttaacccccctaagctgatttgggggcggttttgactggggaggtggacacgtggtcgtccaacgtacgtggcgacccctgccatgtcaacctagccccacacggataacccgaccggcgccatcccccttactctctctcgacaaaatttcccctttcctctataaaccctagtcggcggcgactagggcggcgattgcgggggtgactccggtgacggtgggcggtgacttcggcgacgggacggcggcacgctctgaggcagagagggcggcgcgttctcaggctgtctcaacccacgacgatgtcgaggagctcaggtacgtcgcagggcttgtcttcgtcttcttgggctggacgtggtgagggaggaaggcgtcacctgccggtgccatatagggaggggcctcttgattacgagcctccagttttttgtgagtgtaaaatgaaggcagctaggtggatttcctggagtcccagtaaccccgggaggagatattttacgtgctacaatgcatgtgtgagtaaattttcgattgttcgatttatttttctgatttgtttggttttgaactgattcagtgtttcacttgatatattctgatatattatgtatagtgtggggggtgcgatttttggcagtggtacgatgaaaagtcctgaccatattgaaagcaatttttgcttgatttgaggaatgctgtgtggtctggacgagaagaaatcaatggattggaggctgcactccgtgacagcaagaatgaagtcaggtagaacagggtggctgcacagagcagagaaagcaaagaaatggaatccctaagagcagctttacagcagatagaagctgcgaatgctgcttgagttgatagggttaataggcagcagaaatgtatggttgtgttgatgtatgtgttagcagctcttgttgttattatggttggtaataagtacctaagatcctagtgcattcctgaacaaaaaatgtgtggtgttggcaagggttgtatggtggcctgtaatggaatttggaattaatggaagtagaaatgatgcttttgatgaacatcagtatgtcatagtgactctttatctggagtaacaaatgttgccatagaaacactttgaatcattagttgttggaagattgcacaaaatgtgggcataaaaatgaatcatgatctgtaaaaagatatgtatccatagaacacattgaataattagaacgtgaagattgtacatatgttgccatataaatcaatcatgatctggaatacagaagttgccatagataggtattgaatcattagaactggaagattgcacatatattgccataaaaatacattgtgaatcatggatctagcataacatataaattcttcattgtctaaaatgttgccatcaacttacttagtgccacatgtttgacattatagtaaccactttacatcaggtaatacacaaaagatgacagttagtgctacatgtccaaatacagaagttgagcaccaactatcactacacaaaatatggtgaacttctgcatattgcttgctatcccagtaagcatgtccaaaagtactatgtatctattgtatctatcctactcactgtcctgatatgttgagctgagtagatcttctaactttcaacttctttgctggttgcccccctgaatcatgtgcagctgcggtggaccttgtccttggtcttgtagatgttgatgtcattgccaattgttgccatagtacataatatttgcagttaaaaaaaaagatacattggaaatcagtacaaaaataactgcagttaaatggcatgtgtggatgtgtggcagttgctcactgtggggtgtagaatctgtgttggcacgtgtggagctgtgctgagaaccctgagcctgtaaaaatgacttaacatcagaaaaatgacagtgaaattagtacatgtagatgataatctatagcatcttacctgcacatttgtctgtgcttgtgatcatttcagacatgatgccttgttatgaccagggagcttgcacaatctgcatgtcatgacagacccaaccctagacactcttgttgcttttggtttctcattgggttatctcctcctatcttttttggaaggctttcctagcattttcacataaccaggtgcttgtgggctaggcctatctgacttgggccaactctcaataccctcaactgtatctaggcagaacctgtatgtcttcttgaatgagtatattgagtagcaagggacaatgtaactgtccaggcagttggttctaaaatgcatgcaggctatagcatgacagcatggtaaaccagccaactcccagtatttacatgaacatgtctttctctcaagatcagcagtgaacctatgagagtgaacctatgagactgatgcttcagctcaaacttgtccatcccattactgattgcatggtaaacccctgattctatgatgtatgcattcagcttcttatgtatgtttgggcaaactgatcctacccacttgtccattatagacctttggtcatgtatcctaaccatcacttttcttctaatagattcca

SEQ ID NO: 60783 - DNA, 4990 bp, Oryza sativa
aaacccccgaacccctgccccaaccttacacagcagcaccatagcccatgtgagaacgaccaatgacctggccaggccttagacctgtgcttcggtgtaggacagacgaggggaatttttttaaccccaagctgaaattcactcccacggggagtcgaacccagtacctaaggagtgctactagagccacctaaccaactcacctagaggaaatcaggaacaaagtttatgctataaagggacaaaactatttagagacctgatttaaggatttattttccatccaattaacattttgttgtttttgcgtctagtgcaaacatgtaatagtactgtagactcactatgacccattatatcatatgttcaagacataacttgtaacaggtaaagcagataatacagaaaagacgtccccattaaaattggcatcagataatcgctgattataaaacaacatcaagcaatagtgacatagctgcaaacaaacttgtagagtcacgagtcagaacaccaaaggccccaacaagttacaagcttctttatatagaaagggatagcactaaattttttgtacattagaacataacattccatgattttaagctatggattggtaacatactccaaggtattttatacacccaagtggtaacaatgaagcaaaaacactatatacaagatcaaaaaaaggtgcaggtagacacgataacaaaaacaggaaggcatacccttaacaagttcccatgagaaaaaagctctggtctcctcattggaagagtaacaagttcatccagtgtcttcttaacatcctcaagagcaccaatatcatcaaattttactccaatttcattgggaggtacaactgctgaaatgaaattgcgctcgaattcatcttttgccaaaatctgcagtgaagatcccccttgagcttggaagtaacgcagtacaatgacttgccagcaggacaaataagactagcaactaatagaaaagttaaacaactaaagctaaattaccttaattttttcagaagacttcctcgatgaagcctcctgtgcctttaaccttccaattgctaggtccagacttcaaaaaaaacaagaaagcattgtcagtgcagagccaacagagatgaccgaatcccaaaatcaatgatgaaatacctctcacggggaatgatcagcctgtcaccctttatagagggacacgtcactgatgataaatagtgacttctagcccatccaatgaccttctctgctcctgcaattggaattccaaattttcaatgtatatgaaattacgtatgcataaagtaagaacctgtcctaattatcactccaataaattagttgagcgagttgcattcattatgcagtattagaaaagaagtatttattagtgtgttaagtttcatcacaagaaggtgcaaaacaaattgatagggccatgtagttggcagacagtggttgcatactatattatgtgtttctgctggggtaattgtgcagtaacatttcacatgtgattgcataaatcaaataaaaatgcatacaaccagaacattcaaacgtcaactccaacaaacttcaacttgaagacactatgcttcaaattttcatatgatcaacaaagcatatataacactggcaacccaggtaaaagtatagcatatacgcatcataatatggatccagctagcacactcactttgttttgtcaaaataatgccctccaatttcacatgcaaaagatcctcacatgatagctcatgctcttcaagcacctacattaatcagtcattacttaaaggcaagcactttgaggaagtgatgttttaaccatatggttttgtaggtcagtaaatgaaattcaaaagcaagggcaaaattactgattaaagcacatgtaatcagcatgtccaataccttgggcctttctaccagggatgccttgagataattatttttctggcttctcaatctgggtattgaaaactcttaactggtcattatcctgcccctaaaaaggaataccttaattttaaaggtccagcttgaaaagtctaaagcaacagctgtctaatcacagaagaattgcatttagttattggcataatgtaacacacagacgcatgatcattacatgtcagtgaacaaccgcagtcaaaacctttggaaggattcacatatgaaaacttcagagaatcagtactaaaaagatgtcaacttacctttggaagaggaataaagaatttatttctgaagagctttgatatgtcatttgactttgaaggcttccgcgcttttagcccacctaccagccgcttcaaggatgatgtctgaaaatatggtattacagattaatagactttttgtgactataggttgcgggaaacccaccatgcatggtgttagaaagaaaagcagctctttagaacattcaagttctccaagcagcaaaacacagaatgatgtacagcaaaaccaataagctcctcctatcaaaacacctttctttgttttctaactattcctgtggcaaaactacagttgagtatttcctggtagcgttgtttgttttaaaggttgcatatggaaaacctaagttgtctttttaaaaagcatttccattttgcctttttcttattagctaacaggtaagtggtaaccattgttttgagcaaaggccgggatgttatattccattatctaaaaaataataattgcaacagcaacaatttgccaattactagtacttgaaactaatcacagctcaatacatcattgtagcagcagcaaacaggtacacatcaaccttgctatatttggctgttcccaacgtacctagtagtgaaagtcactacattttcagactaggctgagccagatcttgctttctaacagcactataaacacagcttgatatggcacaggatcacatatatcagcatccctttgcgttttcttccaaaaaccagcatgatgtcaagccaatcttattaacctactggagtttatgggactattcagcacatatatatatgttatatgttagatgagcaactgtttttttcatttattcccaagcagtggtggggccaggattcagacatgggaggggcctaatacactgttatttaggttaattatctaattataaggtggttatgtgtggaaaaaaatgttagagggggccagatcactgcccctccccccgccctctagctggatatagtctgaaggcctaggaacctcacatggttttccatgcataaaatcaagatgagcagcagagcaaatgtaggagaatgcaagtgttttctgaacagttgaacaaagaacttgaagagtaccataaactaaacataacttctttgatagattaacaagacattaccagtggagataggcgagcaagattgtggaacactagcgtcttctgcattatgaaaaaacaaataagatccaaaagaagtgcctaactgcctataatataaatgcaagcagctggaacaataagtgtatctaaaatttaccggctctttttccttgggcgctgcctcagttatattttgtccacatatcaaaactaaagacccagtaagctggtcaaacacttcttctaccttttcaacaaactccctgcgatttgatcttggaactgccctagacagccactgggaactatcaggaaagtaaacaatggctggctgtagagatggcagtacctatttatataagagacccagtacagttaagttcattagcagatcatacaagacacaagtatagtagttacagcatctgcatatctcaccaagtgtacaacatagaacaagacgtcaaaactatgcaatgcaaacaacaagaaaattcaacaaaatataggttttagacaaaaaataatttctgtcaaattacctcacgaagtgcttcgattgcgatgtgccaatcttctgcctgtatatcatggtcaagctcaatatcctgagctaaaagtacaaatgagatcagtgttaaaattgcagaattttcaggtcagttacaaaactatggatgactgggaatagaagcatactgtcgacccaacaaactgctggtttagcaagatgctctttgctagcttcatcttttttatcatcagacagcttgtcttcagaaggatcaaatataacagctgcttgatcgccattgatctcatacacctctccacgctgtccatttgataatgtcctgcaattatgacataatatggtgttaaaaaataaacttctcacacaaattgtgccttttaacaatgctaaaagattagttttcgatataaggaatatcaaatgtaaaatgaactcattcatcagaaacaatggtgatacaaaggactattgagatggaaacaaacataaatatgactagtggctatgagtagagaccacactaacaagtattaagatattttgcacctacgtcacacctgaaactgcaagaactttatgcacaaagatttaaagcaaaacttgtagaatattaagataacatgccagcaaatgatatacatttcaggagtaactcttccaccataaataacaactgaatctaggcatatattgctcaaaatgtaacagcagtaacatggagtaaagttccaactaaaccttctagtcctaacctacacaaaactcacctgccattaatagaagtataggcatttgttcctccctcttgagtaggaatttgccccaaattgatcctgtgatatgaaagatatatgttatgaatcatgaatagcatcaagaagtacgaagatctaaaaccatgtaagaagaaagggttcgatggataatatgcagtacaaacaagttcaacatgcctttttgacgcaacaagaagttgaatcaccaatttcaccagcattatgaacatgaatactcaactgtcaatgcaagagcgtgcatccaactagactaacacacgtcgtctaaaccaaccca

SEQ ID NO: 60784 - DNA, 10800 bp, Oryza sativa
ctgatgcatcattattgcaaggtcagctttgcaaacaacacaaaaaaaaaggtaccggatcaagtgaggcaccataatattggatctaattagaccaatagaacttcaatacaaaagcatgaatgccatgacacaagtagccaataaaccaaacatgggtaagcttaactcccaataagtacctgtgatctgcttcaacaagcactgatgctccaacatacttgaccctatctcctgaaatagttaaacaaacaattagaaaagttgttttgacctttggcaacttttcgacctttgttcaagttcagtaagtactaaggccccgttctttttagctaatggaggtatggattattcgtgccatgccacgctttcaaaagtacgatttctccaaaaacattctgcatcaccgttgcttcaataactttttctaagctattgttacctttataatctatagtatttaattaatccatgtattaattaatgagcggataagctcatttggacaggccctaagaaggtctagcttgaatatcatatttcaccagtagatacaatgctatgaacaattaagccaatacttagcatatttgccagggcgttgcaacagctctcaaataaacattccataagtctagccatacataaataagagataataataaaccccatattcaaagaattgcatgcctaattcacattagatcaactggcagctgctaagtatagagaattgaatgtattaccaaatgtttttacaaataacacatctatgtttacatagatcggtccacaaaagatctggtgaagtgggggcgtagagcacaccaactccttttgataagtagttaaaaaacaagatgaaaaagaaaggtagctcatgtacccttttggagcggccttttcccatcttcaggagactcagcagtgtcagaggattctgatgttgatgaacttccctgggcactagcaactctctagaagcataagtgatcaaggcataagccacgtgccagaaatagaagcaaacaaatacagggggaaacaaggatgattataatttgcactaaaagatgtttgcaataaaaagatgggaacaattcggcttgaataaagttattaacaataatgccacttatgtatttgcagggatttttttctctttgtctaaaaggtctttctctcattcattaaacaaatgtattgatacaaagtagtggtataaacatatatcagaacaaagcttttctaagaattttaaaaggtcagacttcaatatggttctgcagcttaacagaaacaaacacctttgcaaattcctcaagagtgcatggaacaagcttcttgaggtcttccacggatttaatagcatcatcatcatcgctttcacctgatttttcttcatcatcatcgccttcatcttccacctctgacacagacccttcatcttcagattctgcatgatcatcttcttcctcactctctgaacaatcttcaccaaaatcctataaaatgatgcattaggtttgctcataaaaaggattatctaatacttagtacaacataatgaggggaaatcttacatatggagctagaacactgctgtccaaaaccaacagtggcacgcgtagctcatgggcaagtgcttttaccaatctctcccggtagagctcagttcctgcattatagaaacaaaaataacagcattccaacatccgattaataagacacacatattaacgaaaaattcaacctcatttgcacacagcacctgacaagctctggagcaatatcctcccaccagaggactgcagccgagaaccatactccagagcgacatctttgtggcgcaggtgtgccgccacacaatcactcagcagctgccttgcgtcctcacttgcaaccaaagagagagcacacaatctaagttagtctggttcaacgagcaaaacatttacagattagagtgttcgggccagttcgtcgtcaagcttactcgacgtagtacgggaagctgcgccaggagagggtggccttctcccatggcacgacgcggcgcaggaactggtcgcggaagcgctcccgcttggtgaggaatggagactcccgcctcctgcagccggtgacgaaccgctcgccgctcagccattccttctggtccctctccccgagccgcgcgtgctcctgctcgctgctgctgctactactaccgcctccgccgctccccacagccgcctccacgctgccgacgccgcccttggagcagtagaaccgggacgacggccgccgccgcccgtcgccgaaaggcaggggaggcggcctccgcgccaccgcgctcccgccaggctctccgagccccacgacaagcgcgcctccggtctcatgcgtgcgcaggagctgcgggcgcaggaggccgcgcagccgcatcgcgcgatgcatcgctggaagccgcgtcgtcgtcgggcgaggcgaggaggaggagggatccgcgagcgcgctaggcctccctctggcgcatgcggcggtggcaacaggtggacggtggatgggcgccgcgagcgccggcggcgcgacggcggggagaggtgtcagggtggcggcggctgcgacgcctcgggaggaggagtacggcggcggctgcacggctcgccgatttgggtgggtgggttagcttcgcttcggattgggccgtgtcatctctgggctttggagttttctttagattcgaccagaactatcgagttggaccaaccctatctacagagttgtaagaacgggccgagtttaccgtattgggccagaaaatttcattcctatcgaggttaagggcctgagctggagctcagccaaaccgtttcagctccactaaaaatggagcggagctggatggagctctctcactagagaggtggagctgggtttattagctccataactccacttcagacccaactcctgaaaataaatttaggagtttgagctctaccaaacaggccctaactctttgggctgggccacgtcaagatctgagcaatttgctggctctgccactacaacttgtcactattagtcctgaattgaactgctgattcagtgttgtattagaagaaattcttctcctctcctcttaaggcctttataatgtggcaagctgtcatttagctcgatctcttcacgtcacagattcggtatgaatctttgccacgttcatggatgggctcaccaaattgaagcccgcgtgatcttcgttggtcacccgttcttggcgtgaggagagaagactacaaacgcgctgcgaaagacgtggctccgttttgtttttcctacatggactatagaccttgtggtcttcctgggtcttactccctccgtccaaaaaaaaatcaacataggcatggatcgaacgctcatgtccagattcattgtcctaggatccatgtctaggttggtcttttttaggacggagggagtaagccttagtggcgtcttgggccaagcctatgcatgacctacattgtaaaggctcttagggcatgtttggtttccggccaaacattgccacgcctaacttaaggctcgccacgggtattttggtaggtgtttggttgacaactaaagctaggctagccacagctcataagccctcccgccacacttttttcccccgaaagtttggcggacattttcaccgccacactgatttgtggcgcgccactgccgcaaaaaactccccaacaaccacgataaattcaccgtccctcaactactctcagatatatcaccacccccatctctcctcatctcccatccatggctgctctctacctcgtttccatggcagatcctctcccgcggccatgctcgttgatcttgtgattagctaccttctcctgtaggttgtgcgttctttccttcttcctctcctagatccattacatctattaaatctcttaattttttcatgtgtagatctgattaaagggacacaagaacttctgtgtttgaggagcagctgcgtcttcatcaagttctttgtgtgcagcaacgcgtctgtgcgggtcgaaaggagctgccgtttgtgtgcggcgacgacgcttccgcgcagccggaaaggaaggtaatattctctcttttccactgacatcgatctgatggatttcgtgttgatttctgaagtctttagctgtgccttttttttttgcctgattagcactaaggcacatgtgcatccttgtataattgatggtgattgaataatcgtgtggcactagaatgtggaccggatctgaactaatatatactagttcttcactattagttttatgcatatgtatgcagtaatagatagatttcattcttgactaatatatgataaacagtgagcttaatagatagatatccatatcatgttgttgctttcaagatattcaaagtgtgcttacagtatattaactatcagttttttttctcttactgatactgataaccagtaacagtgtgcttacagtatttgcagtgaccttaatagatagatatcaactatcagtttttttctcttactgattccatactttttctgaaaatatgttttagatgggtcaaagaaaattgtatttacagtattacttggactactgccattatatatggaggagaagattgattgctggaattctggtgtgcctaaccatgtattggtataggattaatagaagaaaaaggaaaagagccattacatatgctcccatgcttgatagagatgttgaaagattaagacgtctagaccgtttataccatggaaccgaagcacattgcataagtgagcttcgtatgaggaaagttgtcttccataagttgtgtgctgagcttagatcacgtgccctgctagaggagacttttcatgtcacaatagaggaacaagtcgctatgtttattcacgttgtgggtcacaattggtcaaatagaccaattgcatttgaattcatgagatcgggtgagactgttagtaggtatttcaatcttgttttagatgccctctgtatccttgcccgtgaccttgtatgcatcaaatccattgacacacatcaaaagataacaagctctcatggcagatttcacccctactttcaggtacatcaaaattgataatccctgtttaagtataccctaagagtctagggccatattcacctatatttgttctaaacaaaattgtctattttcgtagggatgcataggagccctggatggtacacatattccagcatgtgtacctatgcatatgcaagaccggtttaggggtagaaagaaatttcaatcacaaaatgtgctagcagcagttgattttgacttaaggttcttatatgttcttgctggatgggaaggttctgcccatgattcttatgtgcttcaagatgctctatcacgtactaatggccttaaaataccagaaggtaggattattcacatcatatcctaatagctccatatctgaaacttcaattctgttcttagctaattaatatgcacaaaaaatatgtaggtaaatatttcctagctgatgccggatatgcagctagacctggtgtattacccccataccgaggtacccgatatcacctaaaagaatataagggcgctagagaaccagagaacccaaaggagttattcaaccttcggcattcctctcttagaacaactattgagcgagcatttggtgccttgaagaaccgcttcagaatatttaaatgccaaccattttttcctttgaaaacacaagtgaaaattgtgatggcttgttgtgcacttcataactggattatagaggacggtcctgatgtctatgtgtatgacgatgctgcttggtatgcagcgctgccacggagtgtaagaaaccgtactgatatgcaccaggagaatttgtcatgggcaaagaaaagagatgatacggctaaaaagatgtgggaagataaagtaggacaaactgtaccttagatttaagttgttctctaaattatgtaactaatgtattgagctgtctcttgtgaatgaaaacagaatggctaaaggaaaggcgaaggctgatgcttttccaacctctcatgagaggtccttgacttggcatgaggatcaaacaaaattcatgctagagtggtacatggaatacttgaaaaaacaacatgcaggttttaaggtaaaaaagagtcaccacatgttgtgtgctgatgctttaaacaagaagtttggtatgggggtgactgccgatcaagtggatcgtcactacaggtatcacaaagaaaattggaagtatattgcagcagcattgagcaagagtggcaacgcatttgaccatacaagattcttggtgactatttcagaatctgaaaaggcaacgctatgtgtaagttttctacaaaattgacatgtttgcatgttacattttagaatctgaactgcatatagcaatttaacatgtttgctctttatgcaggatagagcaagacgcctactctctaagcccatcagattctttaatgagatgcaggagctattcacgggatctagtgccgatggttctttggctatggatcaaaacacatgcatgaacgatagtgatggttcaaatagcgatgattcaagagatatgcttgacctcaactgctacacacaacctgaagagccaactggtgaggattctgacactttgccatctccaaccacgaatgcaactgttgacaactcttccagcggtagtcaaggtaaaaagaagcgtccaagaggcaacaaatcaccaactaaaagccacaaaaaagcaagagtcgctttgccgagtccaatgatgaaatcgctactacgatgaaatcacttcgagaaacacttgctaccacagctcctccaccaatgccacagcttactgatccacatgcaattctgtggcagaaactagaggcaatcccaatgacacctgatcaaagggttcttgttggtgagtatttgtctgacaaggagaataaaggtaagcgtggttggttgtgcaatgcgagtgatgctacactaaatgcttgggtgttcaagttcttatgtgagaaagatgggcttaacctgtgaagcatagcttgttaaagtagttttttggcgaactgtctgtgtgatgtgcacatgaacttctgtatggctgtgcactcattttggctttgtgttataaggaatgatggctagaatatatgtattagttgttggttgtctaattttagcagtgtggtcatgacaaatggctagaaaatgtcattgaaatagttttagttggatggttgctgatattattgtaatagctcaactagtgttactggagtgttatctttagctggactaatatttcaatatatgtgcactttaattccaatctacttatatacattttgctgctgaaatgtgattgctttgtgaggagggtaatcttaccactgggtgtttttatcaagatgtggttgcaatccaaacatctaccacaaatttttgccaaacatttgtggcatcaatccaaacagcacccaaaatatttttgccacaccttagttgcaaaccaaacagtctaatttagccacaaagtatggctagccaccattgtgacaaattcttaagcttaggcgtggcaatgtttggccgggaaccaaacagacccttagccacaaagtatggctagccaccattgtgacaaattcttaagcttaggcgtggcaatgtttggccgggaaccaaacagacccagtatgatggaagcaacatggggaatcacaatttgaccatgcgtactattccctttatcctagtaaaggatacgatatattctagtactatgaatcttaatagaacatatactagtattataaatctaaacacaatactatgatgtgtcgtatcacgtattagatttgttttttttatgagacgaagtatgatggaagcaattccagtcacccaagaactactaacgacagtatcatatatgcattttcatttgggcattcagggggaactgaccaaaccccaatggttaaattcctttgtctaccgaaatttcatttgtgctgccaagattgaatattcagaaagattgcgaggaaaagaatcaaaccataacggttggtttcccttttgcatagtgaaatttcatatgttctaccaagtgctaactgccaatggctaacccgttcgattaagtgtgagtatgcaaaacgagaaagataatagtgtatgactgattgcggtattacaaatttaaaaaatgaatatatttgatattataaagcaatttatatatagaaagcctttgcacgaaatacgccgtttaacattttaaaaaacatgcaattaaaaatcgaggtaaaatctatatcttaataaaaaaagaatgagacaattcgtttagaagtaaaaaaaaaatccagatcgaagttttggtttcttttttttttcgttggagaagacaattcgcccagcataactgcgtcaggtcttaactgctatagataccagcttaagattgatgctttcaaaaccaaaaacaggccccaaacagggcaacagagcttaggaaacaaaaactatacatggatccgcttaccaacaattggtagaggattcggatgcttcccatggtactaactaataacatgccatgtaatactagatctgacgcgcgaggtaaggaagtttttcttcttacaaacacggtacaagcgcacacgctcacaacacacgcataccgacccctacaaacgcatatgtgcacaccctaccctataagccacctccagaaaactgagccggtatatcttgaagctgtcgaagtcaccactagtgcctcgttgtcgacgtcgacgagtatggcgcctaccgctgaaagaataattagtcgtaaatacgatcacccttattaagtccaggatttgaacctgggtgtattggtttcaccataaggatactaatctatcgagttacgctcacttcgcgggtgaaagggagaaaccatataagggtagaatggatatttaattgttaactttgcatgtgaagatgatgtggcatgttcacgctgtattttttttctcaagaactatgtaaatcaaacgataattattttgaacaatttaaaaatatcagtgactaaattgaccctagaacgttttgactcttcgcccaaactaaaataatagtatcgaaatcaaggtggcatatacacgaagtagtgaatggaaagagagagggggatgaggtaattaagtatttggttccacctatatagattatgcttggggtaaagagtagtttcttaattaggttgtggagtatatccatatggtggtattaaataggagtattaaatatccatatgtcttgtaaataaatgttacgtgcgccagctagatgtcaagaacatgcggtaaattaaagcaacgtaacgtggcaagttgagcagcctattgtcataagcttaactaagtcgatcatactccacattaaaagccatcagccagagcttgaaaattaatgtcagctcaacacactatattgccatgagcttaatcaagtcataggcattaacgcaagttaggccctgtttctttcagcttaggattattataatccagattattgggagtaaactgaaagaaacagacaatttattgaagtagcttattataatctggatccagcttattataatctgataagcttatttaggtaaactttttctagattattgggtgaaaaaatacccaccatgccatcccaccccctctttagacttgcaaacccaataatttaggctctaataatctagattataataatccaaagctgaaataaacagggctttagccagcttaacgcaagttactgacaattaatacgtatacttgcatgcatgtcctgttcacgttactacttgtaacaaagctttcctgctcacgttactacttgttacataagtgaaaaaaacgtttgagggcacatggaaactgtacatgtacttgtactgcgctaagttcaattaatatagacgtacataaaagagtatatatcaaaaagagccaggggaaactgaatttgcacgcatgcatgcacattcatatgatcgagatcagtagtctaccaaacaagcactataaataggggcctcttatgcacaatacaatcacaaaattaacaagctagctatcattcctccaagtgtcaagtacttacgaaacggtactatgaatatatgtctagttacattttgcacttcaatatatatgtgtagcttctgcccctctgcttgttttgcattacatgtatttgcttgttggagaagtagatagctatatcttaaacatttagatcttattcggttaatcccatatgcgtgaaattagaggggattaattccacacattattcctcttcttccctaattaaataaccttataggtggaattagccgaataagtcaatgattaatttttctagtcctctcttgtgagtggattgattaattactacttagaattggctcatatacgcagaatatgccggcattggtgaagatcgggcagtggggtggatatggagggtcagctcaggacatcactgtgacacccatcaaactcaccggcatgacaattcgtagcggaaatgcgatcgattccataagcttctcctacagtggcattgacggacaggagcatgtcgtgggcccatggggtggtaacggtggacacgctaccacggtacagtgcaaaattctcaatgctt

SEQ ID NO: 60785 - DNA, 25665 bp, Oryza sativa
  unsure (1)..(25665): unsure at all n locations
cgccgccgccgcctgcttcggccggagctgctggtacgccgcggcggcgggggagtcgtcggcgacgcgggagagccgcttgaggaggcgcttggccttcatggctgagctcgccggcggcgaggaggaggatgaagcgaaaggtgggttgtttggggaggcaaaggcgtgagctttgttgcggtttgcggtcggtacaacaagggtagggggggtgtgggcttatataaatgctgtgggggtttagtggttgctccactttagaagttggagggtaggagtattaatttatttctagttaattactgattccattttgcaatgtggagtaatattttatgccttgcatcctagtataataagtatttttttagttcatctcatttatcttaaaattaatttattatttttagcattggtgcatcggagtttataaaagaaagatataaatgtaatgagagtaaataagggaggaataattgtattgagatttgaaaaattgggtgggagggagtgttgcagtccttttcttattggtgcttgtgggatgggtgaaagtaaatttattttgtgacagatagggtgacatcttctctatatgtacaataaaatgttgctgataaaaaaaggtctatatacataagttccattgaatagcacaaagtataagtaagccttacacccaagattcttacgatgcgtgacaatttgaaattgtgcaacaacaatgcacgatagtttgaagttgtgcgtttagggatataatggttaagatcccaatggttgagactattgccgtttctaatatagatctaacattattcgtagtagatggcaacaaaccatgataaccatctattgtaggcatactatataattaattcgtatatattcggactgctctcatgctttatgtcaaaccattcatattcatatttatttatttatactcactcgtgcaaaacacacaataatatggtaatttataggatcatttaatactactacataacactactcctacccattagtacacgtgaatttgctagcgggtgtttccttctcacggcacgatgcatgcgcgtcttctgtataactatgtacaaaatagaaaacatttcggcattgtgcattgaaagatataatagttaagagtccaactttgttgtttctaatatataggtctgacattattcacgaagagggaaaaactacgataacggtctatttgcatacataatgctacttctacacatcagtacacatgaattttccaccggataatcctttaagtgcacgtgtgttacacatgaatttttttaccggataattatatgagcgcgcgtcggtgtgtcacacactcatgaccatctgatgcatgcacgtcgtctatataaccgcggagggaaagaagaagaagaagaagaagaagaagaagaagaagaagaagaagaagtacctaatttcaccggcacaacaaaatggttggcaccacgtaggtgtgaggctagcagataagggcaggggcgagagggtagggtacaagctggtaccgaatagtgtacccggcaggtacagggcgacacaaagccggtggcgacccggaccccccatcccatcgcgtcgtgaccacaccacaccacacgccttttactaaacccggtcgccttggccggcgcggcgcggcgcccgagcccgaccggttggtgtggtgtctggtccggtcgatgcgagcgtgagccgccctggtttgccgtgccgattccgtagtccggctcgtacggtacggctggggggcgggccagcgaaccgaccgatggcgaccgggacagcggggacgcgggggacgagctggctcgtgacagcgacacccgctgcaactgcgggggatgggcgggccccacctcggaattccgtaccgatggaaatgctgctacagtgctgctactaagggggtgtttagatggtactaaaactttttagcccatgtcacatcggatgtttggacgctaatttagagtattaaacatagactaataaaaaaattaatttcataaatgagagctaatccgcgagacgatttttttaagcctaattaatccataattatcaaaagtttactgtagcatcacattgtcaaaatcatggcgtaattagactcaaaagattcgtctcgcgaattagtcaaagcttatggaatgggttttgtaattagtatatgtttaatactccaaattagtgtcaaacatccgatgtgacagggacttggaataagtccctggaaaccaaacagcccctaaatcaattttccttttcctttgtttgtttattactcctacgtcctagaactccctgtatgacaccgttaactttttcgaacaatgtttgaccattcgttttattcaaattttctgtgcaaatataaaaatatttatgtcatacttaaaaaatatttgatgataaatcaagccacaataaaataaatgataattacataattttttttaataagacgaatggtcaaacgttgattaaaaagtcaacggcgtaatacattaaaatatggagagagtattacttttcaaaaagaatatttttgggcaattgcaaatttgccactactttgaatcgttattgcaatattgtcactaaaattataaaaatgccactagaactgtcatccgagtggtatcctaataatattaaaaaaactgatggcaaatttgtaaatgcctcgaatattttttttgttggtgtgatgggctgaactggcgattttttttcgtctctcatctggacttctcgttattctgcttgattttctatacgttacgtgtgtgtagtatgaagtcctggatgttgtaaaattttttgtggttcatagggaattgattttatgaagctgtgagaaaccgagtaatatcacatatcctatatttttttttctagagttaaatacgctggtggtaccacaaccgagaaaaaaccagataatatacgtgtagctattacttctcgatcaccatctccatataaataattgatggatagttatattgctcgatcgatgcccaaacatatactcgctccgtctcataatataagggattttgggtggatatgacacatcccattacattgaatttggatagacggtccgtccatattcactgtactaggatgtgtcacatttacctaaaatcctttatattatgggaagaggtgaatagtggattggtggtccttccacgtatgtatgaattagtaggagacattgaaagtttattaatactaatagctacttgtcctagctagcaagtcacatatatctacttgtacctgcacgtacaatagtgtacgtgtacgttgccctgagcctgaagatcttttggctcgagttctggctgtcttcttttctaagcgataaaccaggaaaaagtatatgcacggtcatgactggaggattaattgaagtaggagtgtttgtcacatattcacatatactccttttaattatgccatcattaaattggtgtggctgaaattatttcagcgtccgggggacaacctgcgcaattaagcagtgtctaaatcgtattgtcgatcatcgatcgtggtcacgagggatatgtatatatatttgtgctaaagagccatcactgatagattatggatggtgggagaactagagcttatcatgcatagttatttaggcacaaatgaattaaataactattataacaaatgttgatgaagaaatattttataacaaattgtatcgtttagtagcttagaaaacatgctcacaataattttgctaccataatagtaggaattaaagaacgggccctaatatgcacgagcttgcctgaacctcccacacatgcatgtagaagtttttagatagtcggtacatctagcatttgtttcagtatatcaagttgcaaccaatctcacccccacgttcatatgcggccaattggttcaccataacacatacaaaagacagagtgaacgtagcccaacatattaggtttctagggatggaacctgcacatccaagttcaacattaaccacttagtatgagtgctctcaattacggctaattatttttagtgattacactggtggagaaaccctttgtagtcccggttcgtaacccccctttagtcccggtttccaaaccgggagtaccaatccgggactaaagatcgctatctttagtcccgggtgaaataaccgggactaaagatagagctgaccttttttttttgcatgcccctgttgctgcatggtttacatatatatatatatatatatatatatatatatatatacatatatatatatatatatacatatatatatacatatatatacatatatatacatatatatatatacatatatatacatatatatatacatatatatacatatatatatacatatatatgtatacatacatatatatatatatatgtacatatatatatgtatacatacatatatatgtatacatacatatatatatatatatatatatatatatatatatatatacatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctatgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgatggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtttgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggtgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcatacatgtatttcacttccgccttttcgattggtgcgactcctagcaattgatccgtagttagaccggtgtcagtaataaattgttctatcgtcatttctttaccggtcaccaacggctcgatctcctggtttggttgccctccaagttgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgtaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttaccttcattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgtgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggttggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcctagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctatgtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatacatacatatatacatatatatacatatatatatacatatatatatatatacatatatatatatatatatatatatatatatatatatatatatatatatatatatatatattgcatttcacgttaacgttcgtcctctttcgttcgctcgttcaagttccctagctcgttcacgttcgttcgctcgttctcattcacgttcgttcgtttgttctcattcacgttcgttccctcgttcttgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcattggggcggcggttggcgcggcggcgtggcgacggcggcggcggcgtggcgttgtggggccgtggcggcggtggcgtggcgtggcgtggcggcggcggcgtggctggcggcggcggcattgcgcgcgcggcggcgaaggcggcggcggcgtggcgacggcggcggcggcgtggcgttggcatgcggcggcggcgttgcgcggcgtcgaaggcggcggcgtggcgtgtcgtcgtcgtggcgcggcgtctcgtggcgggcggcgcgacggagagagatcgagatcggagagatcgagctgcatgaagggagatctggcggcggcggctctcaccccagagatgcagcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattcatatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacaaatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgaagtatccaacctgttaaggtcaacagttgtcatcccactgtcatcaatcattacgcctccaccagttcacctaacccattgggcccgggacaaaagaacctttgagaggcccatagtcaagttcccatatgtcctcgatggcaccgtaaacgtggaagttgttccatcgtgtcccatggcatcgacacgaacagcgctgttttggttcgtgctcttcatgtcttgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagttaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagatattgcaccacttcattctgaagggcttctaatctatccggatcgatgaccttctgcgaaattgcgttcatgaatgcacatagctttgttattgttgcccggacattgtctggaaggatactccttattacaactggtagcagttgtgtcatcaacacgtgacagtcatgagactttaggtttgtgaacttcttctgcttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgtaagtgcaggccaatcgttgatggttacgaacagcagcgctcgtaggttaaactcctcctgtttgtcctcgtcccacacggggacacaatcattcttccacaactgtttaagatcttcgaccagtggtcttaggtacacgtcgatgtcgttaccaggttgctttgggccttgaataataatcggcatcattatgtacttcctcttcatgcatagccaggggggaggttgtacatacacatcgtaacgggccaagggctatggccgctgctcatttctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacctctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttaacaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaattgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcctggttggtgctaccaaccgggactaaagatcccgggggggcctgacaggtcctgacagcattcgaaccgggactaaagatagtcccggttggtaacacaaaccgggactaaagatcaaatatgcccgttaccttttgaaccgggactaaagatcatctttagccccggtttttattgcatccgggactattgtggaaatcggccgaccgacgaaagatggtttctccaccagtgttagcaatatactcgtcgacagtaagttgtccgtgatgattttatcaatcccaaaagatgtcggttcagtcattaggttatcataccgcttgtgtttgtagtattgtgtgtttataacaaaaaggatgcatgcaaaaggctagtccaggtcaagaaagactgatatatagaaaatgaggcagcttgatgtatatatgcgtgcatgccacacacacacacatatatatataggcaacaagtctaaatttaagtatttttccgagtcaaagtagactagctacgcgggtagaaaacgactcctgcagccaagattagtatatatagtagtatgtatagaagtacgtagaattggttcttcgtcgtagatgaatgcagcagcatacacagcttcctggaaacaacaatctttaaacggcgatcgaagtcaccaccggcaacggctgttttaccaccgtcgtcgcacgctagctagcttagctgcgtgccggccggtcaccgttgttggctttaatttctgatcggttggtttagtttgtgagtggatggtcggtgggacccatcgaccggcaatctaggatctattcggaagagcttctgacaactatactttatcttagaactagaaattcccctaaacaatacatttttttcacatttaaaaagttatatacaagctgataaaaaccctattttttcggattttgatcagaaactaactaacagctactcccttcatccctaaatataagggattatgggtatgtgatatattccaagactatggatctgacatttgtccatcctaagatatctgtccagatttatagtcttaggatatgtcacaatcacctataatctcttatattttggtagggaggcgggagtatttctcaaagtcttaaattccctaaaacaagtctctaatgacagtgtgcagtgtgggtgggtcccatgtcgatcggtcggccatgtgcctgcctgcctgcctagctaaaattaagagccgtactcccgcgttactgaacagtacacacgcacgcgcgtggacacgagattatatttgagatggagtatatatatctagctagctatagtttgcatgtatgaatgtatgggccatatgcgatgcaatgaaatgcaacttggtagagagggtagcgatcgaatatccaccaccgtcacggcgcattaatttgcttaagttggctgttcggcccgtgcatatgggtgtactcgttttcgatcgatctctcaaattttaagatgtttctagtggaactatgatctattgcctcttacatctcgctcttttgtgcatgccgaatggctaaaaaatttagttggttcggaacagatgattagcttagatttttgaaagcatgtaaaataagatatccctccgtcgcaaaatatagcaacctttactggataggacacatcctagtacaataaatctagacatactcatgtctagattctttgcacttgtcccatccagtataagattgctatattttaggacatagagagtaagttatttctatatggtaattagtcgagtattaattataataaatttagaaaaatatatttattaacttatatgtaaaaaacttttgcacgaaatgtatcacttaacagtttgggaaatgtattcatcaagaaattgtgatgtagtcgcttcaagtagctatttaaaacttacccttagttattagtgatcatcattcgagtgtgcaagcgaacaaatcgtataaaattataaacatgatttaagaaagtcttctcataaatacaatcatacaatgcgtttgcaagaatgacaccatttgaaaatccgtgaagctatagttatactatgtgtgtaggattttttttatataaaaaaacaactttttataggcaaattgctcataaagatcacagtacatactttgctttctcagccacatatcgatgctttgtgacaacaagatcaaaagggctaaaagataacaagataattggattcctacggcacgcaatgaagtacagtactacgcatcttggagatcgacttggagcgcaccatgcattgcatacacacacacacgctattgttcatcgatccatgaacagcaacctacaacaagtagcaaagcaaaagggcaccaacccaaaatggggcacacacatgcattaattgtcacgatgacctgtcacgtactgtcatgtggggcccacacactgctctgctagtacgtactagtacctacctgtcctcccacgtacgcgtgtacggcgatgacgtcagcggcccactgtcgttggagtccacgtggaccgtacacgcgtacgggtgctgtccggaatcacggtacggtgtacacgtattacgaccctatctcttctcactcttttgagagaaaattcaacgccgcatgcattacatgtgcttgctagcaataacaattactccctccgtttcaaaatatttgacgccgttaacttttttaaacatgtttgaccgttcgtcttattcaaaaattttaagtaattattaattattttcctatcatttgattcattattaaatacattcttatgtaggcatataattttacatatttcacaaaagtttttgaataagacaaacggtcaaacatgtggtaataagtcaacggtgttaaacattttgaaacggatgaagtattaagagtcaattactttgaccaatgtaattttctctccgttcttgcattagtcttagtcatgccggcctggttaaatatatcaccactcgtacatgtgtaagctcctcgagttgtgtcaatcgcacgaagcttcgtaataggttttgttttggtttgaagatagaactgtcgtatgatgctttctgaatttattcctgatcgatgacctacttatacgtactaaacgtgtgttaaaaggctgaacttaggttgcgttgttgtcctgagttgggaaccttctcctccggaaaaaaacaaaacaaatcattagcgcatgattaatcaagtatcaactaaaactaacttaaaaaatatattactatgattttttaaagcaacttttataaatattttttttaaaaaaatacacacgtttagccgtttaaaaagcgacgtacgcgtaaaagatgaggggtataagttggtaaagctaattaccaaacgagcaaccttaaaagtgtgcgggtatgcatgtgcacgtgcatgtaattgaaaaagaatagtatggaaatatactttgtgaaatataaaagtgtcctgtatatataattaaccacgcacgagtcaaacttgtgaattgtagacctatttgggatttaaaatttaacggtagttgttactactgctccactttggtgcatgcctggatcgcatatcatatctcatgctctccaatctttatcatatcttcccatgctttccttttttctttcttgatgaaaagaaaaagaaaagtgaaaaaaaaagatgatactactggattgttaggaccgtttggctcatctttccgtaccactagctactaccataccgtacctacgcgtacgaatactgcacggtggtcaagttgcagcatactataatatggtactattgcatgccacgaaagcgacccgtcggccacacgcaagaaagcacgacttttgatctcgatacatcaaaccatatatgcatatctttcggttgtcaccaagaacaacataactttaatttgacgacagctatatataaaaggaaaaaaaataattaatcttccttttagaatatgattatccttgagaaggtcgggacgggagagagtattttctaatataaaatttgatagtaccaggcacgaggtattttaaagtatcaaaatctttaattagtatataattttagtataagtatgttttcaaacactgtaaatttctttttaagataatggaatgaattatgatatttgcttcaaacaagcttcaatcgcttgttacaacggacgttctctcaacaaagataaactaaacaatttcaacaaattaatggagggcaaaagctaagactaatatatctaaaaaatatatttatctaagtatattataaatcttcatctgaaatgggtaaatatatgtataactatatatggactccaaattttagcatgcaacatgtaatagttccttgtaaattaattaacgtctaggatcaggagcaagaataggactagacgatcaattaattagctcggatgcatcatgcgtgagatatttcaaacacgggtgttattttaatggcgtactatgatcagttcgctgtttgtttttcaaaagctatctgctgaaaggcacgttgtgcttttctcctactcacatcccgatctttttgactcggagtctactagaatggactatgtcttgcgattaaattaactcacgaataaactaactgctaatctagacatcggaccttaattaaaaaggtgttgttagttatggtacggtcccgcttaattaaacgacgagtatgcatattttactgcaaacttcgatcaactagctgcttctagcgtgatatataccttaattttatgccgccttaactagttaactgtaattgtcttgtcaaattagcatattcttatgagatggtttagtttctagatactaaaaattatccataaatttcaataacttttggacagtccaaattatgttaagatctttgcttacactacagtaaccatcgttctcttctccctcaccgacatgtattccaaaatacatattccaaactatcaatattgttgggctaggtggcagctagctcaacgtattccaagtctttgatagctagcgccatatatctaagatgctctcaccttcaactaggggtggacaaaaagctcgggctcgtgagctcggctcgggcttggctcgagctcgtgaagctcggctcggctcgaagattaaacgagccgagcccgagctctctccacagctcgtttgcaaatcgagccgagcccgagctagctcgcaagccgcacagtaggctcgtcaagcctgtggaaaacatgagtacatgtcctgacctggcccattaacaagttgtttcagtctagcccatgagaaacagagaaccctaccctaccctaaccgctcgctgaccctccccattccccatcccacgcaggcgcaggcacgccgccgctcgcgcgcacgaatagcgtctggcggcgattggcgagaggagttgccgggccgccgcctccggctccctcccctgcgccgccggcccgccgtctccctccccagtccctagtcgcccctcggtgccgccggcccaccgcatccctcctctgtgcggctgcgccggctccggcctccctcccaagcgacacttgacgatcaacggctcgacgcttcgtgccgccgcggcaccgcctccctcccctacgttgcctctggcctccctccccagtgccgctcgagctcgacgtcccctgcgtcgccggccctacttgttgcttacatcgcaagccggctcgagccggctcaagcttttatacaagccaagccgagctgcactttttgctcgttccatttatcaagccgagccaagctaagcctgttcttgatcaagctttcacgagccgagccgagcttagctcggtttggctcgtttccacccctaccttcaaccactccgatttcccatactcacaatccagatccacccttatagcaatcccctaatctaattaaatggcaatcaagcatgcctgcatgtatactaagtgtcccttctatcttagccatataaacatatcgatattaaaagttgcttagggctgttcagattgatgttattttcaagcatactgttttttttacaaaattatataaaaaaacaagtgtctaaatttattttttttgttaaacttagataaatacataagaaatcatgctaaaattttgacaatattgacaacttgccaaattttcggtgttgccaaaatttcgtaaggtttattttggttacgacctgaatagccccttagtaaatttatagacctcaccaaattaacctctacatttgcgatattgagatgaactgacagccatgcacatacgaaacctatcaaccgcggaactgccaaatagtttttcgtaggtgaagtatttctggtgtttataacgacgctaattaaaattatggatgattcagtaaattgaaggcatcgatttgcgtggcgttgtatctcgatgccacaatattttacacggtgtttgtaccgtacgtgtgaagagctagctagcacgcgagaataatggtcgtcaaaagcttcgctttctacggtgccgtcctcttgttaatttcccctccagagtcttctagaagatctcctcgatcaatcgatcgattctttaatttctacacctgctaggtaggagtagctagcagctgcctttttttttaatttcttttttttctgaaaccaaatttatttttcctttctgctgacaacgatagcagagggcgattttttttggtcgtcaaatcgaattaattgtggttgggttaatttttaccagcgcgtataaatatacatcatctatacgtgtcttgccgtctctgtgccgtacgtaggtaatcgccgtgtttagttttcaaaatatttcttcaaactttcaacttttccatcatatcaaaactttcctatacacatatacttccaatttttttatcacatcgttttaatttcaaccaatctttcaattttagcgtgaactaaacatagtctatatgtacgtattctgtggcgtcgacgtcgagtgaaagcgtaggcggccatcgtcttctacaaaccgtgtagaatttaccttccgtcgacatctgctcgatcctttttccactgatgatggagacaccggctagctctcacagtctcactcttggtccattcacctgtgactgtgaagggacatgtaccgactgggctggaaaaattaatctagtgatgatggataactgtattttctcctttaatacatgctgcaaatgttgctataacattgttccaaattggagagatttctgcaagaaaggtattggcatcacaattcacacaagatctatcatagctagtcgaactgtaatggtcttatgctagtatgagtagaggacgtactcatggaatgtgagtgtacgtatcttccatataatcgaagagttttttttcttttttacggttttgctatttcacttttgacagattttggacttctatctttcgttttttttatccgtatatgatattgcatcaagatttatatttctataaatctaacttgcagttacactcagttacagagcacttgcactcacttacgatgtatatcaaaattagattttacaacaatattttttctctagattgacgatttttgatatatttgtctttttttttgttttatttcattcacaaagatatgcatctattagttaaaaatcctgtaagatttgaagctctccatcgaaagatttgataaaatagtcccaaaaaaatagggggctcctagctaacgcgtgctcgctgctagcgagcactcctcccctattaactacctctattaacactattagttaatatacttaattacctctattagttaatatacttaacactaatgatagtaattagaaaagattcgggagatttttttactaacagattaaaaaaattttatgttagatttgaaaattttcgatttaaattttaaaatttaaagttaaattttgaaaactttcaactcagaaatgaaaactttcaactcaagattcgaaaactttcaagtccagatttgaaaattttgaaaactttcaatttaagatttgaaaactttcaactcaagattctaaaactttcaagtccagatttgaaaattttgaaaactttcaaatcaagatttgaaaactttcaactcgagattcgaaaactttcaagtccagatttgaaaattttgaaaactttcaaatcgagatttgaaaactttcaactcgagatttaaaaactttctagtccagatttgaaaattttcaactcaaaatttaaaactttaaactcaaaacatgctaaagattaaaaaaataatcagaaaaaaaggaaaatgcgaaaaaaaatgggtaaagaaaaacaaaaaaaaagagtgggaggcgtgcgcgcgccggcgctgggccttatgggccggaaacgcgcgccgattagcaatcgcgcaaaaaataggaccgaggaaataataaatcgatctcgtattcgtttgggcgttaggagcattgggccacggcccacatagcccaacagagaagctcactgggcctctaacttccctctccaacgtcctcgccctctctcgntaagacgctaacgaccaaagcgtccgcgagtcgcgacagctcaaagccgcacgcaacgccaccactgctccgccgccgccgccacgcgccgccgcgattcctccccccgccgatcgaacgccacgcgcgcccgccgcggaaaccctagcctcctccttcgctcgcccgagcgccgtcggcgggaggaggattacttttggtcctgcgcgcgaatcgcggatcgcgattcgcgctagggtttcggccccgtgtgccccgacggccgcctggtccccgctacgccggcgacctcacgcggaatcgagaggtaaagtggtagtaggagaggaggatgagggtgcgacgggtcaggatacctcgtgttcgtcttcgatttgtgttttgcggaggtgtcgtgggaatcgccctagtggattaacttctggcgatttaaaattttgccgatttcttgggggtaacctagagattctggatggtgtcatgatagtttgactttgtgctgctgctgcctgtgtgtatgtgaattctaagccatggcatatcgtaatttactaccttagaattcggaggcttattgagattttaatcatgatctaatgaatcaagtatagtttttgtttagggtgcctgtgcagttgctgcaacagcatttgactttacaacattgtgccaagtccagtggctccacctctgacacttccatgtccactatcaaatctacaattttatatgcaaaatcatataccaaatagtccaatttctatcgtccccttcattctccaccgtcccatctacgtacaaaatcgtaaaccaagtggctataatatggaatcttgtaacttgtgaagttggtttattacttggaattgctaatcacatggtggagggatttctaagaaggggaacagacacttgctataaaaaaaagtgaaacttgaaaagtggaatttgatattgagatgattagcaatcaaaggaacgtcctcttgattagttgattgaatgtgcagtagaagggtgccagtatggtggttttcgtgttggcatttgcttaaccttgtgatatcatgcatctcttacaggacagtagaaaaatctacacccaaaattctgaagatctccaagaactttgcagtctaacatcagtgccgaatatcagaaatggatcatgggcgttatgctccacagcatggatgggagaacaacagtgtaattgaagcctttccctttattagctaacaaggaatagcagatttgctggccatgtggttggccagcattgtgatgtaaagaatttgaagaagcggccattgcttaaatggaatgggttacatgcctgttctgtagacttacttgctgactcaacttctgttgaatctacaggcattggatgggtatggtgtcatcaatggcccagattataggtaagtcaataagctattgtgatggtatgttagattgttagcggttgtagtcatgcacatcttccattctattcgacttacttttgaagtgtgctcagctataatttattgggagtagttgcaatatttttttccattatgacatgttgtccactttaatgtgctctgtcatattaccatattttctacaattgactcaaattgcagggccggtggatcctacaatggtaggaggtttgtggatgatggcttcccaggagattcatatggaaggggggcattctatcaggacacacatgatagaaatgtgtatccacctgcaccctctgtccccatgttgtctcaacctcgaaggtttcatgatgatgaatattcaactgctagagat

SEQ ID NO: 60786 - DNA, 7420 bp, Oryza sativa
gggatgacgggtgggccccacccgtcatcgagggtggcgggcgggcccgcccgtcagtggcgcgcgcgcgggaaaagcccgagtgggccgcggggaagaggagagagggggagggaaatgggccgagccggcccaagagggggagggggggattttaaggtttttctttttataaaatcattttaactttgtatatttcttaataattattatttgtgctctgaaaattccactaaaatttatttacacattttaggcttttaggaaatatacaaaaatcctctaagccttatttgacttttaactttgcagattttaatttttggaggctttcacacggattttaattattctaagcataatttaaaggatgtattttagggtcgttttgggacgtgacaccattcgagagatacatgggaattctgaagtcctacgttcggaacagagcaaaaccagaggggagcatcattgaaggttacacgaccgaggaagccattgagttttgtatcgattacatggccgagactgatcctatcggagttcctatgtctcgccacgaaggaaggttggcaggtgtcggcacaactggtagaaaaagaattgttcccgatcaagcttcctacgcgcaggttcatttcgcagtgctgcaacatatggctgaagtaaccccatactttgagaagcatttagcgaaggtccgacaggacaatattggtcgatcagatatttggatcaacagagaacatggtgctcgcttcaacgaatggttcaaggatcgtgtagcacagtcgaccgatggcccaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcaggatcaagctggatcgagcacatactttggccgcatagagcagatatgggagctgaactatctgaacttcaaagtccctttgtttcgttgcagttgggtgaatatccgcacaggtgtcaaggtcgacaaggaaggcttcacattagtggacctggccaaggttggatatgcaaacgaaccatttgtactagcgaagcaggtcgaacagattttccacataaaagaccccgcaaacaagaagatacacgtcattagggatggcaagcaaagaattgtgggggtgaacaacgtcgtcgatgaagaagaatacaacaagaatcttcatgtcagacctcagatagaccttgacgatgatcccgaagacgaagtggcttacgttcgttcagaccattcggaaggcatatcactgtgaatgatcatctatgaaaataagtgcgttgttggatcggaaaatcagttggcataattgccaaggaatactcgcaacaaggattgttgtagacatgtcacaagggccttcagccgaacctgccgaaaccatcaaatcagcgagacgccaactgagtccacgaggttcctctcaagcgaagccaaaagacgaagtcaggagggttcgtcaccaagttcgaagggctcaccatcaagtttcccatccaggtgaagaagcaagaagggttcgccaccaagccgggagggctcatcgccaagtctccgctctgggtgaaggcctcagggtgaagcacaatgggttcgccccatggaagatgggtttcgctagggagaccagctagcagcatggcccatgaaggctgttcacctcttacgggccaggccaggggccaatcaaaggtcccatagttagaatggatactgtatgccccttttaatgtccctatccatataaattcccctgaacatattgaaccgtagagggtatgggcctgtagtaaggctataaatagcccaatagggccatgtaatgggggatcccctaaaaatttcataaattagcacgttgtttactattcaaatcattccaccaagagagccacgtcctttgacgtgaagttcttgtcattttgacaacaaggattagaatttactgttacaattaatagtttctttagttagggatctttgtagtgatttatgcaatagggagcaatgatattggtagaatcagatatttaccttacagtttgaaatcatcattaagtattgtttttgattgatcgtggaaactggcttgagtactgctcctgggactattatagtgctaagctaaataaagcccgtacaacgaagattggtacatgacttgtctctatcagtctgttgcatgaaatttaacgagcatgcttaggagttggagacgagggagaaatttaaatgatgagtgattggaggaaaaaataatactctagaattagacttacttttacaagttttgaatcctatgaaattacaattaatttattattatgagaaggatggagtaaataatggtccacggtacttgaacattgatagttcaaatattataggagcaaaatcaagagatagtaagtactataatgtgtgtttataggggtaaatttatgggcgctatcagcacatgcgtttgtaccgtgtattaaaaaaaatgatcagcataggtactcactggtgagtaagttgtaagccctcaaaaaagtgtgcaggggatgttccaccgccaaagcgtgttttcccgattcaatcattccatgtggttgttacgtgcatgcatagtgcgcaatagtgtttctgttgcttgtgtatttttttaagctctccaaacaactaaaaagagttttcatagagagcccaaataatgtgattaatgattgtcccattatgcagtctgaacatattagatgtacaccgaaatgcttgaaagaaaattatatttggtcgattaaaatctaaaaatcagttggcataattgccaatggatactctcaacaaggattactcaaacctctatgttgtaaggaggctacactaaatattttattattaattggtccaattagttgccaagccctttatgtatatgtaaggatattttgtgcattttttttaaaaaaatgtttcacgatcactataacatgcatggagtagaaacaattgacatactcatttgtaatttgtgtgtgtgcccgtatataagcatgcatacattcatggtacatcaatttggcacgtaggtgtagtttaatgcaagaattaatctgagtgtacgggtaaaacaatttgcatggcgggtacgaggttggtacaataacttaagaaataatgcaacaacattctttctatacacattcagtttttaagtaattattttgtcaatatacatggactaatttgtactaatatacttaaattttgcaattctagtaactaaagtcacttaaattttgggtttatagttgagagtgaaaaacaaattggtggtgcaaaaaggatgaggaacataattcttatatattaaattccagactgtaagctaatatccttcgaattgtgtaatgtcatatctaaagaagtggaagctgaaacatttcttgaaaaaagacgcgtccacgtcatcaataaaccttaaaacgtccggtatttttgtagatcgatgtgagccatcagattacctaaatggcgaaagatcataaatgtccgtcttgaaaattctattcatttgatattttactattttcccctccactcccccatccaccagtgttaaacggctcctcttctcctgccttagctgctctctccacaccgccacttttgcatcccctcgccgccaccgccgcctgcagccgccgcctctgactcctatccatcgcgccttggcagcaggctcctcgtctccctagccatactgcctccccatccaaaccgcaccgcgtcccccgtcggacccagacgcgcggagctcaagggcgctagactcggctaggctcacaacggttcaccgactcagcctactcgaccacaagctccgacgctgcctcctccccatctaaaccgcagctatctcatctcatcttacaccaacagcctctctcctcatcgccatcaatggcactgctgatccggacgatttctcatccaaatggttactatgcaagagggtttcttgaagagaccgaggaattagtgcatactaatcaccaacccgtgcgttgcatgggctattattattaatattataatattttagattctaattatagaaaattcattagatattttttaattatatcggtttaaacttaaagatatataaatcagatgtcaattacaacatggatagtataaactgaagaatcaaaagtattttcagtagtctgttattaactacaatagcctattgttaaatagggcattgttatttaatttttaatcgtacctatggtcatgataatacgatccaagtaagtactgaccagatttataattaatgttttagctcataacgagtgctctattagtttggtacactactacgaaaaccatctttcgtggcggtcattttgggtttccgctggcagaaatcgcagccgtcacaaagcaaaggccagtgaaaatgtcgatcttcgctagcagttatttaccgccagccaaaatgcatcttcgctggcggccgagaaaggaacgcccgccagcaaagagatctcttcgctggcggtagccttaggacggccgctagcgaagccaccgaagacatgtccttgctggtggcggacataacgcagccgccagcaaagaagtatctccgcttgcggtagccttaggtcggccaccagcgaagataattctttctttgataggaaacatattttcaaacaccaagtcaaagaagatagtagttcccatcccgggcaggcatgaattgaaataatagtttccatcccggataatagtgaatacatcctagcatttgccggcaaagccaagtaagcgtgatcagcgcttacccacaggaacatgaataaagatccaaattgcactcccatgactacacatgttccttgaataattgaaaactagaatcaaagaaccaaattgaaatcatattgcgcatccatggcaagcatggaacttgaattatttacccagaaccagaatccggaatattgaaacaagaataatgtcgtaaacataggataaacatgaaaacctaaatggcgtgaacaacaatatgaatataagcggtcacatgtcacatagaaatatatcggaaataaatagatagagcaaacaatccatgaatcacacaattagttcatcatacacttgcctccaaagaaaggttggtatcatgcacaatctgaaggaccactacctaatcacaaacaaaacctcagcaaacacattcaaacatgcatataaaacaatgaaaaaggtgaacctactgtcccatcccatcaaaacgcaataacaaagaacgccgtttggactataaacaagactgctgcttcaaaccttcatatcttaaaatatgaaaaggctatggccgcaaataaatacattttggaaatacgaaaatgctatgccattaaaatggtctaatttgcgctcgaaagaaggcttcacaatctgtccaaaatttcagactatccgcaccaaaacaatcaaaactggagttctactcgcccaatcagggtattcctgaccaatatggaaagctaagaaacacctctacaactttgtttataggcggcttgggtgattccactgtttaacccatccaaaaactattcaatctactactatccaaattatgacataaaaacaacagttatactaaaaaattcatatcgtctaaaccagttgagataaaaccgctctctttggtcagaagatagacataaatattatctacaacttcctaattatatacactttcacaaaaaatatcatttagtcctccgaaacttcgaaaaaccgaaacactgtaaatctgccaacgtgcagaacagccaattcgaaccacaacaacaaaactccttctctaaccttctttatccaggaattaaaccactaaaactaccatagaacaactgatacaacaaggggataagcctcacctagggttttccttctatatcccatgggaaacgacgaggaaactccgatctaacccctcctccttctcatctctcctcctcttcgttccgtttttccacattgcttcttgatccaagctatgaagatggagatctagggagggcaatttgttgtagaggggagatatgcgaacacatgaggaacaggaggaaggaggcgctggccagggagaggggtgggattcggtttcctaggttttaagggagaactaatgggcagggtttatgagccttctcatgttggcccacttataaagatatttttcttttatttatttctattaacatatttattttaacaagtcaacccaaactaaaaacctaaatatatttttttaatatacggggtattacaccttttcatgatgcctttgtgctatgtaagttttcctctcttcgggactcatcgcctttgtcggtgatatgggcatggggtctcaagaccagagggaggaggccaccccccaacaccacatggccctccctcgaggggagtctggcccgaggtggggtggcggccactccttcctagagactagatggaggaagctgccccccaatgccacgtggccctccctcgaggagagtcaggcccgaggtggggtggcggccactccttcccagagactagacggaggaagctgccccccccaatgccacgtggccctcccccgaggggggtcgggcccgaggtagggcgacagccactccctcatgtgactaggggtcgggttcccccgacgccctccgcgagtcgccacgtgcggtgggttaggtggccaccttcgagcgctcacctacccgcattaatggtgacctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaaca

SEQ ID NO: 60787 - DNA, 5883 bp, Oryza sativa
ccctgctccactctaagaattgaaattcgcaggcatcagcaactgaagacatgggacggcaaatattggcctttggtgaaaggtgtggtgttttgattattctactgtattgctggaccttaaagttttgcctgttgcttatatctctattctatccagcgccacatggttatactattactgacttaatagtaaatacaaaagtttaatatgcactctagattttatagaactcatgtttagtagggttcagatgaactatgccatttgacttgttcatggaattaggatagaaggttatataatataggctggcaataacgtagcttttatagcacaaattattgctctctttatcgtttagatcagtacaagataactgaaaaaaacaggtttttacacttgataaatctttctgttggcattctacagtatttgcagaaattatctaaattattgtagtgagttagaacacccacacccccttcattccgttccatattgtcttcaatgtactcatttctgttatctgatgtgtatgggcagttattttgtatgtgctgctatataagctaaaagttttttttacaaaataaataaataaaaatatatacatattcaaatgatgaagttccctccatccagtttttccaaattcagaccttgtaattttagcccacaatttgtcatgttatatgcatattattttatccgtaaatttatatatataagtttttgtgttttcataggataaaggaatatgtaggtcttgtattgtattggaaattaatattcaaattttaattttgatgaccataccaactcaagccaagcctcaaaaaattgtacagagggtgtatatacctcaaactcatagcatggtgtttattatcctgtgttccctggaatatttttaatcttcaatgcaggctaatttacgccgtaatttttgtttcataaaatttttcaggaaacctgttgagcaccttctcaaggctgttgatggtgttactctgaaagacattacagcccttgctgagaaaatcatatcatcaccattgacaatggcatctcatggaaacggttagctcatatttttcatatgtagccagtcatctttacatagtgtaacagttgcagtatcctaactctgccctttacgatgcagttctgaacgtgccaacttatgattcagtcagtggcaagtttcgctcgaaatgagtagtaatgtggtcattgttttcctcctcctggacaagttttaactgttgatagtttttcctcaggccattcattggcagggtttcagagagaaaaataaggagcttcatacaattttgatcatttaactctggatgattgagaataccatattttacctttttctgcaacatttgtccacttgagttggaattttttatgctgttttcatcagttttatgggcctgtaaattttagggccctctttcggtggcggccagggcctgtacaaaataccggtctccttgcaaaatctttgacacgaatgctgaaacacttgaataaatattctatctatactcttgcatgacagtgaaattctgcaggagatgcgtccaaagcgagggaactgctgtgagccatcgcttttccacaattccaatcacgttttgcatgctgtttggactgtcaattcccgtctgtttggttccatgattgaattcgaggaaatcgagctcatgagtcgaaggcaaagagcaaagagcagctagaggcagcaatgcaggctggtaaactcccaaatgccctccaaggtctatgaataaaattaattattcagtatcatctactgtgctgaaaatgcagcaggggatgggtctgtgtacgatggtgcatcgtctggatgagctctagaaccaacttcctgcgaaggaaaatggttgtagcagcagcagcagccgaaatttctgagaaggtgtcttggttggaaggaaacgacacccttggttgacttctgggccgtgtacgagcggtttggacatgagtggcccatgggattggaaagggagggtccaggtcgcgaggcgacaccacatcggcaaagacgacggcgacgcctcctgtttgagggagtcgccgtttctgactccgagctcccggcggctggaggggccagaattattgcagtcgaggagacgacggaatgcaatcgcagtgccaccgacccacccaccacccattgccgatttgccactcgttgttccgagtccgagtcgttgtttgttggctcgtggatgctcctctacctcgacgtctccgtccttggttaacctgctcaaacaccggaggcgccggcgtttctctctctctctcgctcgctaaccccatggttttctcccgttcggtcttcttccttttcggtcgagtcaagttatcacaaacctattcatagcttcctgataaccacgaaggcttatatatgtgggtttttttttggagagtgtatgcaagaaaattattttctaagacaacttgccaccgtttgtgtggttagtcctggaaggctggaataatgcattgacagcattgttaccaacctactttttgatgctccaaagagtgaaacaaggtaccaaccaattgacggcatgctagtgaccactccccacgtcccaaaacgtggttacctagaacatgaagtgatattacctagtactataaatttggataaggacattaggaatctgaataaggacatattgggtaatgccacttcatgttctactatgtattaatattttgggacgaaaggagtaatgactagcaaatgggaaacaagcaaagtttgtaggcttttcgtgttgttatctgaatcctctaatggacttgttgggttatactcttattagtgacgtcgctgaaatctgtatatggttaatatggagtggagtaatttacagtagcattcctccaaatcaaataagtcaaagaatgtcgtattcgcctttgcctcgattgatcctactacatcatcaaggcataataatgtcaactagctacaccaatgtccaatggaagttaacacttaactcgagaaacgaacaaagcaaagcaaatgcatattttacatttcaagaacgaatctgaaacaagtttttctttttgctatatttttttccctgtcgaggaacaagaagaatttggagttggcacctagatgcatccatccgtttaaataaaggattggcttgggtttattaggacccaaattaatcattggtttaccagatagccgtttcgtatttaagtggattaaactaacgcaacggcggcgtttattcacagccacgaacaacaatattcatttgaacactccaatcatataacactctcaaattaaagaaaaaaatacttgcatcactcgcgacagagccaattggacgaaaagaaagtctatacatcgcttcatcaaattagaataacatttttcaatgcatcataatgttgcttgatgacctccatggagggtgacattttggactattgaaattcagctttgtgtaactttcatccacttcatccgtcattggcagcatcatgttagtttatacatagataaaacctttaatcatcaccaatggaaggcgatcagggtgagacagagggaggtaggtcatgagctcatcatgcatgcggagataatacctgtgttagataaaacctcatgtatgcaaacatcactggttactaattggagcttacctgtctaaaaaaaaaactaattggagcttagcctgctgcctttcaacttgcatgttgttcttttgtttcttccacttgatataattttgatcttctccaataaaaacgggtaaattttttgtccgttaatttaatctggcaaaattgggaattgttgctagctttctataatctcaaacctgagattgttgcagggaccatgaaatgaaatatagttgaaaccaccattatctgcttaaccagcagttttcgtttatttctagtatgtgttttgcggcacagttgtacagttttttttttttttgtgaacatacagttgtacaggttgagctccaattggacaagctagctaggtagccaaagaattaatcgacaaacttgacttcgctaccaatcaatagtttattttgttctcttgtctttgtctgatgtagaaggagcatttaaatctgttcatttgtagtttgataccaccggtatgtgtcgttttcatgagcaaagcaaaccgaagaggaaggaaggaacggacgccaagttttcggagatgatgctctcattataattttgtttttctcctctgaagaaaaggagaagttcgagaagattttgtggtattcctatataataaatcacggaaagtattacatcactgacactgtttttagcatagagaacatgttgtttgatgtagcattctgcattccttcaaaaggaaaaagtattttttttaaaaaaaaaaaggtaacaagtgtacattttgagtataacatattctgttttcctatgtgaagctatatgaactcttttctactccatggaagcatagccttagcactcctttttttaatatatgatactgttgactttttgagatacgtttgaccattcgtcttatttaaaaaattgtataattatcatttattttattgtgacttgatttatcatcaaatgttatgtaagcatgatataaatatttttatatttacacaaaagttttaaataagacgaataaccaaacgttaataaaaaaaagtcaacgggtatcatacattaaagaaatgaaggaagcatttatttgtattgattggaaattgaagctaccatcttgaccttctgattggaaaatgaaggtcctgattacatgattctacacatgaaacatgcaagtggtatcagctacccaaagtcatcaacaagaaagacaacaagaataatgcatcccaaggaggagatgataagaggagatcgattcggatttgacaaaacagggaggggaaccttaatatgccctccattacaataatgacactttacacttctctcatctaaaagcaagtttataatactcatcacccatccctaacctctcataggtcacaaccaaacatctaatcaggatctcacaggtggatgcatacatgatatacgcacaataagcttataagcatctcccagggaataatgctcctgtcatcatccaaaaccactcgctggtagcctatctgcctctgatctataagcttatcagggaccatgtgagaggttatcaaggcatcagcaccctgattttgactctaacccaaccataaactaaccaatgctaccactttttaattactagtttgttggcgtgctgtcattagtgagttgatcagagttttgtgctttgtttgcttgctgagagagagattgacaggaaagaaaaagaaatatgtgggcggttgaggaagccaagacggatcgcacatagtcttgcaataaaaattgtgaactccacatggatgcgactggagaaaagagcttggtcggccggccatggagtctttcttctatggctgcctcctctcaatgtgtcctaagctttgctgctgcctgtgtttgttttctttgattagtctctttcttagagtaattagagtcttttatgaaagttgtcatggacgcatgtatcactcggacaggtagaactggttcaggaattgaagacaaagctaggaaatttaattaggaattgtttagttagggaaaaatttaggtttagtggttatatcggatatgcggaaacacatttaaagtattaaacgcagtttaataacaaaataaattacagattccgctctgaaaccgcaagacgaatttatt

SEQ ID NO: 60788 - DNA, 2645 bp, Oryza sativa
ccgcaaaaaaatgaaaaaaaaaacgcagtctggcctatgccgccccgccccccctctcctgcgtgcgacacgtgcccagtcgtgtgcgcgaattagggatcgctccatggcgaaaagttcaggacacacgcatgggtttttgctatataagaatctagatagatacctcccctgtgatgtgcaggaagccactcgagagctttctctttctgtgtgtagtgtgtgcaactaggaggcttgttccatactagtttgctaggtcatggaaaagagcgagattttcgtaggagcacactcatatgcagctatatgtgcttttacactcatcataggatggttagctcactgggtatacagatggataaatcctccatgcaatgggaggcttcctccgggctcaatgggcttccctattgttggtgagaccttccaatttttcagaacaagtccatcaatagacatgccaatttactacaagcgaagactggagaggttaggattcaaatagttaataattaactttttttggaatcagtatgctatatatagttaaactttaggagaaagaacattgttgatatgaagacactattgctctaaatatgaacaacacacacaataaatctaagttcggtgtactgaactatcaggtatggacctatattcaaaactaacataggaggccagcacgtggtcatatcccttgatcccgaggtgaaccagttcatatttcaacaagaggggaagttgttccaatcctggtttccagaaaccacactaaacatctttggaaagaagacactcaccacgtataatagaactgctcacaagttgatccggagcttcgtatgcaagctctatggccctgaaaacgtgaaaaaatcactcctgccagaactagagaactccatgagggaaagcttggcgtcatggataggaaaacctagtgtcgaggtgaatgatggcgtgtcaaatgtaagttaacatctgcatttctacataagtattcacaattgcacagtgctcataaaatcatcatgatgttttactatgattaatttctattgtgcagatgatcttcggcctagctgccaaacatttgattggcctcgacatcaccaattcaggagaattgaaaaagaactttcaggaaatatttcaagtgatggtttccatcccattcccaatatattttccagggacctcgttttaccgatgcatgcaggtaggtctttatatcatccaaatagctttatgaaaatacatattttaagaatattaataagctctctaaagttataaaaattgtgattcagttaccttgattttttttttcattcctaatgaagggtaggagaaatgtatggaccacactaacaaatgtaatgaaaaagaggctaagtgcacctggaaacaaattcggcgaccttgtcgatctgatagttgaagagctacggagtgaaaatccaacaattgatgaaagttttgctatagacactctatctgggctcttgtttgctagctttgcaccgctatcgtgcaccttgactacaacttttaagttcctcaacgacaatcctgaagtttttgacaagctcaaggtatgtatagttctttaggagtgaatattttacatgtatattgaataattaaagaggatcaaacattgaaattttgggctgatcctaaacaaaaaaattcgttgcatctaccattccaggaggagcacgaaatgatactgaagaaacgagagggtgcgaattctgggttcacatgggaggaatacaagtccttgaaattcagtactcaggtgatttcaagttaatgtatgcttggattgaagcatcattggtgccaccctgatgcatttggcaattgcttttaaattgagcttgtttcaactgcaggttgtgaatgaaattaatcgaatcactacggttatacctggtggtttcaggaaagcactaacagacgtgcaagtaaacggtaaaaacttttttttacaaaaacaataaggaaaatgttgtgcatgtaggtcatgcaattgattattagagtatttgcttttgcacacaggatatacaattccgtctgggtggctagtcatgattagccccatgggagtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcggcagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaagtgctcgactatggtctatctccgcggtcctcgcaccgggaag

SEQ ID NO: 60789 - DNA, 651 bp, Oryza sativa
cattcttcaatgttttttgtggttataatacttttggagctatgtttcacacattttttttttgtctctaaaacgttgttgtaagttgatgagagagaaaatttttgtggggaagatgaatatatagaaattttggtttgttacttaaaaagttttattctcatagtttaaaatataatgaaaattaatcttaaaaatagaaaataaaataaattgaaaattaaaagaagtacaacattaatattagtttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaagatggatcggcaatggatgtacgctgaccggcggtccaaagagtttatcgatggcgtgcattattttttgagagtggccgaagctaacaagcataaggcttttatgtgttgtccatgcaataagtaagaaccagaaggagtattctgcatctaggactattcatttccacttctt

SEQ ID NO: 60790 - DNA, 3586 bp, Oryza sativa
tcgcaaatatccatttaaagagcatataaacttcaaatggccataacttggccatttgaacttggaattggaccgttcaagtctctaatttttccttaagaagtcaagaacccatttttgggctttatttctgcttgttatatggagtttattagagtaaaagccttttcttttccattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctactcatggtaccactagtatgattttaggtagatgcttcgctgtttaattaggtatcattaggtggttttacaactctagactctgggatattctcatcacctggacactttggaattgttggattattgcggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttgaaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgagggttcacggccttgattaataatactgtgtaactctaggatcgtctctataaaatggctttgggcaactaagtgacttttaaatgctgttttctgtaaaacttaacccctatattattatccccttgtactcccttgcattaattatgcatctccggtgtggcttgctgagtactgtggttgtactcattcttgctcaatctttctccccctttcagtaagagaagctttggagaagatgtcttaggtggagtcttggcttataccccagttgagcgcctgtgaagttggagccgtaggcccgcaagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggaaattttctcggtcgcgacattagatgatcggaacatgagatgaaccgatagccgcttgggttgatgagatcaatcggtatgtgtgttggtgacttcactggaatgtctagtactcaccaaggccgagcgcaattgtgttcatcggatagtccgatgtccacaagaaccgcacgccaatgagaaaaacgagccaatgagattgacttggtttcggcataattcgattactccgttaaggttttgacatggcgaatcgtagatgagatctatgtacacggctagcgggaccgccgtgtgcgttgccccttagatttcgcttagggttttatatctatcttattttattgctgttgtatatttgatatgacatggtaggatagattccctcagaaaaattaagtgtaatttatgctcttccaataattgcacctattacggttgtgatcataagtgataggtttgccatagcaaagtgtcactttttatcatgataaaataggatagatgtcggacatctatctgcggagattattggtttacttgacaaggagatgtcaccccaacagcacgagagtcacatatgatgtgattagcaaggtgttgcttacctattttgatagttatctagctgtgatgccaaagctcactagacactaataaaaatgaggatcttgactcactatgttattagagggaattttgtttcacaatacatagtgggagtatctttcgttaaactgtttaatgaaaggttaaatgtagacatggtgctgattttgcctacatatatttctattgtagatcatggcagctcctgcaccatccagttttaacttgcggtctattcttgaaaaagagaagttgactggaacaaacatcatggattggtatcgcaacctgagaattgttctcaggcaagagcacaaagagtttgtgcttacacagccttttccagctgacttgcccaacaatgctcctgctgctcaacgtagggagcatgaaaagcgatgtaatgattatcttgatattagctgtctcatgcttgctactatgtcccctgagcttcaaaggcaatatgaggcattggatgctcatacgataatcacgggactgcgtaacatgtttgaggaccaagcaagagctaagaggtttaatacctcaaagtccttgtttgcgtgcaggcttgcagaaggtaatccagtgagcccacatgtgatcaaaatgattggttacaacgagactctggaaaagcttggttttccccttagccaagagttggctactgatttgattctccagtcgctccctcccagctttgagccgttcatattaaatttcaacatgaacaacatgaacaggaccttgacaaaattgcctgggatgctaaagactgccgaggaaagcattaagaaaaactccaaccatgtgatggttatgcataagcgcaagcccaacaacaagaagagtggttagaagagaaagctaaactctgatgagatcacgagtactagcaactctaagaccaaggttcaaaggacagggcctgctaaggatgcagagtgcttcttttgcaaggaggcaggtcattggaagagaaactgtaagaaatacctagagcagctcaagcagaagcagcaggatggaaagagttccacctcaggtattaatgttatagaaattaatcttgctacttcctctactgattcttgggtatttgacaccgggtcagttgctcacatatgcaaatcgttgcaagggctgaaaagaagtaggagcttagcaagaggcgaagtggacattcgcggggg

SEQ ID NO: 60791 - DNA, 32592 bp, Oryza sativa
gcttccccccccccccccccccgtgctgatgtcagccctgggatttattgcgcaatgaatgatttaaggtttttcttttatagtaataaacacagtgaatcttctaaaattcataactaattcatccgagatccgtttaagcccattcaagtatcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggttcctccagcagcagagcaaggcaagtcatgcttgtcacttgaacatgttgatcctatattgcaaatgctctattgttttccttcaaatactgcattgttttataatatttctatggggtgtttacctattgtcatagccatgctattgttgcaccatgtcccttttgtcagcttggggttataacatgactagagattggactagggattgcttagccatgcttagttcaactagtgcacaatggggaaaatcttattaatgtttagactgttggttctaatggtagtgttggattagtgccaccgctttggtgctggttaattaaaataaatcacatggtgggctgtgggtgcatggtttcgctggtcgcacccatggcagttaaggaccggttcgcgggatgccctggaagaacttatcgtacttaccacaagctagcgtgggcaacggctgggcttgtagtgtagccttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggcctctttccgatgtgtcgtggtggcatgtcggcgcacggaaacgtgttgtggggctgtgtcttgtgggtacagttgtatacctctgatcagagtaaaactattcgaatagccgtgcccgcggttatgggcggtcaaccagattcaccgtgattagtctcaccctagtgtaatcttttgaatttggatggtttaggtggatggttgggcctgttgcaacgtgggatagcgttggacagcggatgatcaatattaattaattattacaactgcttaaatcttttaacttctgtttataaatgctcgctttatgcaaatgaaccactctagctcttctttgataattccctgcatcatacccctattccggtatgacttgctgagtacagtgggtagtactcagtcttgctctatttttcccaacccccccagagttcgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacagatggcggcgtgcgtgcgtgcgtcacgtcgctatccttttgcaggcactaacccacgttcccacgattccctccgcaacagcgcgtccacgttctttctcctgatagataaggaggccgcgagtccgatccgttttcttagcttctttcccggtgttagtttcttcttctccgcgcctgaattgctctcgcttcctcgcttctgatctcttgcgcgcacgagagaatggaaggagcagtgcctccgaaaccacaccttcgcctgaaatctgcaccaggtaggcgggtgatcagatttttggggagtgcctcccgcacgactgctcgactgctcatcgccatgtctggagttgccgccgccactgctggcggaggtggtacgccgccgacgggagctggatccggagctggtgcgccaggaggtgccgtgaacgacaacaacaacggaggcaattctgcctcaccatccagcggagggctattctcggagtatactcttctcctcctgctactgttgttagcgctattcctgttcccattgttagcgctatcgctatactatgtgcgctatgtttttgttcctgttctacatgatgcctctagcatgttatcgcgttactggtatattcctgttcctgacattcatgatgcgcatagtatgctactggttatgttaagatcaccctatactgcttatgccatgatcattgctttaactttttggattaaaatatgtcgattaatgactatatttccaacattgagtgttcagtgttcttgatcagtgatgaaatttaatgcaaatgatgccgtgcgatgcatctagaattctagcatagccgacttcatttttttgttcaatctggccgatcaattgggcctagtggacgtagatgatcgaactatcgaagagccgacctttgacgtggtcgttttcaattttgaacggccctcgccctccatgaccatgcacgcataatcggctcgatcgtgtccagtcttggttgactcctgataaaaaaaagacttaattgacgcgacggcttacgcatcgaagatggcaaaagaaacgctagtaaacgcctgtgcgtagcctcctccgctgctcgtgcctatccgcctgagatgcactgatgcacattggcaactgaaccaggttgggtcagtttctagcataagcacaaacagcaaaccatgaggcccaaacttatattagggcagataaaccatgagaccccaaactaaaagaaatgagaaaatcaataagttatcttaagaacaaactaaatactgctaccttttaaacaccttgcaactaaaaaataataaacccaaatttgaacgttaaaatcacattcataactaattgtttacacaaattcctcatttcaattaaaatatcacatattcaaagatatcttgttaataaaatactactctctccttcccaaattgataatcatataatgaaatccaaaatttcttaaattgatcatcattatgaaagaatgtatgtatagtatcttgattgatgtgatttaaattatccttaacgttggtacataaatatatatcatatcattttgggatggagggagtatcatacttttattgaaaagaagacatactatgataagggtgggttctaaactctcgatgggatatttctcatgtactttttttttctttcgaactgaatacaaatactccctccatttcaaaatataagtcacaaccacccttaacccaaagaccaagaaatagttattatcaccttgtagtttagatcatcctaataaatgtaatgcatccatccaatagagttagagaatgtgagtgaaggatttaaaaaaatagtaatttaatggagaattgttatagttaatggcatacatacatgtatgccttatattatggaatatcttaaaaaaagtggttgtgccttatattatggaatggagggagtaattgtttaacaattttttttatcttttttatatatcgacatgtgagttgagtttggacctaagatttcatgaaattgtacatatagacatgtcatgagtgctttaaatttttttttagaaatttttaaaacagtttggatggtttttaaacaaacgagaagacatcccctcgagaagtttccaatacactgcaggggagtaacaagaagaacatcggtgatcttgctgaaattacgtaccaacctaaaagacataaaattatcgaacgcattcacttagatttccacgataatccgatacataacagagatttggagaaagtagactgccttacagactcgataatacattatttagaagccaccattcatgggccataatcgcgaattctgatcgattagcagcctaacttttggagcgctccaaaacctctacttgccatcgccatggaggccctggaagtagccctgcgggttggactcgaagccggagcgggagatgtacgatccgtcgccgccgggagccttcatgctgtcgcccccaccgccgccgtggtagccgccggacttgcctgcgccaccgccgccaccagcgtgcccgccgctgtatccgccgccgtacttgcctgaacctccttcgccacctccctttcctcctcctcctcctccgccaccgccgctcctgcccccacctccgctgccgcctccacctcctttgccgcctccacctcctccaccaccacccttgccgcctccgcctccgccgccacccttgccgcccatgtctctaccttgcttgatcagtcgaagaataagcttgcagaagtagagtactcttgcgattgaacttgcgaactgcgttatgctgtatcgagctggagtgctttgttttatagaggacgacgtccaccgggataagcgcgagcaatcaaagccgcgttcatggcgacgcctcgcatatcacgtctgagccatgcatatgcccattaccaacgcgaagaatgaatcagaatttactactccggccaaactcccgagagttttaatccgtgaaaattcaaaggtcgagttggaccctgaccgttcggctgaatcatcatcagcaacggcgttgcgagaagccgagaaacaggccgtatttgtagagcccaagactatagactgatctgggccattacgagcaacagcacacagcccagctccttctatgggctgtggcccatagatcacctgggccagtatcctcctcacaggcttccagccaataatcgtagcttgtaaggtaacaacagtacaactgtacaagaaaggatggaagtgtcacatgcatttctgtcatgttgaaccagctaattgcagcaggccaacttaccgtaacacacacgtacgcacgtcgcaacacggctccgcaacagaaaaaaaagaaaaaaaaaagaaacaggatcgattaattatcatacaaaaacgttgccgccttgcgcaaccaccaaaattaattaaactacatcatcatctaccactgtaattaattaattaatgaactccatcttctgctgtaattaatcctgtgtacgtgtgttctgtatgcatgatcgcctcaccggagtatatatatatcgatcgccggcgatcaccggaggaggtggagggccttgaggaggacggggcggaagcggcggacgtcgaggcggacgtcctgctgcccgaggtagatgtccttgacgagcgaccagctctgcttgtggatggggagcgggtcgaggaacaccgggtgcgcccgcgggtacacctccgacagcgtgctctcctccgccgtgatgttgtactgcaggtacctcatgttcatgtcgcgcggcggcacgccgtactcgtccatggcgagcccctccatcctccccagcggcaccacctggatcaccaccgcgttcatggggaggaacaccaggttggtcagccccgacccgtgcaccgccaccatcgcgtcgtacgagttcaccgccgacgccgccgccgggatgtgggcgtccagctccgccgccgccacctcgaacccgaccccctccgccgccgccacgatctcgtccaggttcacgaaccggcggcgggagcgccggttgatcaccagcagccgcggcttcttgctcttgtcctcctcctccatccggatcgcgtgctcccgcggcagcgcgtaccgccacatcaagaaccgcttgaagtccaccatggagtagttgttcggagctcgccgcgggtcgatgctgaggtccttgtggctgtggagcccgacggtggcgcggcggtagcagcggacgcgctgctcggcgtcgaggtcgacgggctcgtacttggtcaggccctccacgatctccctgtacttgccgaaccaccaccgctgcttctgcgtcaccagcagctggacctcgccggcgaggtggcgcgacgtgatgaacagcgggatgatgttgtcgttgaagtcgtggtagtagttgccgcagtagccgccgttggagtacacgatcgccgggacgtcgtgccactcgtcgcacggcggcgcctcgtcggcggtcaccagccgcaccgtcacctccgtgatgccgggcatcacgcgggactcgcccttgcgggtgtacggctggatcttccacctcgtcgcgttcgcgtccacgcccgtcgcgttcacgccgccgccgccgccggagatggaggcgaggctcggcgccaccaggaacacctccgacgtgcggccgaggatgcggatggcgccctccatctcgcacacgtcggatctattgtctctgaagtcgcatcgcaggtgaggctccgggatgaactcatctgcatcaagaatttcatcgagcaaattaaaacaaaatcagaatcttttctccaagataaactcagaatcaacaacgtcagaaattaatcacattgtggggtttgaaattcccaagattatgtgacacatacctacttgtttgaagctcctcctaccatcaatcaacattgatgggaaaccaggcttgcctgcagggacaacccatcaatgtcagttaacccatttcgatcacaagaacatgggaataacaacagatgctgatatcctaacgtgagcagtagcctatcatgaatccatgatggacattgtcaacgaactaatcaattcatcattcagcaactgttaccattttatcccaacaaataaaggaacttgttttcttgaaaggattcagcaactgtttccaaatatgcacaggaatggagtatcgacaagacaaacagcatatgcttctctgacagtactactaatcaacatacaaactgaagaatacaaaacgattatgattacggcgtacctgtggttagcatcaccatgtactgatcaagggttggtgagtaaatcaccaagaactggattgccacgatgagcaggagcagaggagggtggcagaaagagcccttgctcttcttgctcctcacagctgccttcatctctgaaacagcaactacccacacaccagggacaagaacagaacagcagctttacaactatatacaaaacatagagcttagctccctctctgatgcaggtatccataaatgcatcacatttgcatgtattagtacattgctaggcaagttgattagttaagtccaggggaattaacaaaccagattattaatcgatggacccagcgaagcagcagcgagcaatagtgaccgtgaagaacagtactgctacatgatttggaagtgatcaattaattaatcaggccttggtcggttgaaccagctgggcagttcatggaaaccacgtttattcgcgtccttttcctttttgttcttttttttttcgtcacgagaactgacgttgcttcttcgtctttatgctgttatttcttttctctgaaacagctagaattcagaagcaagatttcaagaaaactccagtttgtggtggcgatttcgactgttttaatctcaagtggcaaatctgcccgatataatttgtgaagtcaatgtgtgacatgtgccatctaatggtgttttgcacttgaaaacccgggatgagttcagaggccagatccgttacactgcaaggctacatctgaaaaagaataaaaagcgtgataagtacccctcagatctatcagtttggcatttcatgattctgctctagcaaaagggaattgtttgatagcacaggagcacatggggggtaagggaatcgcggagcaaacgcaacgaaatggtaggggagattgctcagattgcaagtttgtactttatatgtatttatattttggatgaactttgtgcactttatataaagtgggagattatttgttcataagtgaaacacttgctaatcctgcattttgcataatcataatggctgaggcttttgcatcctgtgcttctgcatatacaatgactcaaaactgcgtcttttgctgtctggtcatgacaaaagaaaacaattgcagacaccaataaaaactgcaagctggatatcctggattaacactctggcatgagcaatatacaaggatcaagaagtaaacgccaggatccatgaacaaatgagcatctagctaacatgtacacagcgcgagatcatctcgcgaatagcatggggaattttctttaattctgatccacgttggttctgatgtatggatcatacatttatcttaggatggttgaccaatccttaaaataggatgattgactatgattagagtcagttagctgcaatttcatatttgcccaattgacactcgtcagttgccaccatgtctgaccttgcctgcttaccagatgacagtgaaaacgttgctatccatgtccacagagattctgcagtgatgtacttaggaaatcaatatgcagtggggcgattacacgtttctttaatcctttccatccaaatttgctgacacctctctgaagttcttcttacttaaccctgaattcttttcgaagcactatctgaactataacagtccatacaatcccgtccaaattcatcaaacatatatcgaccagctggagtgctggaccattacacttgtttggattaaaacaatttcttatctctttggatgattttagttagcccatacaatcccgtccaaattcatgaaacgtatatcaaaccagctggagggctggaccaatacacttgtttggattagaaaatttcttatctctttggatgattttaattcaatttttcctgctaatccagatggataaggcattatttctatccatccgtacgagattcctgtgtttaacttatcaagaactcttgctacttgctctgagtttttttttcagagagaggaagagaagacctgagttaattaatagcccgaggcagggtttggctgtgttgtttggggctgggaaccctttcccgacgcttaaaaacagagcaacggattaacatatgattaattaagtattaataaaaaataaattaatataatttttaaaataatttttctgtaaaattatttaaaaaacacacaatttaaaagtgcgcatcgaaaatgagagtaaagttagaaaactgtagtgtgaagcttatggactgtttgggaagcttaagattctgagaagcagctggttgttagccaacttataagaatctagaaaagctgagtttcctaacttctggcttctagttcttttttagaccaaaagctgtttgaggagtttctgatcctgattctaggagaagctgtagctagggatgcaagcaggttttttatccagtttatctcacttctagtttatttttcttctaaaatttgtactaccatgtgaaaaataaattaacaagcgggtttttatacgggtagtgggactacccacttgcatctctactgcagctagaagctcccccaaacaggccctagctttggaggccaaggcccatatatagtaaggcctcatttgagattttcgcccaaataagtcccatccatgatgggccgggaaaacggtgccaatttacgggctttcctcagatatgggccataatttgggccctaccagacgaggccgaagtgggtcgggccatgtatgcgctgtagtcaacggcccgtacgatgcgactccgagaggaaactgctccggccatggccatcgcctccacgagtcaaacccagccaccatcggaattcgagggcgcggagcagcggcgaaatgagcggcggcggcggcgaggtcgaggcggcggcggaggcggcccctctcctcgtcccccacgaccctcagccggcggtgggggcggaggtgcggaggcaggtggggctcgcggcgccgctggtggcgtgtagccttctgcagtacagcttgcaggtggtctccgtcatgttcgccggacatctcggcgagctctccctctccggcgcctccgtcgcctcctccttcgccaacgtcaccggcttcagcgtcctggtaacacttaaaccataattacatatactttaacttcgggttggtaaattcttttagtatgaatagttactcctttgttcggcaaaaaaatttgggaagtgaaaatcagtacaaagtacggcgcgtttgctttatggtaggacatcatatccaaaaattagttcaagttctacaaaaatacaatccatccaatgatctaaagaggccttgtatatgcttgtagttgtattgtgcttatggaattatggtgactggcatttctttataaaatgtatggaatctcgtttgtttttcttaaagaatatgtatggattctcctttgttctactatatgatgcctgatcttttacttgcaagaaaatttcaatgaaaactgcatatctgtttattccatgacaagctgggaatgggaagcgcgctggatacattctgtggacaatcatatggagcaaaacaatatgatatgcttgggacacatgcgcaaagggctatctttgttcttatgcttatgggtgtcccgctggcttttgttttggcattcgctggccaaattcttatcgctcttggtcaaaatcctgagatatcatctgaagctggactatatgccgtgtggttgattcctggtctttttgcatacggtttgcttcagtgccttaccaagtttctgcaaactcaaaacattgtccatccactggtagtttgttctggggccaccttggtaattcacattttgctgtgctgggttatggttcattgttttgaccttggcaacagaggtgcagctttgtcaatatcattatcttactggttcaatgtgatattgctagcaatatatgtaaaagtctccgaagttggcagaaggagttggcctggatggtcaagggaggcacttaagttaaaggatgttaatatgtatctaaggctagccattccatctacttttatgacttggtaagcagcctgacatggagcaaccctgttcaacaatagatactctctttttatgatttaacagataagttacatgaaataccttgttctttctgcatggaaataattatttgacttgtgacataactcagcttggagtattgggcatttgagatggtggttctccttgcaggctttctacctaatccgaaactggaaacttcgattttgtcaataaggtgagcaaacagaatgtctgcattcctttcagtatagtttctagcaaatgagtttagttccaaagttgttccaaaacataaataataggctgtacatttcaaattcatggtattacatgcatttgctttttaaattttctgtgataaccatgaaatacacagctagcaacttagcatgttcaatggattatgctttcagacacttgataatgtgaagtaatgaatggtttgtttccagcctgaatacaatgtggatggtttatacaattccaagtggcctcagcagtgcaataaggtcagcagagcagaaatttgggatgacttttcctttcattttatgagatttgacacctcaaagcttatctaattttggcccatggctcatgtctctttgcagtataagagtttccaacgaactaggtgctaggaatccgcaagcagcacgcctatcagtctttgtttcaggaatcatgtgcctaaccgaaggcatacttgtagctatcatcacagttttggtacgggatatctggggttacttgtacagcaatgaagaagaagttgtgaaatatgtcgcagcaatgatgccaattcttgctttatctgacttcatggatggaatacaatgcacactatcaggtttgggataaaacacacatccaaatatgacaattctgcatttatcacgtagtgcctacactccctgtttttaatcatacatgtaaccagaataccagattgcatatctttttacattgttgccaatcttgcagttggccgttttgccccattacagtgccacttctaataataataaagcccttgaattgtttatatgttgcatgtcacggcctgtttaagagctttactgacgtgccttgtacaatccaattagactcagtaccactaccattccaacgcccaacgatttcactatgcaatctaccagcaacaccagcattaagagagatagtatagaagttttagtgtgtgattacgagaaattattctactgtagaaggatggtaatgtaagtattatgtaggagttttactatgcaagctaccagcaatgcttgtgttaaagaaggctgaccatataagtactgtgtagagaactgtgcctagctcggttggtatgggttgattgctttcacccagcagacccaggttcgaccccttgacctgctcatattccactggattaaatgaagggatggaaaaatatgtggcttctcctatcttaataccattggagtgctagtttttttttgttctgtttttttttttaaagaacaaagagtgctagttcatatgccattttctggggggtgatgtaatcttttgatattttagacttgttattgttcatgatatttctacataatttagttttttttaaccttggtcaaatattttatgttgcctttattatatcacatccatagtaaccatgatgccaacaaacctcaatattattgatcttagtcaccatttgtttattttttttatgactcttaaggtgctgctagagggtgtggctggcaaaaagtctgttctgttatcaacctgtgcgcttactatacaattggtatcccttcagctgttacttttgcatttgttctgaagatcgatggtaaggtaaattttattttttatatgcaattctggcatgacattgttgtgcaagttctgtcgtaatcccactctgagttggttttctgtgcagggactttggttgggaataatatgcgccatgacagtgcaaattttagcgctggttgtcatgctgcttcgtacaagctggaatgaagaggtacacccttaaacttataacctttacagtcaaagaattgatgcttattttttcccttttttaaaaaaaaaaatcgaaggcacaagatctccctctagcccagtaggaactaggaacagaaggacatgcactgttccagtagtatgaaaaattgagattgggcagtagctacgttcagtggcaaagccaggatttagagatggggggtgccatctacgagacatggtaattcacttaaggttcaatgaacagtgattttgtagtgttgatgcatgatcggtaactcgatatcatacatgttacagcgattagctacaagagagaacaagaacccatatatcatgattcgccaatttaaaattcagtaatatttttaatatatggatgattgaacagtttgttccattaattggagtcttgcaatcacttctaaaatgataaatcagttagctaagtcatttcataagtcagttgtcttatatcctatatagttagtctcatctgtaactaatgatataattaatagctagattataagtgctaatcatccttgggagaagagaggggaggggaggtcacataggggttaggggggtgttggccctccctggcccctacggtggcttcgccactggctacattgacctccacaaaattgctgaagcagcacaggactttacacctggtgaatgcttctcagtgcctcagtggggattggggaaggggatgcataactgatatctatgaattgctggttttctgctttgtcacaagaaactaacttgcaattattctttcctctgaaattaatttgcatggagaaatgcatatcaatcgtttccttctaactggtttggtatgacatggaagtctggtttgattgagtctgcgtggcatacctgttgagccttacctcaccagtccttcctgctgtgctgagatgacatgatatgctagcagtctttgtcttactatgttgtctataactaacttgtccttgatgcgtttacttttgttttctttataggctgaaaaggcccgggctagagttcagggttcagatggaagaatcacattggcctgaacatggatttcaccagttttgagtcatgattataccaccacaaaagcagttattgataccatagtactatatatagagtaattgatactgttgattatttgaaacttgtttgctgtacattcaataattgtaactgattgggcatgtgacttcttttcttttgtatagttgatatggtgtgctgtgaatgaaattctgcatagttcgccctgcaacacaggataaaggtaactcctaaccatcttttccaacacaattctatttccgtgtttgaaaagctttttcgaacatttttctacaattagtgcccaagtggaattattggagtagatgaaactaaaccatcagaaactgaaattgaagtcaccaaagcataactagggcagggtactgcaaatttatttttatttccccctccataccagatcagattgctattgttaatcttttgaagacaaagaggagtaatcattaaattactattatgagacactggcctacctaattcgatgttcttttcctgaggaaggtaccaagctagtctagcttcgatctgagagtcgacgagtaccatattacattcctacatgctttagttgttgctactcctctctcagttatagtagatgtataatgcgaaaaagaaacaaagttcaggaatttcctccttttaatgcaaagacatggaaagcttttgtgcattcctaaaaacaaggttcatgaagaaaatacagcataaaccacaccgttataatttgtcaacatccttgaaaattaaggcacgccctcttatgttaaaacaaacagttctggttttacaactcatggataataataacccacccgttcttccctatgtctcctggtagatggcacagcacaaaaaagtctgcagagattctggaacttcctctctggtcttcccattcaaaaattgttctttaaaacacatgcttttacgttagctggtgctgtagtggtgtttctataggcacaatggtacttagatcatcatcctgggtcttggtcttagtttatgatttatcactgttcttgcttattctctatcgcctctgtcttcatttttctttggagtactatatacatatatatatatatatatagctgctctaatatgatatttcgtggttaaaattcctggctccatcttgtttttcactcactttccgccactcagcatcctcagatgttatcatttatcatacatgtgtccctgtattgttggaccagaagtcttcggcacgtaaagctttagataaagcagcacctgacctgagtcagagcttctggacgcatatcataattgcttccctgcttggctagcttaatatacaaggccaattaagaatgcatttatcagaagaacgtgcacaaaccacccttattgatggcatccaaaagctacatttcctctgccaattaggtctgtgaggtcaaaggtctgatgaacctggcaaaagcagagacagatttctgaccacagaaccttcatctcagtgcagaattttcaaagactgcatttctattgtacagtaacatttccctggaaagactcctttacatatgatcagagacaaatgaggcttttgcaaatgtaaaacaatgaagttccacctttgaaagttgaaacccactagaaaggagacagataaagcattatctatgttgagcatatgtttggagtactaaggaggaacttagcatctgttgaggaatttagcatctgttgttgttagagaagaaaataatgagaaaacctgtgatcaaagggattcgaactcaggcaagcatgctgctccctgtcagccgagctctccctgccaaccaagctaggtgccgttctcttctacataagtagtagacgaaactcagctggttttaactgcatagacaagcattttgctgtccttctgtcagtaaccatgaaatgcaacacacggtcacccttgagctggtgagacacagctatcagccacaaagcagatagtactttgcttacaggagatgattctggagtgctttctttctggtttcggcagctcaatgatcccaccgtgaaaggcgaggaagcaacagaaatttggtagctcctccaaagtggagattatcgtggaagctgagctgtttccaaatcccaatactacacctactaatcgtctcttatctgaaagataccactgatcatttctgaataacgaaaaaaatgagaatgtgtaaataggcaaagttctatgattaaggccacgattgtcggttatttgggcgttttccacatatgattgatggcatctaatgatcacatttctactgattatatctctgggtcggttcagtaatgaggaaatgagagggaaacggctccttcaagttgttttactgtcttgtcgtgcagtctttttcttgtgggaaacagttcaacaaccactgcagcttgttgggtacctgggttcatggattcttttaagaccttttctgtggtggtcttgtttggcagtgcttaccttaaagctcttgcaaactggcttctcagatgaactctgaatatttcgttgtctgtacaggtagtgtttcagtttaccctatgagctacaactaacgacataatgtcagtgggtgcttaaagagactagtctctaggtacttttaaggtaatgtcagacttccgactgaatgcatatctgaaaactatgttcttgattgagaacaaggggggcatggttaaccatttcttttttgtttcagaaaggccagattggtatagctgaaatttgtttttttgctcattcttttctcgatataagttgaacattgccttgttttacaaaattgctcggactattcagatttacatactattgatcgtcatctcatattattgatcatcaccatttgcttggcaggttgtcagaattaaagactgccaagatcttggaagaacactattggtggtggcaaaagtgaattgttcatcactccccacaaacaaataattagcatttttcatgttgacattttatcgacaacaaccaatttacaaagtgtgcaagtgtaaattaacctttggacacttgtctatgacacgatcttactcgtctcctcctttttatcaaaaaacaatgaaagaaatgaatctcaccacaagaagaagaaggagaaaaaaagcgaatcaaaaacagaagagctctcctatctaccatcagcatcatcaagatccccagccatggtgtcagggctctggcaagaagtcgcgcgcccgttccagcgtgttggtgagcttggtgaggttgagctccacattctgcttgtccaggtacaccgtcttgatggcgtcccagcctttcttgtgcacatcgtatggatgctggatgtagaaatggtctctcgggtagagctctctcagcgagctctcgtcgaaggagacattgtactccatgtagttgacatccatgtccttggctggatccttgaaggtgacacgggtgagccattcgagccccccgaatggcaccacctggatgagcacggcgcggctggggaggaacaccatgttggtgaggccggcgccatggacgcccatcatcacgtcggcggagttgacgaggcgcgcgaagttgggcatgtcggtgtggttgtccggctcggcgatgcgcacgtcgaacctggcgagcgcggcggcgtgcgccatggcgcgctcgttgaggaagcggcgcgagctcttgcgggagatgatgaggaggcgcggcttgtcgcgccgcggcgcgcccgtgcgcgacgcgacggcgcgctccaggcggaaggtgcggcggaggaggcgcttgaagtcggcgacggtgacgccgcccggggagcgcgccgggtcgatgcccatggcgcggtggaacgtggcgccgatgaagatccgcgggaagcagtgcacctcctggtcgttgtcgacgtcgatgacgtcgtaccgggagagctgccggaacagcggcgtgaacttgtcgagccaccaatccttgatcccgctgagcaagaactgcacctcgccgccgaagtggttggtgctggtgaagagcgggacgagcacgtcggtgtagtcatggtacaggttgccggcgaagccgccgctggagaagaggaacgccgggacggagtggttgcgcgtgcagagcggcggcacggcggtgtggttggcgccgccgaaggggacgagcgtgaactcccgcacgtcgtccatggcgacggcgtcgtggaggcgcgcgtacggcttggttctccactccttgtcgagcgggttgatgtagatcttggagtggttgccgtcgacgcggatgtcgcccacggcggcgcaccgctccgaccgcttgctcgtgacgtagcacgtcggcctggtcgggtcgaagtcctcctcccctatcggccccgtcatcttgtacctcgtgctgtcgtaatcctcgtcgatctccaccacctccatctcctccgccgccttggctgcaaccacaattactcacagctcatcactccatgaatcaatcaaagctcatcactccatgaatcgatcaagaacaaggaggaggaggaggaggaggaggaggaggaggaagaagcgtacggaagggggtggagcagtagcgagccttgatgtaggtgaggacgcagagggagaggagcatggtgatgaccatggcggcgttgcccatccgccgcggctcggcgcgcccccgcgccacatgatggtgcttcatcggcgccgggctctcgccgcgggcggcgcgcgccgcaggtggtggtttggtttggatctgaaggaagcaaaaacgatcgggcgtgagcagcagagagaggttagtagtattaaaggcggggtcggggtggcgtcgcgtcgagtggatgatggcgaggcgatggcaaccagaggttggtggcgtcgtgtggtgggtcggagctcgcaacggcgcaaccactcactacaagcacaagcagcagcagctgctgcacagtgcaaacggcaaagcagagcaggcagctacagctacaggggtggggacgagtagacaaagcagtggcccagctagcgcaccagtgcaccaccaacaacaacccgatcgccgatcgctcgccgtcgattggccgaggcagataagatcgcttattcacagatgtactgcagtgataaagggtgtatggtttcaaggctgaggtacaatgtttaacctctacccctaacacgttcataattttttttcttaaaaaatgtttggaggcagcgcaaacgcaacaacgctttgttgttgatgggtacgtggttcaacaaaaaaatcaaaccagttaagcttcgttcacttttcaattttttttttgggacgctccttccgtcaacccggtgtttttctttgcgtcgattatatgtgatgttggtgaagaaacggtcgcctgcctcgtgcttcatgacgagaggtaggttggttcattcacgcgttggcgttggcgttggcgttggctacagaatggtgatcacaacagattcacagatctaccaaacgtttgagcctaccaagtacacgtaccaagctgcagcgacacgtacagcagtgtggaataaatggcataaaaatgtacagcagatggtgcctgattaattcagagttgctcgcggcggcgccgggcagcgagaggaacactcgtgtctcaggcatgttcatcctcaaatctcaactgaatttttgtcaggatgctgcggtgtcaatgcacgcgcgctcacgtgtttttcccgtttcgcattggctttcaaacgccggaatccaacacaaccgggggctggattaaattaaagttgactccttctttcaaccatgatgttaatttgctaaattgatcataaatcatgtactagtaatcaggcatagagcttagcttgtacaaacctacaagcttaactgcatagtagtggacacatgaaacttgagggagaaaaggaacccatttatccacccaattagttgctcggtcattctcatcaacctgaacgcaagaacaaacctgtatatatgcaaccacttgaccaatcactcgacaagcaatgccaattcatgttctccaatccaatctcaccaaatcgagaaccaacattttccaacgacaaaataatacactgaacctatgcctgcatttggaattttggatcactcgttcagttcttgcaccgttttattaacctgtagcgatgtactaccaccatctgtttcagggattcagaaaaagaactgagagagacagcggagcttactgtcgtcgttgctacgatgaaaagggttgctttcaagtgtccatctctgtggcaggtgaatggcttctttatataagtcccaaatggatggaccatttgccttggatctttgctttcatctactctctgctctgcctctatttctccttttgttaattgacatgtccttgttaaatacttaactatgtagtcgcactgaaaataaaactgttgcttctgatgcaaatttgctagagctggctacagaatgggccttgcttgatgaattgaagcaaaagcaacattgctagcgacttggaggaattgggaatataagatgttgctcgatcagacagccatgaactcccagcaccaatgccctgggcagcatgtgttttgtgggggctatctcgtacaaattggccagcgatccagcgtaccaaaccgatttgtcgtgggattaacaatcagtcgatcacaaggctacaaaaaacggagttaatcaaatcgaagactgcgtctgcgttggtcgtttcataatcacgttcgacaactttccatgtgtgaataaacaaagtcaatcataaggggaaagcacctttatcataaaggttaaaaaatcatgatatatgattacacacagcaggttctcaattttaggtctgttcactttgatgtaaaaaaacattaccaaattttagcattaccaaaatttggcattaccaaaattttggcataggcaggattttttatatggttaccaaaatttgacagcaaactaaatgcagccactttttttacagctttatcaaaatttggtaatgttgaaaatggcatcaaagtaaacaggcccttagcaacttgccaatattttggtaggatttcttatataattaccaaaattcagcaacaaactaaatgtagccacttttatggtaactttaccaaaattggtaaggttgaaaatgacatcaaagtgaacaggccttttttttaaacaaatgttctcaaaatttatggattacatattgatgtgcctattgaggatgtgttagagatacgattacaaacaagtattccttccgtattttaatgtatgacgccgtttactttttgaccaacgtttagccatttgtcttattcaaaaaaatgtaattatcatttactccatccgtcccaaaatataacaacttttagccctcaagatttgtcccaaaatataacttctccactaacattctctttccaaccaatcacacccctccaccattcactttcccacctacctccattacttaaccaatcacaaccatttatcattcacttctacctactttcttaataaccatgtccaactctaaaaatacttatattttgagaccgagtaatattttattatgacttgatttatcatcaaatgttctttaagtataacataaatatttttatatttgcacaaaaattttgaataagacgaatgattaaacattggctaaaaagtaaacggtgtcgtacattaaaatacggagggaggatgtacttacatgtgatgatgatgtgtacgcgtatacatacaagtacattcttacttgcggcccatgttggttagacggtcgtaacgggattacgattttgtgaagcccaagaactagattgaggtcctacgtgcgctgggctttcctcttacttgcggcccatttatgttgggctgtcaatttatgggcctcattttctaaagtggctcaatgaggcctagcaaggtttatcacggcgggccatgaatttgggatccgggcctttccaatgcttgcaaaataaaggaataagatcactttgactccctcaactgaccaacgaatctaaatcgtatccctcaagcgcaataccagaaatcttatcccctgaacttgtaaaaccggtgtaattttactcccttggtggttttggatggcggtttcgctgacgtggtgcacacgtggcagtgttgacctgatctttgttccacgtggcatttgacgtggcgtttatgtggcattaaaataaaaaaatatatgcggggcccatttatcattcacacaaaaaaaaattgtgggacatgtcatcttctctctcactatccttcttcctcctctctcccttatctctctctctctctccccttgacaagagccgatggcaggcgggggctcggtggcggcatcagcgagtgggtgcccggagtggtggctgtggtgggcggtggaccttggagcaatagcttgcacgccccaacgcgcggcggcggactggcctcgagcgctccggcgtcgacctggccatgatgcggaacagcgactggagctcctcctcctccgacacgggccccctccccgaccacgtccgccgcgagaccgccccttcttcctcttggacttgccgccagccgtgcccgcggcggcctcgcggaggctcgggaagttggcagcaggagtagggggctcggtggccgccggggcggcagcgttcttgcgctcctccacctcctcctcggtgcgctcggtgtcctccgccgcgcacattccttcgtgccaccgtgcccggctcgctccctccccaccacggccgccccgcgccatcgtcgccggaatcatcctgctcatcgctgttgtgccctcgccgccatgccctcgccccgccaccatccccatctcccgtggcgccagcgccgctccagtcccggacctgccgaagctgaatccttgctactgcggcggcgagggcggcggcggaggcggcgcgaagaccgtcggctgccgctccgtccattgcccgccgccgccgctccccacgcacgaagagaaagagggagagatagagaagggaggagggggaggaggaagaagagataggagagggtgacctatgggatccacatgtcagtgggtcccacaaattttttttgtgtgaatgacaaatgggtcccgcatatatttttttattttaatgtcacataagcgccacgtcaatgccacgtggaacaaagaccaagtcaacactgccacgtgtgcgccacatcagcgaaaccgccatccaaaaccatcaagggagtcaaattgcaccggttttgcaagttcgggggtcaatatttctggtattgcggttgaggtatacgatttagattcggtagtcagttgatggagtcaaagtgatcttattcccaaaataaaatcccttctttgcatgaatattgtgagtttcaccaatactatcactgaatattttttcagtttctacgaaatttgatctgttttgcacattaaaactcacagatggcactggtatcttgaataatgaaccagattagtacattgtgatcctgacagggcaacctgtcttggccacaactagcaatttgttgttacaagaggtcaaccagagattgacctcgttctcacactgacaagcacatccatttttacaacttattgcaaacaggtcaacaagacgttgacctcacccacgcattcggaagctaaaaaaactttttacaagcagcaagcaggtcaacaaaaagttgagctgcagatgctgaagaaatgaagatatctgaactttgtctgaaaaaaaggaaaaaactctgaacatttcagaattcagactgacggattggcgttcgtcagttggtgcaggaagggaagacccacaccggcggcggccacttccagagcaggtcgcgcacggcgccgcgtggcaccttgtagctcccgtcggcgaggtcgagcacgccgacgtcgggaaccacctcgtggcacctctcgtgcgaccatggcccgtcgtcggtgaagtagacgcagttgcccttcacctccgggcagcaatccgccgggacgcacagcgacgcgctcttgcccaagaacagcgcgcgcccggcgaggatgccggcgccggcgccgtccacccgcgcccactcgccatggccgccgccggcggcgttccactcgaagagctcggccttgacggtggtgtactcgacgcgttcttgccggggctcccacttggaccgcgcgtgcgccttgtccctgagccggtgcacctggagcaggtgtcccggcgagagctcgacgaggtatttgctgcaggggatcgacatggagcacgcgcggccggagcagcagcacggcggcgcgatctccctgggcggcggcggcgtcgtgcccgccgccgtgacgtccatgtcccatgcctcgacgcgacccacggagtccagcgtgtacaccgcttggtgcccgtcggcggcgggggcggaggcggcgcgcacggcgtcgacccagcatcgtgatggcatgtcgaggagagtccacttcgtgtcccctgctctggcaatggcgagacggtacagtggctggcagatgagcagcacggcgtagccgccccaagaccccggcggcgtcgtctgcctccgcggcggtgcaacgaggatggccttctcgtagagctcgtacctgagcctgtccggcgcgaacgactccggcgggacgagcacctcgtcgccgtcgttgtctccatcgccgaagcagcagcggaggtcgtagctcgcgacacggccgtcggcgtcgcggctggcgtcgacgaagggcagcgtggtgaccgagggtagctggacctgcgcgccggtgagcgggttcaggaggtggagctcggaggcggcgtcggcggtgacgagccacccgtcggacgagccaacacatagccgctcagacaccggcggcgccggctgcgggatggcgtacgccctgccatcggagaggctcaagaacctcgcctccaagaacctaccatccccaccgccgccgccgctcgggctctgcctgcgcgccgtcgggttgaacgggagcatgagccacggcggctgcgcggcgcgaaaccgtgcggtggcggaggccgcatcagccgactgccacgccgtgcacacgccggggaagcggaggcggtccggcacggggaggcggccgagcacggactcgaggaggtcccgcgggaggtcggcccacccaggccgcctcaccgcggcgccgactagcttgttcatcgccattgccagagcagagcaaagctcgatcgcatgacaaggaggagaagatcagaggaggaggaagaagaagatgagacggtttgcttgttgggattgcaagaaacgcgaggcgaggtcgcggcttaacaatggccatgtcgcgccgttccgacgtgcggcgcggcccgtgtatttgtgggatgccgcaggcgcggcggtcagagacggctactagttttgggtgcggtcgcagcatgggactgagagggagagaggcgggtggtgcgaacgggaaggcacgcgaacgcgcggcgtgacacggtgaaaatcccgtgggcgctggtggtaaaacgtcgaacaggtcgtcggcgcgggcagctgattttggacgggatgatgagcaatttggtcctccaactttcttactcgtctcactttggtcctaaaagggccaatttggttcatgaacttcttcgctttttgcccttttgtttcagatattttggtcgtccagatattttgtcgattgttaaatagatgaggcttatagaatgtagtgaaacttgacatttctaattattagtatgtaaattaaatgttaaggtgtagtatgtcaaaatattcttaatagattcattatgtggttgtagtggtggttttcgtccagtttcccctaattaattgtgcgttgtatggtttggtttcctttttttttaaaaaaatgggatgtcttctttatataaaacattggcaacaaccaaaccgtttgaaaaaaaatggattcattaacggcctgtttggttggagggagttggtgatggggaatgggagtttatgatatctgggagtttaagtctgtagtttggttggaagacttgagaattcgagggggtttaggatggggaatgatggggaattaaaatgtcgaattcccaccaatctcttacctgggagaggcatgttaattcgtgagacttggagggaattcaatgtgaaaccaaacaagggatgaggactaaaaatgtaactcccatgaccaatcccaccattaactccctccttgaaactcccattcctcttcccttctcttgccaaactggccgtaagcactggagtagttatcttcaataatttttgttcacaaattattataaacattaatgatcgaatatttgttttgagactatgtagatgttcaaaacataaaaataagatatctcccaggttgtttctcgacttgtttctgtgggttttctgtgaaatatttaagattggattttattaactggttacaagaaatgctatttataagtaccactgagagatggagaaagagaacattgcttcttatccatacacgtccatacccaatctgcttctcatcaagtcacaccaattaaaaaatcaattcgagaaaccaaactaagtactcccacctttcctaaatgtttgacgctgttgacttttttaaacatatttaaatgttcgtcttattcaaaaacttttgtgaaatgtataaaactatatgtataataaaagtatatttaacaataaatcaaatgataggataaaaactaataattacttaaattttttgaataagacgaacagtcaaacatttttaaaaaagtcaacggtgtcaagcattttaggatggagggagtactagctctttaaccaaacagcccgagttcattagtagccgcacaaaagtatttcggtgtgtttttatggtaaatacttaatatagttaaatttgctcaggcttttttttttttgaattctccaccagacgaaaccgatcgttgattaaagtcaggggaccaagctgatctgtagtttttcttcttttttttttaaaaaaaaactgatcagtaacccttttctccttgtaattatctgaatttcgtcgtttgattgttgacttaagagcatcaccaacagactacttatctgattcccaaaactaatttaatagattttagtccaaaaaacagctctaacagatctcctactctattaccaaagttttagagttcccttcttccgatttctcgctccgtttatatgcggacgcgaaagttgtgcttccaatttcgcactcccgcccctctcctcctgttcccgtgcatgggagatagcgatctttctgcgcgtgaaagaaaaaaacgaaattttctgttgatagtttaacagaagagtccacttttaagttttggggattgaatttaggctatatgttggagttttttcacttcctattttcagtttaggaaaccaaaaacaattttttagggggagattatagataatctgttggtgatgctcaagcagtatccaaaatttaaaatttgaaacttaatcttagatctgattttgtcattttatcgtagcctactaattttcatcattgggttataaaccccgaacaatataatgtttttacccataaattaattttgttgcttcatttacttttttatagctcatcatctttttttttaaatggcagctctgtgacagtgcaatcctgttcattcagttcagtgcaccttggcccgcttcatttttttttctatagcatgaaggcataatggtcacttggcaagctaatgttgcggtactactcatggcttgacaatactaaccaatagggtggcatgcgcatttacacggctagatctactttaaaatttactaaaatgataatgggatggtcaaatccttaccatgccaatgagaatgggatggtcaaaaaatttaggtttagaaacgagtaaaaaaaatagatttagagacgagccatataaattccctcatcacgccacacaaacagaaggataaatttgatccaattacacacaaacagactcttctgaaaactgagggactaaagtaagcattgattaaaagtcgagggaccaaatcaaccaaatcaaccaaatcaacctcctccttcgagttatcctgattctgacggctgctccgttgacgctgttcattgggtaaacttgggttcagagcaccttcgcgcgctatatacatatctgcgtatttgttatagcaagtggcgtgttccagctcgagatgcaccggagataaccccagataaggatcaaaggattaggcaatctgtatgcgtacaggtcactgatgacctgtagatttgcccttgcttgatactcttccagtcctctttgatcctctccaactaagcatgctattactttaatagtttccatggagtaagagcatgtgattgtaatggagctgattaaataactgcaagcactagaacaaacaggggcatgcgacctgctgttgcagacctgagacttgcagctgtggttacaaggaagaaaggttgtgaacttctaccagagctgcatgttcagttcatccactccttcctttctctagaaacagagggaaaaaaatacagtatcagctagagatctgcaaaaatgaacatatatatgattgaagtgagctcttttacagcatattgaggtagccacaagtgacaagtcaattcaagcaagttatgcacaactactgacggccacatatgcattatttgctagtgaaataacagaagtacatatgttacaaactgcaagcttacaagttgtggaaaatgtcctttgtaaacatcagcctccttgactcatttgtcatggaattgcaggccacaccaactgcaggcaattgagcaggagagaactctccaggtgaagccaccatacttttgaaattgttgacattgttaagtacctcctgctgataaacaagtggaagctgtttgctgtcagaagctgagggaaataatgaagattgtacttcatatagttcaagaagaatgtctgtttctaccgacaagtattaactgactatatgaatacattgcactaccttgatgaactgaagaagaagaaaaattagtatagcacgctgataacatattttaactgaactaggccaacgcaacgtataaatttcggttaactgaactaggccaaaacagggtataaatttcagttaatcagaaaggtactttacatatcgagtctaagagtgccaaattcaacgataagaactgacacaaggaaaatttcagtgaaacacaacagttttctcaaagttaatagttccattaaaacccggaaccgctgaaagatatgataaataggaaaagttgactgaccaaacaatcagctgcagagatgaacttgtatgctttcaccaagcagtttttgtgtaataatacacacggtggaagaggcacaagtcatttattaacttatattgtgcatggaaacaactgtgaaggtaaggcatgtcctaatccaaaaggaggcctgcacagtagatcagaacaagcaggttggtcagatagatgaattaaacaatagcagtggtgtgccaaacagaatgtgaactggggatgtgtcatgtcaaacaagggtgtgttttgttaccattaccttggattagtagtatcgtctgtctttgatgatcggaatggttcctctcaggtcgcggcactgccttttgagctcctcgttgttgctagaacggacatctagtacttccagtgaactcggaaggccgcccttgggcagcgaacggatggctggacaggaccagatctttaatctcttgaggctggtgagtctgtgtaacccagtggggagggactgcagctccgagcagtaccaaaattcaaggtcctggagggaggagaggagcagaagtgccgcgctttgctcctttgtgaagcgctccacctcgtcgttccaactaatggttaggctggtgagtgaggaagcaaggaggctgcagatgggcgcggcaaggacctttgtgatgtcatctgtttggaggcactgcagccgcaaggagtcagagccacacccgacgaagaatttgggggtctcgaagatgttcaggtttgtgagttggccatgggcgaggagagaagacaagtcctcacctcttaaatccatacatttccgtatggttaatctggtgagagagctgaggtttgagagaggcgccagagtctccatgcctcccacaccatcaagatgcagatattgcagggaggatggaaatgggaagcaagacgaggaggaggacgagtagtaggaggagaggaaattggggcaaccccgaatagtgagtgttcttaggaagtgcaggccttgtaatcctcctcctatgcttcttaagcctcctgccatgccatctacgagagaatcaaactgcaggatcagctttgagatattctctatgtacaaatcctgaagttggtgaggcaagagcagcagtcctgcatcagctgctgctttctcatcctctcctcttagttgctcctgctcctgctcctgtcctatatgtgcatcctccaacttatgaccagaaggtgacgacgacaatgctgacattgccattgtctgctccttcgccacaccaagcactcttatcttcccacaaccttgtaatgaaaacattgacagcttggggaaaagagacagcaacagcgtcagttccttcccgctacagctacagtcatcgatactgagaccctcaatctgaaattggtagccgacagtgttctcagcttcaacattcaacaagacattacttgaatcatgtatcgtgggactcctcaaacatgatagcactaggagatgtttcagtggcaaaggaggacatttcttcaaatacaacactttcagttcagttagattactaaatgccaatacattccagaatgacatatctagatggccatcctttcccacaactttcaagcaaaattcagattggttattttttgagtaatccaaccgctgaaaatctgatcccacttcatcaataagaacacgacatggagagcttgtccaaggaatgtgaggaaatgatgacagctttggacaatttacaacctcaagctcccttagtgtagggaattgggtcaagttcatctcctgtcctgatcgagggcaagttgaatgtgaaaatggcaactccataagttctgggcaatctcttataatgaacacctctagcagggagaacacatgggaagcatcatttccaacccattttgctagctgtggtatgccaagcagctctaacctttttaatttttgaaagctctgacttgttgtacaacccaaggattcttcaccggacgcattaaccaaccacaactcacctagagggggaaatttgttccactgtatgctatccaaacgaagagcttgcaagtttttggtagacaagttaacacccaaccatgatgggcaagattgctatgtggtttaagattttcaagaacatgttctgcttgtgaagaatcatcagaccaaactaatactaacttgtgtaagtgccttttgtttaaaaggtttgcttcctcccctgtctgtgcattttcaagattataaatgcacagtgatccttttagctcttccaactgccctagttgtcttaatgcaaatgcctcagcttgtcttttgacttcaaatctccttagttcttgtaaacatttcagctttcccacactagtaatgtcggagtggagattatcgtatgggacaagaaaatgccgtagccttacaagattattcatgtctcttggtaaaccaaagtgacccctgcattgttgtaaatcaaggatccttaagtgataaaatcttgaaatggtattgggtagactcatttctgggaaatatcccttattaatccttaagtagcgcaaatgaataagatttgaaaagttgtgcaacatattttccaccacgtaagatggtgcatacaacaagacgacgcggagtgcttttgctttgcttaacaaattaccaagaggaatgacaaagcttccatggtattgtccaaatagcatcacagagtgaagcttttcaatatccaattgcttatgcagtgtgctgaaatccttcttgatgttttcaaaagtcactctatcatttacatccacatcatctatcacaatagacaagtgccgtatagatggtggaacttgaatagatctcacattagaactacttatagcaagacattcatatgatgaaacc

SEQ ID NO: 60792 - DNA, 758 bp, Oryza sativa
atgagtgatcgattcatatagggcgaattcgagctcggtaccctatatatatatatatatatatatatatatatatatatatatatatatatatatatatatatatatatatatatatgaaaattatatcctactaccgagagtaaatatacatgtattacaattcattatgtgctcgctagctacgacttcgacgccggtgttatatatgtcagaagaagaaggaccggcgttataaattgtcgatccgtcgtagtagaattcaccgtcgggatcaagaacttgttcgttgatgaatcgcatcaagttgttcttgagcagccacgataaatttcttgtgtgtgaggttgtccctcatgtgaataacctatgaatatatgaaattaataaacaagaaattgatatgtacgtaatgaaattttgaatgggttatatgtacattgtgctctcttgtgggatagatttgggttgataggatgtgtatacagtcgggtacaaaaatttgcatacggactttttaacaaacagatccgcatacaaaaacaggccttttttttatgcttcttaacaggttgcgcttgtgaaatgaattttggcaaccgggcctatattaattggatacattccaaatccctttacatataggtcttctttgcatgtgataaaaaaggtgtgttcacgaaaaaacattttctttatagtggcaggggatcctcagagtcgacctcaggctcagcgagagatctcagtttcatcac

SEQ ID NO: 60793 - DNA, 1093 bp, Oryza sativa
cccgtaatccaccgtactatacggacgacgacgcggtgcccgccgtgtactcactcgcgcgcgatcgccccgcggacgacgcagccgccacacggacgacgcggcccctgcgcacgcacgcgcaccccacgggaaactacgcgccccgcggtccgatcgacctgcctatatggctatataggacctgcctagacgtggtcgcgccagccttcaattgatcgatggatttaattaacagcaggagtagctaccaagcatttgcaggggtagtagtgcccggcctattggctattgcatgagttttccaaacctggggccggccggttttgcaaaccagccctgggaaaggccggacagctgagctaccccaaagttcttgcacaatttttgacaatttgaccctctgcaaaaactaattttgcaaatgaatcgtgaccaaaacttatttaaaaaggaaaaagtccgaattaccccctgaactattgaggtcgaccgaataaccccctcaaacttgaaaagcagacatttcgtacccaaaactaataaaaccatgtatttaacccccctaagctgatttggggccggttttgactggggaggtggacacgtggtcgtccaacgtacgtggcgacccctgccatgtcaacctagccccacacggataacccgaccggcgccatcccccttactctctctcgacaaaatttcccctttcctctataaaccctagtcggcggcgactagggcggcgattgcgggggtgactccggtgacggtgggcggtgacttcggcgacgggacggcggcacgctctgaggcagagagggcggcgcgttctcaggctgtctcaacccacgacgatgtcgaggagctcaggtacgtcgcagggcttgtcttcgtcttcttgggctggacgtggtgagggagaaaggcgtcacctgccggtgccatatagggaggggcctcttgattacgagcctccagttttttgtgagtgtaaaatgaaggcagctaggtggatttcctggagtcccagtaaccccgggaggagatatttaccggcctccatgcatgggggagtaaattttcgatt

SEQ ID NO: 60794 - DNA, 8318 bp, Oryza sativa
catacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaaaatgctcgacaagatgatcacccattcattaaaaaaaaacttccactgaaatattctaacactattttcttttcgtcaacctggtgaatagatggaaggatatcgacggagggaatgtaaagcgtatctccgaggttttggtcgctcaagagtatcatattcaactagttcctcagacgtaacatacctatgggatattcatctataaaaaaccaagtgtcaatggatcctacggagctattcgtacatgtacttcaatattttcatcatatggtcctcttatgtgtgtgtgtgtgcaagtttgaatttccatatattgttccatacttccattaaagtctcatatgattttcctcgaatttgatgaactagccgccaaaccgtgcattgtatcacttttcatatattgttataatatcattaatgtattggttatctatatcacttttcattgttctaagtcagatcgtgataaagtactggtagtttcattcaagttatacgttgaaagcatgtcacgagggcctttgactgaacctgccgaaacaacactggcgaacaaggcagagccattttggtgaaacaagatggcgaagcaccaaggagaaggcaaagacaaagctctttgccatcgccaccaccgtgccgaagatatacggtgccaagaatgggccgaaccgtcaaggacggcccacttagcagcccaactaggggcccatgaccaatttgtttttaattaagagcgtctgcagcataaacataaaatcgattttacagcaaaagaactgaaccatgcacgttgtagctatcgaactgtatgtgtcggataacaaatcgaactccagattggagtcgaaaggaactagtacaaacctattttactatgcatacgtgcgtgaaaggtagactagtgattggttgattcattttttgcgggtcccacaaagcaattttaacgctacagctatcaaactgaaattttattcggctcttggatcagatcagtcgaaccaaatactacagatgccctaaatatcgctatcataagactaaccatgtaaattcctctataatatgtaaccctagggcatgtaatctataaataggcccaaaggggcatgtattagggaaatcccaaaattttcaatcttaataaactgcttttgcttttccactatgtgaaccctgccatttagtaaacacagttgttattcgacaacagctggtgacgatcatggggaaccctagccgaaatcactgatgccaccaaataagtctgtgagtgagaaagtggtgcggatgaggtgtgagagcgaaggagaagtcgaggcgagcaagggcaaattggccgcaggggccgaagctgaagccgagtcatgaagagtcaaagctgggattcagcctgccagagcagagggcgaagctcgagtcgaagcgaccacaactcaagtgactgcttcaaccatagctgcggtgactactttcgttagtccagaagtcgacgcttcagcagccccaaccatagctgcggcgactactttcgttagtccagaaatcgacgcttcggcagcccaaggagcggagatttttttagagaaggatattttttacccggcctctatatcctaccggataaatgcagtatttttcaatttagaacttagcctatcaaatagggaacttaaccctcaaataacccaatctgaaatttgctcttatgaagatttgaactcagaaccttatggtgctacccaggtcactgcaaccactaggctacatgcctaaggaggggagatgaaaaccatgcggcaagacacactacgccgaatgcaggagcaacaccaggcgtacgaagcagctatacaagccaagtcaacagcttctaccaggccagctgtcacttcattggcaacgaccactgtggcattgactgcttcgacgccacaagtttcggctgcaacaacttcatcgctattgccaatcaatgcctcaagtctctccatactccaaatcactatcgcgcaatcgaccatggcaacatgcacaacttcaatcgaccacatcttccgcattttcacttctgaaaattaactagtaatttctgaactaatttgtgcataaaattcttgtaaaggaatcattgagataaacaaatcgataatttaatatatagattcatcaataactaaaacgattgaatgcttacaaagaaaagaaacaacagcgaacaaacgatatagcgacggcttcaactccactcccacaggcatccccattgtggtataagccaaacgtgttctctttcacaactttcttcaactgaggttgattgattattgcaaggtgagtacatcgaatactccgcaagccacacagcaaatatggaagtgcacagggatgcaaaggatggaataatagggttcatttgtaaaagcaacatttggcaaacatttgagaattgtaaaacattagagtaattaattatcaatattaatcaatcattaagcatcacacccatactacataggcccaactatctatgaacaaccattcccgattgcactgatctaacctctaaactaagaattatccattccaaaccatgagctaacagttatcatcaattaccatcttattattattattactagtaatttgcccgtgctaacgctatggaattttttttaatcattcgggtataacgcacgttatgaattaaatttaacatttgcaagaatttattatcttttgaagaatcaatgtctagactttgaagttcctaaaaagggataatacatagaatccagaataatcgaccaaaattcataaatattagatagacgagtttctgatttgttgtttacatagccaccttaaggactctattgtcaggttaaggtatgtcagaatatgagacaataggatcacagtatctagaatttctaccatcatatgtaacaagataatagtacaatagttataattcttttttttacaaaatcaaaacataaaatcattatagtaaagacttattagccatcaagctcatgccgttcgtcactgtacatctacaatactcaacaagtctaaaattataaggaacttcttttagccttgaatgcccagtagaatttctatagaaaaacgcgcatctgctgtttgtcatagtagattggatttggcaaacaactaaaaattctatccaaaaacacacatttgctaaagcacaatacatgttaagattgttagtgatatgccctagaggcaatcatagagatgattgtatcacatactatgtttaaatatttatccgacattgttccttgaaatacataactcattattggttaatgaatatgtgattctttcatgagactctttatgttgtttgttactatttctaaaggatccttgatcaaatatcatatgtggaacaaatatgtttaaatgatcagcacatgtattaattgatgatcatgtctcatggatcatggcatagagataccaaattaataatgtggacacatgttggtgaacatgttgttggatagacccaacatgagacactgcaaaagccatatgtgttgtgtcatcagtgatctcatcatggttcctaacatgtgtagtagcttacttagggactgctaaacgctactctaattctagaggttaaatccagtaagttattactgaaattctagaggttaaatccagtaagttattactatctctaattaactatttatgaaatcaagattcatcttacagggtcttttggtctttactgaaccttaccccacataactatttatatatctagttttgaagcccaacagcacaattaccatatttcttagcaatataaaatacttcttgctgctagctacatgatgatacaaataattttgaactataactaatctttctacttgtgagctaaatcaaaatatttataccctattgtttacacatgttctgcagctgaaattattatatgatccttttactgatttcagagatattcttgttcatattatgatggatgagaatgcaacacacaactcctacacatactagtatatgcatcacacaagaatcatgtcatgatatgatttcacttccattttaatcttctaattacctgccatgctttagggtgactgatatgttattcccttctgactttgcagctgctcctctaaactatggttcaagggttctcctgatggaactctgctggaacaccacttgctccttcttcaggttggtttctctgctatctcacttcagcatctccttgctgctttggtttatatggtaagataagtgaaaatcttgattggcatctggatttgctacttcccttggttttcctggagtttatcctctttcttgatttctgctccatcttgcttgagctactaatggttgcttctcctactactcctctgacctctcattcactcaccctagcctctcctggctgtacacacaaggctgctacggctgtggtgaagcatgggtgagatgttgaactactgatttgctagctgtgattatttctctttagcttgagttgaatccctagctgaactgctggtgttgatttccgttgcggcagctgctgctattgctctactgcggcaggtgcttgaggtggttttccaaccgatgcaaccgaggctggggttcactgaatagcttggttgatgtatatgtgaatttggtgaagactaggtgactcacctactttagttttgatggttgtttactgactgacacctaagcagtgcttgatcggtggagtaatgtgggatttcactaaattttttctagttagataaattctgatacaattaggtacttttacacttgagtccctcggggtctctaaaattgaagggtactctgagattagggactgatttgtaattgttctagaactcaagagtttttctgaaaactaaatgattattgaatctttgactgaggtgtttcagtttatgatatggtatcaataaacaccttatatatgcacaatatatgcgatgcatactgtataagatttctagagtacaattatatgcatatatgtatgcagacctgtagtggtaaattgtaaataacgaactgtggtttctactgtgcacatgtgtagctcacttcgtgacgactaatctatgctataatttaaccaaaactaaattatcccactcctcactaggtctactctaactaaaaataatgatgcatatggatatgacttgataaataaatgacaaggaaacgatcgaaaaatcatttaagatccataatagaacaacaatcaacatatttataggtcctagccagcatcgtggctcaatcgacaccgctctcagccagtgtgaccaagtcatttgcgtgactaagactatagctgatatgatctttatgtatgtccggtgggtcaatacgttctgctaggggccgctgttgacatgtggaccgagaaggagttttcggtttacagccgagtgtacatgaacctacagggtcgcacgcttaatgggccaaaataaggggattggatagagatctaatatgagcttaattcggatagggatccgaataggagtcctacgggccttggaggcccgagtgatggattctatatattcgtgaggggtgtgaccggcggaggtattgcatcacgtgagaaaccctagctgccattttcctccctgagcaaaaccctagttgcgcgcgggtgctagcacatctgcgcgtggcattccgtccctatacgtgtggataccggtagaggcaccgctggtttgcggtgctgatcggcgtgggagtacggcgaggaggacgcacgaggaggagaaggtcgagccggtgcgattgactacttcctctacatcgacgcgcgctacatcgcgagggttccttcgactccttagcgctttcttccactgcgcagcgcgtcgagtggtaacgatctatgatctaatgcttgcatggttcctggtttacgcggtagaaaaattttgatttatgctatcgtagcctacgcatatcccaacagtggtatgagagccgccttgtattgtttatgatctagatcattgcatatagttgatatgcgggtgtagtagatgagatctattatattgtatatgagttcttagatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaatttttggtggaattttcagagcacaaataataattattaagaaataaacaaagttaaaatggtttcataaaaagaaaaaccctaaaaagtctttcccccccccttttcccctcttgggccggctcggcccatccctttctctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgtcgtccacgcgcgcaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcacccccggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcgccccggaccgcctcccacctcggcgccggctccttcggcttcgccgcatcctcgccgacctcgtccacccctccgtttcggtcgccaaccgccggagcgccgccgaccccgttgacccgagccgagccaccgcctccctccgctccggccgcctcctctgtcgccgccatcgccccggggtgagctgtggaccaccgcctcgtttcccccttcccttcccctctctcggccgctgctccgccgtgcctatggccgccgccgggtgaccataggggtgcgggcgcgccgcctcccgccggccgggccgacgtggccgtcttcgggcgcgccgagcggctgccgcgtggggcccggccgtcagccgcccgtgccctcgggtgcggctgacgcgtgggacccacggcgctggccggtgtgagcccgggtgcacccggtccaccgtggaccgtgaggctgccgcgtgggccccactcccgtggacccggtccgcgcgccctctcccctcggctgacgcaataaaccctttttaaattaaaatttaaataaagaaattcgcaaatatccatttaaagagcatataaacttcaaatggccataacttggccatttgaactcggaattggaccgttcaagtctctaatttttccttaagaagtcaagaatccatttttgtgctttgttcctgctttttatatggagtttattagagtaaaagccttttgcttttccgttggtcgtgtagacactgcagcttcggaagatccgctcttcgtggaggttgaagccgacgtttgggaaagcgagcaaggcaagtcacatcatccttgaacatattgaattccagtttataaaattattttgatttaaattaatgcattatcgctttatttaaattcccgcgttatcactgttttatttagccatgcctatttacctttgttatgaccttattattatttctattgttattattaccttgttcaccctagaataaacaaaaccccaactactgtgcactctactcaaggttcccctagtatgaatttaggtagatgcttcgctggttaattaggcaacattaggtggttttacaactctagactttgggaatattcatatcacttggacattatggaa

SEQ ID NO: 60795 - DNA, 1837 bp, Oryza sativa
ccggcgcgaggaggtccaacggccggctggcgatgcggcggcggagacacgggagaaggggaaggcggcagtagggcgaggcggcgtcggcgggctcgcggtggcggagtgacgacagcggctgcgacgcggggcgaggaggtcggatggcccgccggcgatgcggcggtggcgcgcttgtagtagtcgtgcccggcgcccatgagcccgccccaccattccaggttccacgttgtgtgtaaagtgtgtgtgagagagagagaggaggaaaggagaggaagggagaggctggcttgctgacgtggcatcctgacatgtgggacccatatgggtcccacgttgactcagctgccacgtcggacaaaactagggtcaaaaccgctgagggacctagtttacactggttttgtaagttgggggatgcgttatattcggttttgcggttgggggatgattttgtaagtcgatgacaagttgagggaccttcggtgtactttttcctctcctctcggacgtaatctgactcggacaagcccagcctactaggccacacccggacttctgcaatcacacatcctcaccattgttaggaataagttcatttgaggccccttagctttacccgaatccgatttctgtcaatccaaaaaccagatacaaccggtccctgaactgataaagccgatttttgtcaccattgttagctgttgttatggagcccccaaccaactatacatccgccactgattaagaattcaaaccaatattgatttggtggtaattctctatctagtactacatccgtcccaaaataagtgcagccatgagaatccgtatccaatgtttgatcgtccatcttatttgaaaaatttatgagaaaattaaaataagttagtcacacataaaatactatttatattttatcatctaataacaataaaaatattaattgtaaaaaaaattcaaataagacgaacggtcaaacgtgagacataaacagtgcaaaactacacttattttgggatggagggagtacattgtctatttcatggtcataaaaggaccttgttcacactagacagcaagcagatcctcgctgggttcaaactatcgatcattttcgttattggtactggggataccgatataaaatttggttaaactttgcaatttttttaaaaaaagagtccaaaacttcggccaaataatttcgtatcggatggaggacgatagaaccgaaatttcctgatcctcatcgatttaagccttgtttagatcctaccctaaaattttttaccctatcacatcgaacgtttgaacacccgcatgaagtattaaatataggctaaaaaataactaattgcacagattacgactaatttacgcgataaatcttttaagcctaattgctctatgatttgataatgtggtgctacagtaaacatttgctaaggatggattaattatgcttaataagtttgtctcgcagtttacatgcagaatctgtaatttgttttgttattagactatatttaatacttcaaatgtgtgtccatatatccgatgtgacacgccaaaacttttcacccctggatttaaacacccccaccctggatctaaacacccccttacacaaggggcttaaattggccaacaatggaagttccatgttttccggtatgtgttctactccaagatttcgatcaccagcactttgtcatggatgggaaaaacagaggaagataacatacatcctctaagtgaagaaagtcataaataatactccagtgctagaaatatattcatatattctctgtagacaaggacatgagggctt

SEQ ID NO: 60796 - DNA, 733 bp, Oryza sativa
  unsure (1)..(733): unsure at all n locations
agagcgtnattgatgatacaccttcatgcttgcctgcacgcacgactatctatagaggatccccttgaaaaaaaaaacataagattttctttgctgtcccaacttttttaatggatataggtgagacacaaactgtctggtggttgggtagatatctagccgccgggtacctcatggcaatatctggcgctccagaccagggttgactctatcgggtgacgcttttgtatagggggtcaccgaaatcccgaaattttcggaaatttcgatatgatatttccgaaattttaagcaaaatttagttgaatttgaacaaatattacccaaattcatgaaaaaatgaaaaatttcggtcgaaataatatcgtatcgggggtgaccgaaatgaccaaaattttcgaaatttcaaaaatttcagtccgaaatttccaaccctgctccggtccttggccggatctggacgacgggatggttaaggcgctaggggcacgggatgaggaaaggagacacagatgggaaaggtggaggaggctccaaaaggtggtgggaggagccgactttggtccgccacctctgcatctgagaggtttctcgcggcctctgcgcaacttccatggccgccgcctctattgtaccaaaggagaaaggaggtttgatagttcgtcggcgggaccacaaccctgcatcggcccacctctgggaggtcgcccgcgctcgggaggtcccgcataag

SEQ ID NO: 60797 - DNA, 630 bp, Oryza sativa
ttagcagtctcaaaagacgagtcataatatagacaaaaacaaaaccatcgtaatgacagaaatcttagtgaaactgttggattagaaaaatgaaacgggttgaatgttaagccttaggggagtaacctggaacataaacaagggaatgtgccatggtaacatgggatgtagattaactgtgaagaaatagaaaattatcccaaaactccataaggatgacaggaatatgtaactggaccaatttggcacactaagcaactaagaaatacccataaagttaaaaacttgtggatgaaagacacacaaagataagtatacagttttaactttgtgtacataccttcacaagacttggtttcaactcccttgattgatgccctcgatcatttgaaactctattacttgtatctgcagagaaatttctggtggtatggttgctacaccagcctgctatgaactaaaaacaggtgtataaatggaaggatgactttgtaaaatgggtgtaaaatgttgtccgaaggaaaggacaaaggagaatagtacctcaatttgtgaactctgtatcctgcacaatgtagagagcagtgagattagtaatagaattagccaatggctcaaaggtagcaagaa

SEQ ID NO: 60798 - DNA, 2340 bp, Oryza sativa
atctgtgtgattagcacgtggcaatcgtgagacttcattccaaccagctttggatcctctaatttaacgtgcttacttattctcgcacaatagcccgaaggaactttaatatctgccagacatgatagcattgcgatcttctcatccttcgacaatgtgtggcaagctggtgggaggtacactcttcctgtcttctcatctgtaacaggctgaagttcactacgaatgttcatgtcctatagatcgagacgcgcattcaacccgtcctttgtcttgctaggcatattcaacaatagccctagcaagctatcgcacacattcttctctacgtgcatcagatcaatgcaatgacggacctcaagatcttcccaataaggtagccgccaaaatatggattttttcttccacaacctattcttgtcctccttgctacgttttcttttcttcccaaactcattagtaatgtccttcaccatattgtgtacctgatctccggacaaatccgcaggggcagacccaagttctttcttaccattgaaaattttcttctttcttctaaaggcgtgccgtagggggagccatctcctatgacccatttaaaccatctttcttgatttctttagccacctactgtgtgtatgttccatacagtcagagcatgccttctttcctttcacggtttgtccagaaagattacccagcgcgggataatcattaatggtgcagaacaatagaacttgtagtgtgaaagttttctgaccatatgcatcccaagtttccacaccctatttccacagaatctcaatgtcatcgataacaggctcaaagaacacatcgatgtcattgccgagttgtctcggaccttggattaataagcccaacataatatattttcttttgaagcacaaccatggcgggaggttaaagttcgcaatgagaactggccaagtgctgtgagaactgctcatgtctccgaaaggattcatgccatccgtacacaaacatatcctcacgtttctggggtcggcagcaaactctttgtgctttcgatcgatattccaacattgaatccaatctgtagggtgtcttagcaaaccgtcattccttctctctgtggcatgccaatgtactaactttgcttcagtggggttggcaaatattctcttgaaacgatcaatgattggtagataccacacaaccttcgccggaccaccccgctttgacttctttccctcgcccgcgctcttctttcgcttgtatcgagaagccttgcagacaggacaagcatctaagtccgcgtattgcttgtggtacaatatgcaatcgtttggatacgcgtgaattctccagacctctaaccctaggggacagagaacctgttttgcttcatatgtcgtctcgggcaatgtgttcccctgaggaagcatgtccttcagtattcccaaaagttttgtaaaactcttgtctgaccatccactactagccttcaacttcattaggtctaatgttgctgataatttggtgtgctttggcttgcatcctgcgtatagaggagtctccgagtcactgaccaacctgctgaacttcatggaatctctctcgttcatagctaggtcatcaacgtcacgtaacatgtcttgccgcatatcagggtccacatcaaccaattcaccgcccaatggagatgggacaaacatgtcatgctcttctcatctacttcttcatgattgtctgcaccacttctgtctgctgctgcaccattagtacccagatcttgctctccatgcatcacccaacatgtgtatctctccatgaatccccggcgtatcaagtgagcgtgtacttccttttcatcttcccacaaaatcttattcctgcaatcgctacatggacaacacatgtacttggtggttcttcttatcctatccctctctgcgggtttcataaaacttaatacgccatctctatactccttgtaatgacgccttaagccagtcgtgtacatccaacttcgatcccatcgttgacaatgaacaaaatattagttaacatctcataacataagtactactaaattaataggaaatgattagtacccttttacttacttttatgatttttcctgtttttgtttgcaaaaaaattacaaaaattcgcccccttcaacctcccaccaaaatagtgaacagtgggataaactacagacaacggactactggagtatatatagtgtgcaaagtatatctcaatcgggccaaaaaaatgtcatttctaacgggcgcacactaatctctaactggtacaaatagaagcccgacaccgataagagtcatcggtgac

SEQ ID NO: 60799 - DNA, 780 bp, Oryza sativa
ttttccgtcggccgaaagcttccacacaaagctgtcccgggaatccggctgtagctgaattgcctcaagccgatcccacaagtgcagcgcctgcatcgaaagggcccccttgatgtcatggacggacggacccaaccatatgagaggaagctaagatgttaggggtctaatctgacggccggtgacagaaatggaatcctatattttacaatcaactgattttctttcttttacaatcaactgattttctttccaagaaaatatttatgatttaaacatgttatgtaaggagagttggagacagatagaatcatcgtgtttcacgctgggcaccaaagaacagttcgtctaatcaatcaaaagcaataaagctagcgcactaggattacacatgtggattcacagtgaaactttgcagcatgcatggtcccgtgtaaaagttgattgattattgtactatgctaatgggtggacactgtgattagggactgaattatgcagagtaaactccacgttagtaatccattaattccccctctccctttaaaacctgccccttgcattctgttgatgagcacctgcgcctcaccttgtctagttagcaatggcggctgatcaccttgtcgtggccatgcttctcctgctggctttgtcgccgccggccgttgctgacgacacggcggtgctcggccagaaaggcggcgtcgtggaagggcaggcagcggggccggggaggtacgccgtgatattgaacgccggcagcaccggcacacgggtgca

SEQ ID NO: 60800 - DNA, 31848 bp, Oryza sativa
  unsure (1)..(31848): unsure at all n locations
ttcaaaaaggaccaaaatgtaaaatttcagagcaaaatcaagcatgccacattccagcctcccaagggaaagtatatgttaataactatatcttaaatgaaaacttaaaaaccttttatgtaaaagtttttaaataagtctttaaaaaaatcagacatgttggtaatacgtaaataaataaccttacaaagttgcatgaacaaatttaacttcactaatgagttacaaaattaacaaataacactattcatttttttctttttctgctatgtttctcaatttttcacagatgaagttcagtttatccttaaaactttacatggttgttcaatttgtgagatttttttttccaaatcttttgaaaacttttatatctttgtttgaaatgtaaaaatgagaaacatagaagaaataatgatattttttaaaaaaaataaaaaataaaatctcatagatagctaaggtaatagtactttgacaaccatgcaaagttccatgaataaacttaactttatttttgagatataaaatttgagaaacatagtagaaaaagacaaaaataggaatattgttatttgttaatttatatatcattaatgaagttgattttgttcatgcaactttgtagggtcgttcatttacatattacctacatgtgtgattttttaaagaatttttaagaacttttataaaaaaaaaattcaagtttccacctaggatgtgatttccaccatatactttccccatcaggaataacactatatgtgcatcttcggtaagtgtaagagcatctcaaagagaatggccaaatggctctccaagctaaaatttggcaagtataaagaaaaatgccctccaacagcctctctattcggttggctaagccgtatggctagccaaatcacagcactcactggccaaacttggagagtcatttcggctggccatccatgggctccaccactcctaccatctctctctgcccaaatagcagaggaccatggcagtggtggtgttacagtaggcttccttgtcgttcgccgccgtcagctctcgccttgtgtgcgtgggatctgtcgcctgcctcacgcgtggggagccacagttgcttcgccgcccgcgcgtcgccgctgtcaccgcccgcgcgcgcgcgaagccgccgccgccgtcgccccccgcctctcgcacacgggggagccaccgcagccgtcgctgctcgcacgcgcggggagccgctacagccgttgctgctcacctcgtcgccgcccgcgcgaggggaagccgccgccgcctgcctggcgtgcggggggatccgtcgccgccgcagtcgatgggctgatgcgggagaagagaaagagaaagaggaggaagaagaaggcaatggaggttgacatgggtcccttttttattttggagatgtaaatagagagactattggagtgaatacctagtttgactgcccaaatcagttagagagttggctataagagtatttaaagagtctaatttagagatgctgttggagatgctctaacagagaagaagggaaaacggttcaagatcctaagaggtcaccgaaagatgtcctctaggatttgaggtcttacgaaatatcctcctgatctccaacagatcagacatgtctccatatagtgaaaaacttcgtgaaggcccaacccgacccatcaatcataaaaggaataagtccatcttacctcactcatctctttcacttcgccgaataacatccctcaaccgcaaaaccggctataatacctcccccatctccgtaaaccggtgcaaatcgactcctccggtggttttgaaagcggtttatgctgatatggcaggttgacttggtccgaatgtgctgatgtggcagccatgtcattaaagggattgaagatagaagtgggtcccacatgtaagtgacaaatgctaaaacaaaacggggccccctgtcagccccatttttttcttatcttcttcctcctttctaccttcttcttgcagccgcacgcacggaggccgattcggccggcttcatccaacactggcgccagttgatatgaggtggaagtcgctgacatgtgggccccaattgccaactcagcgagtcaaccgcggtctagcatccatgtcagcaaatactgcttgctaaaccactaaaggagataatttgcaccggtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaagaaagggggaaactacatccaattcgaatccgataagaagaatcaaatccattgcgtgtagaaatggagaggaacgaattcgccggagatctctggttgttgtttccccggaccagctggtgcatttctccctgatgggaagagaagccagctcggttacaagccatggctccgcaccggcgcgtccggcttctacaccggagctcctcgcatcctcctccttcagtaacggcagcgacaaggttctataaataatgcttgtttgcattgtttgttgatatagaggtcgaaaataatgcttccattatcgttgtctagggagtggattttgatatcccgaggggacgacttctcgttgtttgtacgtcactcaaataattatgaaaaaaatttaaaaaatatattaatatgttatgttatattatatttaacttctacatttcacaacgagaaaaacatattaaactacagcttgttaacatatattcatatgtcaaatttattttttttccgttgcgagatgtaaaagttaaatttaaacttgtatgtttatggattgatatatcacatgctaatacatcttcttaatttatttttcataattatttaagtgacatccaaacaacgagaaagattccacattaattatctaaagcctcaatctctactcactactggagaaaccatctttggtcagttgcctaaaatccacaataatcctggtttgaattttaaccgggactaaagatgactttagtcccggttgaaagagctgacatcactttttactctttagtcccggttggtaaaatcaaccgggactaaagatcatttttagtcccggtttaaaagaagacagactgtgtcagacccttctattatctttagtcccggttggtgatccatttttaatctcggttccttataacaaccgggagaaaaaatgaaaacgaaaaaaaaatcgcagagcaagcgccgcgcctcctcgtcctctcgcgcgcacagccttatcctctcatctctcctcgtctcccttcttatcttctccaatctcctcccttctcaactcctcctcttcccccttcctccccttcacctctcctccccctcccttgcgggcgcggcgcgcggcggacggtggatgcggccgcggcggcgcaggcggtggcgtgcgacagaagcggccgcggcagcggccaggcggtggttgggatgcggcctggcggaggacagcagccgggtagcggaagaggccgcgacggcggccgggcggcagctaggcggcggcccggtggagggcggcggccaggcggtggctgggctgtggccgcggcggcgcaggcagcggcgtgcggaagaagcagccgtggcggcggctaggctgcggcctggtggagggcggcgggcaggcgacggcggcagtggaggatttgtttattttttggatttgtaatgaatttgcttttgagaatttgtgatgtatttgatctgtgtgcgatgtaaatatgtgatgtatttatgatgtttgtatttgaagatggtggatttgtaattgatcgatttgagatttagagatgatgttctgttatgtgattctgggggatgtggtgaaatcaatattcaaagtagaaaacaatacaagaaaagagaaactaccaatcagatctgacttcatctttagtcccggttggtaaatgactttatttttaatctcggttggtgttactaaccgggactaaaaatcgatctttagtaccgggtatttgaaccgggactaaagatagcgatttttagtcctgcattcgtagtctcgatcgaaaaactaagactacagatggttataaaccggtagtaaaaagcctttctctgctagtgacttgatccgatcctctctctcttcacctcgccgccagcctcgggtggcgccgccgcctcctcttcgtcgttcttggcgacgacggcggggctgctaactagccgcgcctccagctcccggttcttctcctccagctccgacagctttgactcgagaaacttcacgtactcccttgctccgatcagtatcgacgacgtcttgtctttctgccattaaaatggatcgagaaataatttaagcaaatattagtgaagatcaatactaatcaattaatacggagtagaagaaaatgttcatgaatatgcatgtatgcatatgcacgtgtatacgttcgtgtataagccagctataaacatatttcgaggagataaaagagaagagagaatggtagcgagctacagatttgtagctaacttcagcacggactccaaggtgcaagtgtatatgacatgtgggaccagatattaattatatagtatatgtttataattaactattatattagttggctattaagttggttatagataatttgaagccagcagttgactgtactactgtattaaacttgctctaattaataattgtacctagcttggagccgggagggaggacgtacggcctggactggagggcgacgaagctgccgttgagcttctcccgccgcttccgctccgacatcgtgtgctgcagctggttgctggacggcggcggccgctgtctgctggtattagcactggcgtacgcctgtacattgttgccgtgtgcatcttggtcagcaccgattctatggctgtgtttagatcacactaaaattaaaagtttaatcgaaattaaaacgatgtgacggaaaagttaaaattttgtatgtgtaggaaagttttgatgtgatggaaaaagttgaagtttaaaaaaaaaactttagaaccaaacacgctctggccctgtttagttccccaaaagttttcgccaaaaacatcacatcgaatatttagacacatgtatgaaacattaaatatagattaaaagaaaaaccaattgcacagttagggggaaattgcgagacgaatcttttaagtctaattagtctatgattagccataagtgctacagtaatccacatatgctaatgacggattaattaggctcaatagattcgtctcgcggtttccagacgagttatgaaattagttttttcattcatattcaaaaacctttttttgacatccggttaaacatccgatattaccacccaaaattttcatttggcaaagtaaacggggcctctatctatagaactggcacctagctataatctttaaaataaaaaaatgtgtcgccgccgtctggtggagctccgacaggaagatgacgccgctgaccgtgacgcccgagaaggcgccgccagcctagcttcttgcactgttcaactcattattaatcgattttgctatatatttgtcgacaaattttcccctaaaaatttgacaggtgtaattacagtacaatcgtaatataattacactgtaacttgcatgtaattacactgtaactatagtgtaacttgtatgtaactttcaaaaatctatccgtaatatgttatttcggtaaattggaggtcgtgggaacaaattctttcacatatgtgtgtgctatgatttattttctttctcaccaaaataaatcttgtaatagatctaatgatttaaaattatgtgaaacttacatataagttacactgtagttacatgcaaattacagtataattacatataagttacagtgtaattacactacgattgtactataattatatctattaaatttttagaagaaaatttatcgataaatgtataggtagtctcttattaattagcgtgcctctccgggcttctccccatccccatgtacgagtacgaccacctcccgcccccggcgcggtggccatccaagcgagagctcgaatcaaccggtccaagaaggaggcgccccacaccaactttgtcagcccgcgccgctggctatgtcaccaccggccgtctacatctgcatctcgttatagtgtaattatgtgtggattacactctagttaattacatagtgtagcatttagattgtaatttttattattgttctatagtataatttctacttattgtttatacatgtgcatctctccctgcttcacacaatcctggtctccacaaccacattgaaatagtgtagtaagccaaatgcgtccttggcccgaggaaccgagaaagttgcagctaaacacaagagtaattagtgtgctcacggataacgaatcaacagagaacgtgccaaagaatcacatatctcaagatgggatctgatggtaaaaaaaatcgtatgatacggtggaaaaaaattctgtcaaatgatttatagcaaaaccgataaaatattataaataccggttttccctttaaaactgacacctatagttaattaaatatatcagttttatatatttttattccgtgaaggttagaggtttaaatgagagaacttttatgttacaatatactacaagtatatactagcagtataaatgatagaacgatatagattgtagctgcaatggcttcaactgcgagcttcttagcctcatgattatgcgctctgcttgctgccaacacacccaccaccgcagctgcgcctcccgctatacttggcctccccgccgtgccgtcgttgcctacacaccgccgccgatgtttgtcgttcggtcaatgccatgggtcgtctctctgctccggatagattaggcatctacgatcaatttgacaattagaatgaagatgaatcacgaattactaaatacccctttaaatttggcagggaattccaaatgtgtcctcatttataatgttagtatatactattagtatatatattgtaccgtaaaattctcttaaatgaaccaacacctataaaccgataattattagaagtgttgtagtagtgcgtattggctgaacgcgccaccgatcgctggcaactccatcgccggtgacggtggcggtggcaggctagcggtgtaatggttgtgctggggctcgctcgttgcacaccaagggtggtggtaacggcacctgcgaggagacctccagctactggaatcccgtcaccgccaccaccgccgacaaggtctttgggctgtatgacctattagggaagagatttgcttcagtccaacaaaaagtatctcgaggtaccagtacctcacggtatcaaatcgtttccgatcgttggatttaagaatatctatcttgcctaactagatccaacgatcgaaaacgatttgatactgtgaggtaccagtacctcgagatactttttattggaccggagtaaatctcattagggaagctaccggcggcgacagcatgcatggtgcgtcgacgaatgcatcaggaggtcgtccaccatggcggcgccgtacaccgcggcaccggctcaccgcggactgatcatcgtcacatcatccatgctcaagctcatgctgatctgcatgtcataatccaaaacccaacaaagttaattctacaatatatttctttgatcttatatgcattgattgttcatgatcgagctagttaatcaataaaaaaaattgtgatataagcttgcctggttgaaatggcgctgaatctgcgaggagctgatgaacagccgctcctgctgctgctccctttgctgaaactcccgggggctgcagctgcaataataatatgcacgacagaacagaggaattcacagaccatatatacattatcgtctcgatcaatcgtgatttgtacagtggtgtagaattcctttaccagtttgacatcatggtcctttacttttcagagaatcttgttataatatttgtgtctgctagctatgactgacgacgaacgttacagtagtattagtcaactttcacgcttgattcttaatgttgacctgaagttactaaagtaccacgttaattagccctccatcattatcgatcggccatcatgcagacttttggggctcgcaggatcgtcagcagagtgaagtaattaattgaggtgtcaaggctaattaattcaagccgtcaagaacattgcatgcccacgtattcgaatcaatttgtttggagagcagttcagtttttatttagttaatttataccttcttagaaccatatctaatatgtttgatggttggcttttgagggttgacaagttcagttctcatctgatctatacctttctagaaccatatctaatatgtttgatggttggcttttgacggttgacaagaaaaagagtaaactcatacttgtaggagcatctgccatatgttgggctctgtggttgagtaaaaatgatatggtatttgacaaatcaccatctatctcatatttacaggtaattttcagagcaacatattggctccgatgttgggtacaactgcaaaagtatgaagatgatggagagcttatgaaggttgcatgtcttaggcttgagacgacagttatgtaactttctgcaaaatatagatggagatttataaatagatttgaataaatgtgtactccttatcttgatttggtcttttattttgttgggtgtgtttatttttattttgaactacactcttcgttagagtgatactttgcaaggccggaatgttttattccattatctaaaaaaagtatgagtatgtgtataaggttttccattatcttagagagaaaaatgtgtacaatcataccgtcaataatgtacatgaaatttcttcttttcttttctttttcttttttctgatcaacgaggtgtgagacagctttggcgtttgacttcaataagaaaatgtttaattagttagttagttataccttgagctgtaatgttaggtttgcactaggagggcggccgccggagccggcgctggtgctcatcgccacgaggctggcgccgtcgccgatctgctctctcaggcactgcagcgtccggagcacaacgtccgtcgtgctcatgcctccgccgccgccgccgcgcaagtccacgttgagcgtgcaacaagtctcttgatctcctcctgtcgccgccgcagccgccgctccgctgccgccgctcgtcgtcgtcacctcgatctctactaggtcctctcgcttcgtctcgtcgccggcttccgccgccgccgtctcgcctttgtcgttcttggcggcggggcggctggctagcctcgcctccagctcccggttcttctcctccagctccgacagctttgactcgagagactttatgtgctctcttgccctgatcagtatcgacgccttgtctttctgccattaaaaaagagaaatattttaagcaaatagtacggtttttttttcggtcagataatacttgtcgttttggataagcgtgagatcaaactttagagtatttaattatgaattatttttaaaatatttattttttaaatatggtaactatagtaaatatatgtatatagagtagtcttaaaaagtactttaataaggttatatatttgttaacacttttatatatattataatgaaaaataatggttaaagttgtttatttaagatcgtgccttttacaaaacaataacccatattatggaattgctacgtatctgtcgacagattttctattaaaaatcagtcgatttgttgaccgcatgatttactttgagatacgtgcatgtgccattgagtgaaaaaaaaaagtcgctagaaaagggaatcaaacccatgacgtcgggatgccacaacatgcactccaccaactgagcaagcagcggacaacagctttatgtctatacttaacatttttaaaactttcaatgcagttacactacacccactcacaccattgttataccacgattaaaatgtaagtgcactacagatacaatgtaatttttaagtacatgcgggtgtagtttttgttttacatgtacggatttactcatcgttgttttgttgcattgtagttaacttaattgtttgaggtgtgatttgatatttttgggactatatataccgttgtatttttcataaaagaagttttacattgcaagtacccaaagttacatatgtaattttaatgtatttacactgtaagttttaaaattacatatgtaagttgatgtaaataggtgtaagttgcttgtttttccttttcttttagcatcattgaagtgattaacgtccggtgactgacgtacgttgatatgttttcatttgaaccgcacgtgggggtggcttgaaaatccgactaattttctacgaaaaatctgtcgaatgatttttagtctgtctaaatattattaacccggagagagtattagtcaaggtggtgaagaaaatgttcataaagaagctttgcacatatatatatgcacgtgtaatacgtacaaactagcatgatggcccgcgcagattgcgcggctagcatcattatattttctctcatataatagcatatatgttttctcattatattattcaaatatattaaaataacaacataattttaaattttgcaataactttacaaaactactaatgtgtaatattcatattgcattttatatatgtgttagttattaattatttttaagataaaattttagttatttgtaaattatatatattcctatatggactctagactcgtcttttaatatttcttttttctgtaaattgtatttctatatagactatatgttcttcttctaatattatttatttttatttctgaaattttattatttctaattatatttctatgtggactctaaactcatctttcaatattatttaatttttaatttcgaattttagttacttctaaattgtattcctatattagcattaaactcttcttcccattttttcttaatttcgaattcttttttctgtaaattgtatttctatatagactatatgttcttcttctaatattatttatttttatttctgaaattttattatttctaattatatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatagactctatactctacttctaatattccttatttttaattccgaatttcagttatttcctaattgtatttctacatggactctatactctacttctaatattccttatttttaattccgaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgttttttctttttctccgattaatgtgagaatttctaggccatgagagcgaacgtggaggctcctttttctattcctttaattatataatagatagatgtactggagtacgtattaattttaccttggagccggtagggaggacggccttgagggcgacgaagctgtcgttgagcttctcccgccgcttccgctccgagatcatgtgctgcagctggttgtcggacggcggcgccggcccgcctcggccgccgccgccgccgccgcttgctggtagtagtactggcggcggtacgtcgccgccacgtgcatgttggcgagcaccgacatggccgtcttgaacatcctctgcccgcacgctcccggcttgggtggcctcctcgggcggaggtgccgcgcgtagcgactgaacgcgccgccggttgccgccggcaactctggcgccgccgccgccgagctctccgggttgcacgagacggaggcggagcggaaggaggcggaggaggacgtcgtcgacgaggagtactggaagctgccggcaccggcgtggtgcgccgacgaggaagccatgaggaggtcgcccaccatggaggcgccgtcgtacaccgccgactcgtcatccatgcccatctgcatgctgatctgcaaaccatatatacctaccaaattagattaatcctatcattttgattgattttatgcattgttgttgatcgatcagagcaaattaagcttgcctggttgaggtgttgctgaatcggcgagctgaccagctgttgctgctgcggaaactctactgggctgcagccgcaagcacgaacttaagtaggtaactaactgatcagccaaaaccactcaagaacagacgatttacagagatgatattgtcgttgatcgatcgtgtcatgcacggtgatcatctcatcaagatgttttaattcaacacatatatacctggcagcgtagccgcacatgaagccgctgttggcgccggtggcgttggcgtttgtgtagccatggatccagctgctgctatccatgactatatatgatcaccagatcagttgctctggctagctcgattgatcaaactatatctggttaaattagttccagctagctatgagttgcacagttgatgcgctgcttatcactatacattcatactagtagtatttatatagtacagctagtacgttaagatcgatcaggaaattaaaggaagctagtacaacaccgatgtgttgtatagagttgaaaaaagttagagatgcacgagtggtagctaggtagggtgagtctgcaactgatctatctaaactattttaaatgactctaataccacaagctaacatgtggggctataaatacaatgcttttgctttagatatgatattatatatctaatcaactaactatatatgctgtaaatttgtaattgcttttacttttgcttttacttttgtttttatctcttataatatctgttgtaacgcacgggtctttagctagtgtatatatatatagccaacgacgaagccgcagcaacaggagagcaacagatcgatcgatcaattgaccaacacaatgacttgtactccctccgttataagtgtatatatatgtgtttagtttcattaacatctatatgaatatggacaatgttaaaaagtcttataatatgaaacggaggaagtactaaccaattaatccacgtgctaattaagttcgaaattccggcccgatcagcatgcagctaagctagcttgctgatgactctaacgagtaagagtagattaattagtgacaaattgggagatgaatttttgccgagcgagaggatatctcctatttcttgcatgtcacctagatttaagtcatatttattttttaaaagaaattaacttttataagttgtaacaaaataaacaaattacttctaactaatccttatgagaatctctagaaaacttgggtaaatatatcttgataatgacaagtcatcatgggttactcattgtcaagagtacattgcctaccactaaaaaaataaatagtcataaatacgagcaccaacattatcagtagatacaggttttatcaataggaacctaattagttgagctacactttctactttacgaaatcataaatatttaggtaacataaaagaaaaatcattcctcgagggaaaaaatattttatgggcaaattgctagcgagtacgcacatctcgagaccagccagtggcctgactgccgtaggatgtacatcaatcgattataggatcttttaagtgctcctatgtacccactccattatattttaactgttgttgtgggtttctgtattcgatatttgaccgtctatcttatttaaacttttcttatgattagtatttttattgtcattagatgataaaatataaatagtgctttatgtatgactttttttaaataagatggacaaaaatctatgattacatttaaaatgggacgaagtatcaatgaaggatgatgtaatgtaatatgatcagtccacggtcaatttggtttggctggatgcatgcgaaaatggagagaattgagcagctagcgtccggagacgggaagcttttgaattagacgacggatcagatattcaatgagagagatctcacatcatcttcgtcgacactgcctagctatatatagctatccggccccgttctaaatatttgacaaaacttttggatcattgtggtagctagctaacgaaagattggagaaatatttccagtctaggttgaatttccggcgcaaattttagaaaacaaatatgatgatcatgatgatgatgaagaagaattaattgatgattagccagttggttgctaattagccgattaattcgtaaacctagttagaatagcttaatctgcgcattcacgcatcttgatgattcattcatttaatttagaattcattcggagaagttaagatgaatgcatggagagaatctacagtactacatatatatttgtttgcttgggcgacgacacaaagagagcaaatcagataataatgagtttgtgccaagttgtaatacatgataactagcaaacaaaattagcgaaccaactaaccaatcatatgaaatattttctaacaaaaaaacccatatgagatacgtactactgttttctttcaaaagaaaagaatgtgaaacacgtgactagtagtgcaagcaggatccggatcatctacagcagaggagtattgttcatgtgagagaacaatgaattaacaccatgaacagtgccgatttactgcggttacatgatcgaaaatattgtagcacactgttaagtagtacgatatccgaaacttccgttctcgatcggacggtctacagtattccagtattcctattccgctgtactattcatcctttgcattagtaccttcaatacagaggatctgaatttgtgctagcaacgttattattggagagacatgggtcataagatctcttgatcgcatccaacggccaagatcgatcagattattggccacatacctacctattttccatatataaaaggtgttttacattatctttaatgatttgaatttatttaagtttaactaaattaatagagagatagagcaatacttatattacacaataggcacccctatctctaggcttagactctttcagaacacaagattgtaaaaacatatataaatactggaatgcgaaaatcacaataatagaatatagaaatacatgtataataaatagaaaattgaaaaacacatgaaaccaaccataaaaaataaaataaaataaagaggttggagtggatgattttcttctgtcactggagtctacaggaaagataatatttcttaggattttcagtcacagaatccttagaaactagatgaaaccaaacgcattgccgcgggagcttatacaataatagtagaaataacatgtaacatagctagatgtcataagcttagaatttttttttattttttgatcgatcattagaaaaggccattaagttgatgtggtttatgatattttaaatagtatatagattgataatccaaaagtaaaaaagtaaggtgatgtggcttcatgagagaaaaaaatgagggaaataatttggactatagattaataatctaaaggttaggaacaattgaagtgataaggtttaatgagagaagataaaaggcattaactagtggagatgaacggtacatgtatatagaatattgtagaaaacgatagggagatatatattgaaatattatgtaaattatatgggatgatgattgaacatgcttgtattttaaaacttttaaatataacaaaatatagatgatatagcatgtttacatgaggtttaagatgtaataattgctaatggatgataatgttgcacttttgcatgttgagttttaggatttagttggttgtagctttagggcagtcccaaccctccacataggatggtgtctatggtattaactacattgccatgtaggacttttaacttatgtggcactatattaattaagagagaaagtgaagagaggaagaaactgggtctcatgcaagacacagcttcaacacgagaacctatgcactagacactattaagttttgcattgggagataatagtgtcttcataatagatgaagaataaatatgatttgtagagaagagagatgatgtatttattaatggcccactttaagaaaccatgggttgtaaagtgtagtttctattgtgatgtcttattgacatggcaccatagacactgcttattgatactatgggttgggactgcccttatagatactacatatctatatcctctacttggctccgtcttcttccttaatataattccaagagtacatgtacccatatgttgttttatgttaagataatctacaacagcaaaccattttcattaaatacaccacatttcttctatgttgaaaatgttacttgtttttctataaagtcggctaaactcgaagcggttcaaaagcaattaatttaacttataataaactccttaaaacatctccaacggcctctccaaatctagctctctaaatttattggccatcttgccaaaatattagagaactaaatttatctttccctccaatagtctatctattacactctccaatctgataatagatcccacatgttagtcttacttctttttctctctattacactacccaatctttccctctagtttcaccccctccccactatcttctctctccacactgctcagtagcaggctgtggacgagacaagcataggatggtaggaggcgacagcgacgaagcgacgatggcggacaaggcaagcacaggtggctgacgaggcgtgcacgggaggcggcacaggaggatagggaaagggaagggaggacagtaccgtctccgccaagtgagccagatccacgtgagagcccaagggggtgaagagctctcccaacgctattgtatgtcccctctttgccagatcaggagtcgacctcaccgtcccttcctacctcacgcatatcaggggacatggagctcggtgggacagtgtggaagagcttgacagcaacaaagaaggggcagtagtcaacagattttggcttgaggggggcagaggacgagttcaatggagaaggggcagtaattgacaaggtgaacaaactaggcggcgccagggaaggggcaacaatcggtagaggacgagctcaatggcaccggagaagagtcggtgccatgttgggaggaggaatagtgtgtggagcccactattaacatattgtgtattatctttttatataagaaaattacttttatcatatgtgtaagttacttttagattttattaaattacttcttaggtatttatgaaagtaaattgaataaagcctaaaattaaactacataaatcaaatttacttccaaattttattcttattattaaatcatcttgtagcgaaggtatctctagaatggtacggttagtcctattttttttgacaatatcatgaaatgttacttctacagatgtaaaaaagtcagttataataccgtgaatagttatttttatttttctagtcacttctctactattataaaaattaaaaatattttttctgatactttggtacgtcatccgcatatgagttggtttttaagtttgttcgcttttagaaatacaaatatgattttgagtcggcttttaaggccccgtttagttccccaaaaatttttcctaaaaacatcacatcgaatctttggacacatgcatgaagcattaaatatagataaaaatcctaattgcacagttatgggagaaatcgcgagacgaatcttttgagtctaactagtctatgattagccataagtgctacagtaacccatatatgctaatgacggattaattaggctaaaaagattcgtctcacggttttcaggcgagttataaaattaatttttttttcgtgttcgaaaagcccttccgatattcggtcaaacatcttatgtgacaaccaaaaaatttcttttcgtgaactaaacagggcctaagttcgttcgcttttggaaatatagaaggaatcatataagacatagctgtttaaaaaactcacatgctaacttgagacgatcagactcctaattgcaactcatgattttctaacaaaatatatatccaagcgaatttaacacagtgaatttcacctttactaaaccatataacaataataagactaaaatagtcttcacccattgtaatgcacggatattttgcaacacatattttttctagtccctctaataatgtacttgcttctaatattgtgaagagaaaaatagacctattttccctagtgtaattattttaataacgtgaagggtcactagcttctattcttttagaataacttccaatgatgaaaattactttttttaaagaaaaacatagtgattacttcaaaaatatataaaataaatgtatttacccatcaatcttctccatattttacttcgcataatttcttaattcaacatcttctactacgtttactttcgatgatacagaaagctacttctattgtaaacttagttacttatagggtttaagtaaattacttttgactgtttaaatatatttagtattggacttgttttgtcacatattttgagtggagtacgatggttcaaatggatttaaaaaatataaatcatcaaatgttctgtactttaaaaaaaaaggagctatagtgcaaaggaaaggctagtgaattagttggtattaaggaaaggctagtgaattggttggtattgaacccagccacgtgaatagcgttctttttcatacaagagattcttggtacgtctgatcggactatctgcacatgtgtcgctcgataagtccaacatcgaatgtccgcacgaaatagatttcatcactaaaacaaggtgaccgcgcatatgcgctaggtaacttcctatttggacttaaaagaaacttcctagttggacttaaaaataaaaatttaggccgtgctaaaatttttttaatgtacggacaaacatttgacgtattaaacatagactaataacaaaacaattgcagattccgcatataaactgcgagataaatttattaagcctaattagttcgttattagtaaatgtttattgtagcattacattgtcaaatcatggcgtaattaggctcaaaagattcgtctcgcaatttacatgcaaactgtgcaattggtttttttttctcgttcacaattaatattttatgtatatgttcaaacatttgatgtaacggaattttcgaaagtttgaatggaacgccttagctcgatcggtgcagtacgatgaggaatactgtggtatatatgtactagcacacagtagctattttacccggccatctcctgcattgtgtgtactactgtgtacacacacggtgatgcatggcaccgtcctccaatcctacagtagtctaatttattcaaaattccaagccgtacgtgaccggccacgtacgtcaggtatagcagctgccacaaaaagaccgccgtttaagttgaaagaagaaaagtctcttgtaataatatttacgccaatgcttgtcccgctgccacgcatgcacattcatggcttttctgattgaagatatatagattttacctgaacattttcttgcacgtttttttaagtactaaaggtacatctggtacaaaaattttctatataaaatttactttaaatatcaaatatatttattttaaaatttataataattaaaacttaagtaattaagcactgaatgatttctcgttctacgtatcctagactttattttcatctcaacgtatctcgagcaccccacctgaggactgagctaggtacccaaaacatcattcggtgatggtcacggcgccgtccctttactcgcgcacgcaggatcgatcgatcgaacccaaatcaatttttaataaaaaaaatttaaaagtatatgtttaacgtgataacgtgttatttttttagatacaagacaactcacaaaaccctaaccacgaaagtcttattttaatttagtttattttggaacggaaggatacgtagcaatgtgatcagtgttgttacgtcctttcaagagagagagccttcctactattccatcctattttaagtgttgcgatgagtctccgtgcctaactttaattgtccattttatttaaaaaaattttaaaaaaattaaaaattcataagtcacgtataaattattattcatgttttatcatctaataacaacaaaaatattaatcataaaaacctataaactattaaaattagacatgaaaactcatagttacgcttaaattgtaacggatggaggacgtgtacgtacgggcacaacacgtagtgctttttttccgtaacaatgggtttgtgaaaagtcttctcataatacggatctaatacttgaattggtacggaggaattaaggcaccgtcttgtctcggctgacccagcaactccggccgagcgccggagggccagcctccgccatgaactgatgaactcatgaacacgcacttgtacttccctacaatattgaactcgttggaaattcttctcaaaatatataggatgatatctcaattggaaaagtattttctatacctggtgtaggaacatgttaaatacctcttattgaatttgttggaaatttctctcaagattatgcataggatgatgggacagtattttctacaccttaatgctatgacacctgagttatataaaaatttcataaaatttaataaaatagattacaataatctaagacactatacaaacatgtaaatccaaactcaaactacgtataaaaaacaaataaagggtgccatgacccttatattagaaaaaccttctatgaggccgtctctgtgtccgtttgagagaaaacgccgtgtcgcacatgaatgtgttttcattggacttcctttcccccgagtcccttccccgtgaaaatggatcaatctacgtaagaggaacgttcgacgtcgctaggccgctcgttcggcatcggacggacgcaagcaagcacggcacaccaacaggcacctttctctccgcccacgctagcaatatcagcccatcaaacaagggaggatttacagtgtaagcatcggtgtcggacgacaccgacgactttcgataaaacctatggtaaaactgcttatctatatatcataacactattaacactatagtctaagtgtaattagcatgctatgacaccgatagacacattatgacaccaacaaatcaattttctagatccgccgctaccatcaaacagcctcgctctcggccacttcgctcgccaacgcatggccttcgccgacggtgcggcagcgcatgcatggccgccgagtgcatgctccggcggtggcggcagaaggtcctgcacaccttcaagtctctcgatctcctccgtcccggcggccggcgagggagaacccataacgaacacaccaatgcggcataaacatatcatgaatatattaaattggtaaagaatcaaaccctggaaatatcataactgtttatcactgactttatgcctgtgtcaaactatgcttcctttcaggcaatcgttggactgcgtgcagggttgcagctgttattgggggttggtgcaatttcctaactgtcatttacattggtaagaggctgctacttcaaaacttcttcccaaaatccctctcattcaacctctgaacgtcagaaatttcatgtctgtcactattttctgaatgtacgcagtccactgtattagcgacaaatgtcactgatatttcatatttgattaactggaacaggatttgttagtgctcacacactgcccgtcctctacgagaagtatatatgaagatcaagttgatgatttcctctgcaatattcttggcctgctgcgtaaccagtatcagaaactcgatcaagttgtgttgagcaagaaaattttgccaaattaattagttatattaaatctaatttaatatcacaaacatactttgtggtcactattattattgagttacagtggtatatgtttgactgtcttgatgtgtgatcactgatcaagttctgttgaaaccttcagcatatatttatattattcttccattatatcatcactatcagattatcagtgccccctttgtcagtagtggctatataaacgttgatagtactattttttcccacacatcagcatatctattttgttgatttttagcttcaataatcttatgtgtgctgcttagtaacaaattgtgtttacggtttgtttgcatgttagtggcctggccgcaaatagcccagtgggccagcaggacgtgggttggcggttgccacaatacacctcgcggatgctgcgggcaaccgcaacgcgtcccacctacgtactccactaaatattcgacaccattaactttttaaaagtttaaccattcatcttattaaaaaaataaaaataattatcaattctttttctaccatttgatttattgttaaatatacttttatgtatacatatagttttacatatttcataaaagtttttaaataagacaaatagttaaatatattttaaaaaaaatcaacggcgtcagacatgtagagatggagggagtatatccttaccaataccgcccacgggccaccatctatcgtctaccggcacaccacacgaaggcccctaccccacttcgctcagcacgcgggaacaagtcaagacggcgatgccgcgccggacggacgtacgccgacggtgacgcgacgaccaccaccacggcgtacggcctcgatcggtggcccgcgtggggcatgtacaggtcggctttccaggggttaaatgtggccgtgccggacgatcgatatatatcctggcctcctttaagacgagtcgacgtcaatgagctcgatcgattatgtcgctgtctccaccactgaccggctagctgctcaccgacctgctcacttaattaggtccctgtttcagatcaaatctgatcagactttatgccaatgtgatgggaaagggctgttgattttgatgccaatttcaaccataatatttttttttaggcaaagttgctaaaattttagtaacgtttagtttgttgccaaatttggtaaatacataaaaaaatcctgttaaaattttggcatattaccattgccaattttggcaatgccaaaatttggtaatgtttattttggctacaatctgaacaggcccaaagtatgcctaaattatctatgtatatgtgtatatggttgatcttttaaagatattttttgatcttttaaattatctatatgtgtgtattttggaaagttgtccttttgtttttcttttctttttttttttttttttggttttgcatctagaagtaaaggacaacactcgttgcttgcaaaatgcagggagcgagggagcctgcagggagagtgggaggcacggctgcatgtggcagtgtcactgctgccgcagttgtatactctggatgctgccccaatatactaaaagtatttcactatatatgtttttaatttataattagaaatcgcaaatattgacagcatattcttcccacagcatgcaactggatcattaggaagtaggaacacataattaaataaggactgctttaattagtaggttaataaatggagtatttattactggactagaaaattcctatgcatcgcaacgagtggaaacaattttagttatacatatctgctccgtacatgcgtgatttttttaaaaaaaataacatttttgcaattatatatataattaaattcatcaactctcacaactaattcatcaactctcacaactaattatatatggataaggagccgggctctactgacggtattgtaccgcgatgtcctcccagagtacggcattgaattcaagcgctaggagatactccctctgtcccataatataagagtttttgcttgcaacgtttgaccactcgtcttatttaaaaaaaaattgaaattattatttattttatttgtgacttacttattatctatagtactttaatcacaacttttcatttttctatatttgcaaaaaaaatttaataaaacgagtggttaaatattacaagcaaaatctcaaaatcccttatattgtgggacggaggagtaatagacatggctctgctgatgcgtcaggcatctaccccaacaagatcttcacgtcctcgccccacagcagcgacatcgacatggttaggccattagcaggacaagctacgcaaattgaatggccatgtgaaaagggggcttccacgttgcatggaactgcttaaagaaactcattctacaatgcatgtatcctaacagtactaacacgaaattttctatttcaccccttatgtttttattctgtttttattctagtccgcccaaatctaataaatccagaatttattagatttgcgtctcccacggcgacgagctcagtgtcaccatcggtgcaaagccgctgacagatgccttgaccaccggatctagcctggtgcgaggcgacaaggccggagatggagctcggcggcgtagatccggtcagctcctccggtccatggcgggacgcgatctcctctctctctctctctctctctctctctctctctctctctctctctctctctctctctctctctctctctctctctctccatttggttgcgagggactcgacatatgcatacatggaagggaatctccttggtggcaggttggggctggatgccacctaagagcattgtgaaaggtcttagatagtggcttcaggacatcgagatttcctctagccgatgtttacacctatgcaagttagcacatttttgcgattcgctaagtactctttctattccaaaatattacaacctagaaatttatctgtgtattacaaatctggacagaggtcctatccattctagaaggatatggattttcatccatcgagagaaatcccctcgttacttataggtcatctaatataaaaaaattttaaaaaaagttgacaatatagattaatatgaaatatattactccacaaacatacaagctcaaattagacttctacaagttacaacaaaaggaacaaattaaactgaaaatagttatcgtacgctcgtagttatatttgttttttttttagaacctgtagaagttgataactagttgataacttgcatgtttgagtgatacattttatattaatctatctcatcattcctttttttaaaaaaaatgactatttaggtgacatagataaaacgagaggatatcctttttgattgatgaaaatgtctccttcttgtggcttacgtatcatcttataaaaaaattatctaaagcctcgatctctaccggatcctctctcttcacctcgccgccggcctccggtggcgccgccacctcctcttcgtcgttcttggtgtcgtcggggcgggtggacagccgcgcctcgagctcccggttcttctcctccagctccgacagctttgactcgagagacttcacgtactcccttgctctgatcagtatcgacgtcttgtctttctgccattaaaaacgatcgagaaataatttaagcaaatattagtcaagatcaatactaatcaatagaagaaaatgttcatgaatatgcacgtgtatacgttcgtaatacgtacaaatgtacgtattaataattgtaccttggagccgggagggaggacggccttgagggcgacgaagctgtcgttgagcttctcccgccgcttccgctccgacatcgtgtgctgcagctggttgttgccggacggcggcggcggcgccgcctcggccgccgccgccgcttgctggtagtagtactggcggcgcctgtacgtcgtctccatgtgcatcttggccagcgctgacatggccgtcttgaacatcctctgcccgcacgcccccggcttgggcgccctcctcgggccgaggtgccgcgcgtaccgcctgaacgcgccaccggtcaccggcggcggcggtggcggcggcaggccggcggtgtaacggccgggctggggctcgttgcgcaccaagggtggtggtggnnnnnnnnnnnnnnnnnnnnnnnnnnnnnnnnggtagaatcccgtcgccgccgccgctgccgccgacgacgaggtgtccgggctgtacgacacggaggcggagcggaaggaggccgaggaggatgacgaggaagggaagctgccggcggcggcggcgacggcgtggtgcgtcgacggcgaaggcgtcaggaggtcgtccaccatggcgacgccgtacaccgcggactgatcatcgtcatcatccatgctcaggtgcatgctgatctgcacgtcataattaattaatccaacgcctaccaaattaatcctacaatttctttgattttatacgcattgttcttgatcgatcggacgctcgaggcctcgagctagctagtgaatcaatgtacaattaaactgcagcaattaagcttgcctcattgagacggtgctgaatctgcgagctgatgaactgctgctccctttgctcgaactcccaagaaccgcagctataaccatatacgtaactgatcaccagccaaacaacgcaagaacagtggaatttacaaattacagagacgatattatcgtcgcgatcaatcgatcgaattcctgatccgagagatggagtagctacctgctggcagcatagccacaggtgaagccgtggttgccggcgccggtggcggtggcgccattggtgtagccatggacgatccagccgccgctgtccatgatatgatcagataaccaccacttctgttgctttgctacagctcgatcgatgatctagctatgtgtttgatcggcacaatatcgatatgatacagttgatgctgaacatgcagacatatatagttatatactagcagtatctaattaataaagtataagatgaggaagctacgaagagcacaactccgaatgtgtgtccgaatacaaaaatatagccattgaaggcagccgtagcatggagcaactgatcaactgaaccagtagcaattaatccacgtgggagatatataaacacattgtcttgtagtagcaaatatatattactaccacatatatagtatatatgtaacgtacatttagtatctggaatcagtgattgattaagagattcatgtggaaaaagagaactaaaggcgcctgatgactatcataagccattagtagattaattagtggcaaactaattgcctgagtctggagtatcatactccacggtcaatgacggaatctaactaagatatatcaatggaggatggatagatgatagatcagtccacggtcaatttggttggctagctagctggatcgatatccatgagagaatgtgggaaaaagaagcaactgctagcggccggagccgggaagctttaatttattcagagatcgatcgacaagagaacaatcctacgaaattttaggtgttatctcaattctacgatccctacgatactacaaaatattatttaaaataagctggtttcaaaatattataaataaatatgctcaagtttatataaaaatcagttaaatatatcaaaaccaacgtgattcctgttgataaatgtccctatttgcatgacatatattattactatatttttatatagaatggccatatgtaaataatataaatattaattaaactttaaaaaaaaatttcatagtatcccggtactacgatacgatcatacgatacgatattactttgagcaaaacgatactgtctaggatcccgatcctgacaaccttgatagaaataggcggtttgtatgagcggattgtacatcggtgtatgaaaatccatttttacgggccacctctaaaaataaattttatcttttcaaaaaataattgttaatttgcaaaagcctgataaaatattttgtattttactagaggctctatatacactatgtgcatgtgaatagaacatttcacattttagtgggtgcaaaaatattttcataagttacatgattttccatacgagatatgtacaaagtttatcgactacaaagctataggtcttgtcgaactctaaaatttttatatagaacttgtattaatctaaggtctcaaatatttgtatttcaaaatagacgtaggaccttgtaacgaatatacagaacactaatcgatctcaaataaaaaaaataactacaaagctggagatctcgtcaagagctatactttcatataaatatgtcttcatctgacttcatatacgaagtttgaaacttttttcttaaaatatgttgtttgtttcaatttttagagtctgttctttaagaaccacctatgaaaaacattttttcattattctttgaaataactaaagttaataaaaatatttttaagttcaattgagatgaatcgatctctatgatcattacaatgttttctttgttatggccaggtccatatttctatagattatttggaaaaggattgatcacttacgtcatgtttcctccaatatgagttggcatgttatctatttcgacattagtaaatgactatatctctactattataaaaattgaagttgtttttgccggtagcttgttacgtcatctgtgtatgagtcggtttttaacttcgtttgcttttagaaatacatatccgtatttgagtcagtttttaggttcgttcgcttttgaaaatacaaaaggagtcatataagaaatgtctttaaaaaactcgcatattaacttgagatgatcggacttctaattgcagcttatgattttctaaaaatatatatatatattcaagcaaattcacatagtaaacttcaccttaattaaaccgtataacaatgataagattaaaataacctcacccattgcaacgttgcaacgcacaggcattttttctagttatagtaaatattttaagaaaatattgcccaaacaatgtaaggaaaatactgaaagaatctcggagaactttggttcaccttaattagacttaaaataacttttcaaagtatggacttattttcttagtgcttcaataaacttttttttcatatagcaaaattcagtgcgacaacgtttaacctctcatcagcaattctatttgtgaaatctccataaaagtgtcaagactgtactcctaaaaatatttaattttggtaaagaccacactgacatctcacaatttatgaaaacatgtcgattcggttaagcacgtgcgaacttgagtggtttttcaggaaaactaagtaggtaggggcgcatttgtaataaaatgacttgtgggtgaaatactgaacttcatgcgacttatggggtggattttacaaaattcccaaaaatttatctacattggacttggttacaatttgttaacgacagtttcttatgagaaccacccttaaaaatttgatttatacttaaatcttgcctaaaaattgtgtaaaaatattttcctaagaaattggctataaaaatgatatttgcaggcggtttttttttaggaaaaccactcgtggaaatagactaatttctacatacagtttccttaatgaaccgaccgtaaaaatatgtgttttcacgggtgttctataacccagagacaatctcaattatttcgtactccctccgtctaaaaataaaccaagacaaaacctggtacagtgaatctgaataagcccgatctagatgctttattttgagaacataggagtaaacggctttaaaaaaaaagatagttgtctagggcatccataatgtggctggtgaaatagtgggaaataagcattgaatgcatccctattactaggtaatatacattgtggaggtggtaacaactactatcagggtataagtttactactaggtattagcacttcatatagatctcgtcttttttttaattgtggcattacacatgtttgaaaaaaaaatttagatgggtcatatcttactacccactctacgtatatatattataatacatcttcaacctatttattatcatctgacacagatccatcttattacctagttttacaataataaatattgacaatgtcaaaaaaacatagcataagtgaaaactgtttttttaagtagtgtgtaggccacaggctgctgggctaggccgtggctgccaggaagacgggggtgtcgacgtcccttcgacaccgccgccgaatgggagaaaagtccccgtcaaaattaacactccgctcgcgtacgtgaatgcgccgccggtagccgtcgccgacatgcctgcactgcatgcgcagcacatcgatagcaacagtacctaccctaactaccccggtggtcaatactaccatttcaatagctaatcataatcgcacgtttcgcaaatcgaggcaaagcattttaaattcggagtaattccgatccatcggtttggtttgacgcatttgtggaggagcaagaaagagtgtaatacttcgtaataggatagggttagtatggtccaatatatatgtgcagcctgctatccatgttgattaataattgatgtactgacgtatactccatatatctatactactgaagaaaaaaaaacaaagtgagacagtgaatctcctaccaccttccatatcaatggcatgtgggttcttatctagtattccctccatactcataaaggaagtcgtttaggacaatgtttaagtcaaaccttgagaatataaatcatgaaaaactctcaagttattgagtttgaaaatgtaaaaattatatgaatagatttgtcttgaaaaatactttcataaaagtatacatatatcacttttcaataaatatttttaggggcaattgcttatttgacctcgttttgaattgtaattaccgatttgaccctactttttgaactttgcttatttgaccctcattttcgagtacgaagctctggtctgaccctattccgtttgtgtgaggtgacggtgttaattttggggtaaatagtccattttgcccttgcttatttggccctgttatatcttgtttgtttgcttgtttgacctaaagtttggataatataaaaaaaaatctctttccccggcggcggcggcggcggcgcacccgcagaggaagacggaggccggcgcgcgctggggggagagagcggcgccctgtgctcttcgccacagcggcgtcgtcgtcgttgccgactggtggcggcgcgcgcagtagaagattgaggccgacgcgcgcggggagggagggagcggctccctgtgatcttcgccgtggcgtcgtcgtcgtcattgttgctgacccggcgggggggcgcgcgcggaggaa

SEQ ID NO: 60801 - DNA, 1786 bp, Oryza sativa
atcctaggaatcttttttttctcatccaccggtgcatcatctttgtcgaccacctctccatcggaggctccgttacccgtcttgtaccgactcgtcccacatgttgggcaagagtctaaatccgcgaatttcttgctgtacagtatgcaataattttcacatgaatggatcttctgaacacctaaagaaaatggacatatcaatttctacacttgatatgtgttcgttggcgcaggttcggcttaagaagcataactctcaaaagatccatcaaatcattgaagctagtgtccgacaattcatttctggccttcaatctgagaagttcaagcaccgagcgcagcatcgaatagtccttgtcgcatcctttcgcttcgtcatacagaaggtccttcgctgctttctccaacgcttcccaattgtccaaccctcatcttctaccagttaggacctctggttcaacgtgccacaacatatcttccagatcaaattcaatgccttcattctctatatgtcacgaccggaaataacccaacgggcgttccttatgtgcatgtattattccttgtcccaggaggcaaggaacaccaaaagttgatacatttcagagtttatcaagcggaagcgtaaatagatactttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacatttgcataataaatacaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaacccaaggcctacgatgattcagatcgaaccggcaacccgaccctgggtcccagctcgtcccaagccaacccaggccaaccattccacattttcgttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcacagcctaaaaccattttggggattttgaatagagggggcggtgtgaatctaattccacaatactccaacaattccaaagtgtccaggtgatatgaatatcccaaagtctagagttgtaaaaccgcctaatgttaccta

SEQ ID NO: 60802 - DNA, 557 bp, Oryza sativa
tactcttggaggttaccgcctcctagacggcttgtggaggagttgcccggtgacctctccgagaagattgtggaggaggcccggtgccggtttgtgagtggtttggatttcaccaccttcggagtgaaggaagaactaccacgagtgatcgaggcttgggtagtcctccccgtgggcctgctttccaccttgcccaccccttgacgaagggggcgtgcggtggcttcatggttgagcggtggagttgggctcgcctcaacagggagtaggaaaccggcgagttttcgaacctcggtgaaaaatctcttgtctccttatctcatttgattgtcgcatttacatttgtgcaatttatatttctagagacatacttgagatcatatcaccctaggattgcaaaacattgacataggagtgtgatttactttcctagagaattaattgagccactatcaccctaggtttgcaaaacataacttagttacttagttagacttaaccctcaccgagcctagcaacttaggttagttttgtttaggtgtcatttagtttttaaa

SEQ ID NO: 60803 - DNA, 1074 bp, Oryza sativa
gattcggcccaagagagggaagggggatttttagggtttttctttttataaaaccttttcaactttgtttatttcttaataattactatttgtgctcagataattccactaaaatttatttacacattttaggcttttaggaaatatacaaaaatcctctaagccttatttgacttttaactttgcacattttaattgttggaggcttcgcacggattttaattattctaggcataatttagaggatgtattttagagtcgttttgggacgtgacactataccagagccaccacattccgggatgtttccctgtgacatgtctttgattataaaattttctgcatcatcaaagcagaaatcatccatcacttcgttacgaccaccgacttccccatgaaaagtccatattttgtggccctccttaaatccttgctataagatgtgcgacaatacttcattcggatcttgcagcaaatttcgttcttacacactttgcatgggcaaaaaacgctcctcaaattctccctcacagcatgtgcctttgcgacctcaacaaatttggctgcttccttcaagaacgttggatgagctcttttcttgctgtacatccatgacctacaataaagcttgtcattaatacatccatgcccgatggtaaaaaagaatgtatttaaattggagggaactaatcacatagtaaattaaagttttacggactatttaaacagccacacaacaattttaagcattaataaaatattgtccatttcttacaaatgaaaaaaatcgtccttttatccgaatgaaaataaatttaatagaggcaaacccaacttttcaatttaggtactaaatacttttataaacatgtaatggaatcattatgtatttgctaaaaaataagaaaaaaataaaaaagtaactacaatataccatttataaaagtgcaagtttcttcgtattgcaccgatgaaaactgacaaaaatggctgcaaatgaaggaggagaacaagctctacaccttttatatggaacccaatcaaagatttgagatcgaaaacattctcccataa

SEQ ID NO: 60804 - DNA, 613 bp, Oryza sativa
gatatatatatatatatatatatatatatatatatatatatatatatatatatatatatatatatatatatatatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacagcaatcaacaaatattaaaacactctcctttctcactccca

SEQ ID NO: 60805 - DNA, 15246 bp, Oryza sativa
ccagatgaaaaagtacggccgcaagctctttatgggcggccaaaattgcaattagccccttgccgccctctgtatgggcggcaagggcctaatcgcaattttggccgacggcggcagacggcgcggtcgacccaccgtctgccacgtcagcttgccgcccaccattagggcagcaggggctatttctgcaattttttcggtcgatagattatttctgtaaatataaaaaaaaatctaaaaacgaaaaaaattcttgaattgagtgcctcggtgcaactgaagcccggaagaacagtcaacaagattgatgggtggggttcaatcttccatttgcacaagcacaaaatgagcatatcctatgatgatagttgtacacatctaacaaatgccagcttatctctgaatactctgctggagatgatgcacaatactctcctatctgccatgcagaaaccatgctaatcttgctaggttagtgagaatcaagctactcatgctacaaacttccacacggccggtcatctggtgtttccctttcatgtaccagatcatgctgaactatgctcttgtatgtgtccttttagcttgcgactttggcaaaggcatgtcctgatgctcactcatttgctgatatttcgcagccaagacatcatcaaatgctttctgaagtgcagcctttgcaaccttgtaaacttctggtgacatggctcctctcattccgtatgtcaaaccgtcgagagagagatcgttgtaccaagcaactaggcgctcaggaaagctaactccagtctccaacgatcgctcgtctggtacaacactactcacagcatccattgtccacctcttcatgatgtattcctccggtagattccgaaccccgaccatgaagaagattcttagcgcatgcctgcataatataccagcgtactcaaacttgcaacatgtacactctgctttcctgtccagctggttgaaagagactatatagccccggccattttcttcctcactggccacattgtacttgaggataactccatcctcaattttatcagcatgatagcctagcgattcgataaattcctcctgaaatatgtcaaacactgcccttgtatagatggccgcagcctgcctttcaattacagaaggagttttcagggtaggctttgaatatgctgtcacaaagtttgcttgagcttccttctcgaaactcaacgccatcacttgatcaaacctagagataagaacaagcagtggagtcttcatgttgaaatgcgtcttaaaaaacttgttcagcctctcagatctttgcgacttgagtaactctggaaagaaggatcccttctgatacacccaagcccattgctgccgagtgtcatacaacgactgaagccaagtgttctcctcgagattatacttatggatgacatagtcccaccgagcctgaaactcctcaattgtctcagcctcaaagacacattccctcagatcagctttcaggttgatgtgctgtatatacacagcagacaacttctgcttacataggctcaaaatgttccgctggcagaaacgatggcgggtgttgggcaacaccctcgcaattcctgcttccatcgccttacactggtctgtcaccagcagatcaggttggcggccacccattgcagcaagccatgtatcaaacaaccaggtgtatgaactctttgtctcatccatcagcagacagcacccgaatatgatcccctgcaaatgatggttgattccccggaacaccgcgaacggcatcatgtacttggtcttcctgtatgtggtatcaaatgtcactgcatctccaaagctcttgtatgccatccttgcctttgcatcagcccagaacacattggtcacgcaattgccgctatctacctgcatcgcgtagaagaatcccgggctctcggcctgcatcttcctgaggtaatcgagcaaatcttgcacctcggcacgcaccccagctggattcgctctgacgagcctattgcagaaggatggccctccattgggcgccccattgcccactgcagcaggagctccggtgggttcgtccgagggttcggtggcggcttgggtaggttcatccaatgctgcggcgtgctctccggcgagaccatcggactcaccggcgggaggagggcgggggcagagcgggagcgagacggggtggacgtggtgggcgacgaacttggtgacgacccagcgcaaggggggctccttcttggtgacctcgcacatggccatgcacccctcccggatgatgaggcgcttccgccgcctcttcccggcggcggcctccgactccgtgaggtcgtcgtgcctggtggggtggaacccctcgcgggtgcagacgaagcggcgcatgatgacggagtcgtcgcggcgggagcggcgggacttgtcggtgcgcacggcgaacccggcgcggtcggcgtaggcgcagtagaactccctggccgcctccgacgtcgggaactccatccccaccgacggcggctcgcctgccgccgccgccgcggcggaagcgccggcgctagcgaggccgagacgcagccccagctcctcctcctcgtcgtccgcttcgccgcggcgatgcccctccattccgcccacgcctcgcagctcgcgccgccgagaatggagcagcgccggagttggagtcgagcggaaggggaaggggattcgttcgagaggaagaagaagaaatcgcgcaaagagagagagaagggattgggcctcgcagggtgggcccatgttctgcgtaagtgggccatagccagtgaggcacaagcccacgttgggtgggctcatgtccggcctgctagcttgggatggtaggtagatcctgggaccacctatacatttgtcgataaattttctcctaaaaatttgacagatataattatagtataatcgtagtgtacactataacttatatgtaattacactgtaacttgcatataactacagtgtaacttgtatttaagtttcacgtaatttttaatcgttaaatctattacaagatttgttttggtgaggaagaaaaaaaaatcacagcacacacatatgtgtaaggatttgttcctacaacctccattttactgaaataacatattacagagagatttttgaaagttacatacacgttacactatagttacagtgtattacatgcaagttacagtgtaattacactatgattgtactgtaattacatctgctaaatttttgggagaaaatttgtcgacaaatatatagcaaaatcgtccttttttataagagaaaaaaagagtcttaggcctgttcactttgatgccattttcaaccttaccaaattttggtaaagttgccaaaaaaagtggctacatttagtttgctgtcaaattttggtaactatataagaaatcctgccaaaatttggtaaagttttttttcatcaaagtgaacaggcccttagtattgattttttttggataatgaataaacatcagcctctatatttacaagtgggcatacacagcacaaagaaaaactcttattgatggttggttttttttttctttgcaaaacgattgcggtgatacttgttggtattgaaatatatttatacatgtttatatgcaaattgaacagattgagaaaaaaagttagttgcaagtgtaacttaaagggtgtaattacaggacgcgaggaaataattattcacgatggatattttttatgtaaatcttatcagtttatcaccgatatggaatgtagcaacctacttttattgggactcaaatttgctgaagattcaacaattggtatttggtagcaatgtatcggtaagctgcttgagatgatttgacgacatgtcgtcattcgctcactggaagtatgggttattgaaatcccctaaatgattcatttatagacctattaatacattgctctcaaactctttaggtagatgccgtaaaattgagaattaggcattcatagctttattattgataaccgttagttcatgatgtcatggttatggataccacatacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtaattagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccaaaaaaaaaataaatgctaaatattggctagcctcaggatttgctagccatgccctctgaaaaatagaaacatcacagatatattccagtgacagatccatcacagatacattacccccccaatataacatcacagatccccaacaacacatatatgcagttcaaatgccataattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagttaattacattgcactctataaaaacataattttttacatcgccagaaattataaaaacatcttttttacatcacaataaattatctagccaatttcatgaatctatttggcatgaaaacgtcctttcttgttcattatttctgcaagaataaaggcgcacaattcgcctctgatagcggggggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatggaccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggttgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttacacttgggaggtgtaagctccgtcggtcgacttggatgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagaaatggatcggataacaacaattacctcgatgtggtccactacagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagtgtccctctcttccttggagactttccgtttcctgtattgggagctgtactgagggagtccatgcttccagggcacatcgctaccaattccccgagatcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttatgtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctacagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagaacagaattcctcccacaccgcttcggttatttgagggtattcatcgaacggcgtatgattgccgggcgggttgacatactcggtgaagagcttcgacttccaattcttccaagctttgcccatcttttggaatgccttccacttgagcctatccttttcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagaattagatccaatgtaatacggggtatactatgaaagatatggcctcagttttgctgagaaatatgcatcaattacaatcatttgcatgaagggataaaaagaggaaatcagctactaggagaaaaaagcaaccgaaagaaaatagaacaagtgtagttcatctgttcttatccataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcagggggagattcacataaacagcaacagcagagggaaattcacatagacagcaagggtatataaatcaacaagtgtagataatctgttcttatccataaagaaaagaacaggtatagatagaatgttattaagcaattcatccttgaccatttaacaagaagtacaggggcaacgacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactccattcaacatgtctagatatcatccattcaattcaagcaagtctagataataaaacagcccacaatcattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagatttcaaacaaaatgcttaataaactatttctagctagcttaataaccctcaatccatcctttttcagctaaatgtaaacatgatccacaaaattcaataggtctagcaaaagggaacaaaacaacatatatagcagtacacactccatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataacttatccataaagaaaagaacatctactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcagtcggcggtggtcggggatcccggcgtcgggaaggtcaggatcggggaggtcggggaagtcgatggacggacggcggagaggacgaccggcggcgagggcggcggtggaggcggcggcggagagggcgaggcggcgatggagagggtggagatggcggcagagagggcggcggagatggcggcggataggtcgagacggcgacggtggagatggcggtggagatggatggcggcggtcgagagagtgagtgcggcggcggtggtgcaggccggcgtcgggaaggtcggcggagagggtgagcggcagagaggtcggcagtggagaggtcgaggcggtggtggggaggtctaggcaacggtggagagggtggcggagagggcggagagggcggcggatttggcggcggcgaggacggcggtggagaggtcgaggcggcggtggagaggagggcggcagagaggtcgagagaggcgaggcggcggtcgagagagtgagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggttgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgatagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgacctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaagaatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggattaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgaaagagtgtagcaggctggaggaaggtaaaccctgccggattccgtgcttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtactctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctatgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctattgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagctggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaaactcgtcactggtatacctctaacgggttttcctttcggcccgtcacaggtgaggggatacctgtgacgggccgatggcagatgcctcaccggtgacggtatcccgtataacccgtcaaaggttatggtcattcctgatcaattcctttccccgctaacagttttccagtaggatgtttgaagatttcgctctcgtgatcaccaaataggagtggactaaattatcggcggaactccaccagaatttcattgtctttgtcggaaaccaacctttcgaattttggaggtattctccggtaaaact

SEQ ID NO: 60806 - DNA, 36742 bp, Oryza sativa
agtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctagactcaagaattgtaccagcatgcatgtcgggtactccagagtttactattaagaatctataacccacactgtggatagcataaccaaaaaacacacaatcaacagtttttggtccaagtttccgctttttggctataggtacatttaccttggccaaacagccccatgttcataggtatgagagatttaacttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcatcatctcatgaataattccaaactcttcgcaaaaggatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagacgccttgtgagccttgcgaggttgtttcgattgaacacaagtatggcacttggaacctttgaccaaagtgaattttggaattaaactcatgttagctaagcgcgtcatacaaccgaaattcacatgacagagtcacgaatgccacacattagactcatcattctcgctaatatggttcacagcattatgattattacacatgtcattcaaagaaaagcggaacaagcctccgctgtcataaccttttccaacaaaagtcccatatttagaaacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgaccatgttggcagacttcctgtctttgcgctcaggacagtccttggcccaatgcccatacttgccacacacaaagcagtctccctttgcctttcccttgcctttcttcttaaaattggttgcagccttgggtttgacatcaggcttgactttcttgttgttgtgggatgcatgagggttcttcttctgtaccatattggcactagaacctccctcaacctttttgccccgcacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttctttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacacgataacatgctagaggcattatgtagaacaggaacaagaacatagcgcacatagtatagcgatagcgctaacaatgggaacaggaatagcgctaacaacagtagcaggaggagaagagtataccccgagaatggccctccgctggatggtgaggcagaattgcctccgttgttgttgtcgttcacggcacctcctggcgcaccagctccggatccagctcctgtcggcggcgtaccaccaccgccagcagtggcggcggcaactccagacatggcgatgagcagtcgagcagtcgtgcgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcgcggagaagaagaaactaacaccgggaaagaagctaagaaaatggatcggactcgcggcctccttatctatcaggagaaagaacatggacgcgctgttgcggagggaatcgtgggaacgtggaacgtggacgcgctgttgcggagggaatcgtgggaacgtgggttagtgcctgcaaaaggatagtgacgcccgcccgccgccatccacgccctcgccctcgccctcgcccacggcccggcgcgcgcgtgtggtattccgacccctacctcaactggtcaacagggagcctccaataactccctatttaggttgagatatttctcgcttaaatcctgaggtggtattattatcctcaacacttattatgggcctttgagatttaatattataagttgggcctagcccaattattctaacactcaagtcatcgggttcgcccaagtactatataacatgcatgaagctagcttagcatagatgtcaagtttctcaagaatttaacacgcctatacattctcctctcaaaaattagcatctgctacgacagccacctccaggcacggatgacgaagcatcatccaatgctgctcttccttggcctagctttgctcgccctgcagcctctgatcgcggccgcatcacggcggccgccgccgtcgccgctgtgtccgaagaagtgcggcaacgtcgacatcgagtacccgttcggcatcgggccaaactgctcgctgtccgacgatttcagcctcgagtgcgtccacgacaccccgcagcttcgcctcggcaccgatcggcagcaagtggtgccagaaacacctagggatattttggctagcttcacaaagtagtgggctggacgatctgggttcgaagcctcaccccttctaattatatttgatattaggtctttcgggggcggagacaggcctagagcagctaaggcttgagccctaggcctgtctccaaaaacttgcttaaattttgttgattcaccatgtaaatttttcagaaaactaaaactccattagtcgagccctaccttattcttagtcttatataatttttggctccgccactggtctttccctaatattcgtgttctttttagcaggtggtggccgtgctcgacatcaacctgctccacggcaagatccggattgccaacagcatctcctggcagtgcaaggacgagaacgacccaaccggcgccccgttgaagaacagctcgtggatgggcctcgacgtgacggagctgccgtaccgcttctcctacgaggacaaccaattcgtcaccgtcggctgcaacgtgctcgtcttgctatccggagaggaggcgtcagtcgacccgatcctgaacgtctgcatgtccacatgcttcggcaacgggagcaacatcaggaacggctactgctctggcgcgggatgctgcgagatggccatccccgtgggactcaaatcctaccggcttgaattcagcgggccattattatttaataacagctggtcgccggacaattacacctggtgcagccacgccgtgttgatggaggctaaaagcttcagcttcgagagggactacgcgacaaccgataagtttttcagaaacaagaacggcacggtccccgtcgtgctcaacttcgcggcgggcagcgagaagtgcaaggaagcaagaatgaaagatacctacgcgtgcgtcagcgaccacagcgcgtgcgtcggcacggctgatggctacgtgtgcaactgcacgagtgggtacaagggcaacccctacctccccggcggatgcacaggtacgtccgtccgtctccaataccactgatttgagttcccggatttgtggagagtttttttttagaatgatttgtggggagttgcacgtgattttttattttaataatgaaaatcggtactaagtatatcttttagtcctactgaagcctgtttagttcacgaaaagaaaatttttggatgtcacatcggatgtttgaccggatgtcggaaggggttttcggatacgaatgaaaaaactaatttcataactcgtctggaaaccgcgagacgaatcttttgagcctaattaatccgtcattagggcatgtacaatggtgtttattagtggtctctctcaattgccatgcaagtaaatttgatgacatggaagaaagagaaaggagtacggttgttatgcatgacaacggctcagagtcgattcttagcatttattagagcaaattttgttgcatggtgttgaaagaaaggaaagaagagtaagaaaaagtattttgatacattaattattagagactatattgtctctaattgttgtaggatgctagtctctaaataatgtagagttcatatctaactctaccttttgtacatgcccttagcatatatgtgttactatagcacttatggctaattatggactaattagattgaaaagattcgtctcgcgatttaacccctaactatataattagtttttttaatttatatttaatgctccatacaagattcaaagattcaatgtgatgtttttgggaaaaaaaattaggaactaaaccaagcctgagttgcatgtacatttaactgtactataatttttttttacgggaatgctaggggacgggataccgttccccaatgggatactcctcctccacaaatgcgattctcactcatgcgacgcggccgaagccatcagcgcgcgcccatccctgtccttgtcccctaccgccgctgccgccgccgtcagcatccctcgccgccgcgcccgtcccccgccgccgccgtccccgtcccccaccgccgccgcgcccgtcccctacagtcgtcgccacgcccgcacccgccaccgtcgtcgtccctcgccgccgccgccgcgcccgtcccctgccgtcgccgtcgccatcctcgtctacagggggagggctgcaggtggccggcagcgcgtcgggatgctcctcccccaacgggatgcacaattatatctactaggaatcacctgatacctggtaagtatcatccgataactcttaagtatcacgcgatatataagtataaatcatcttatacctgacatgatacctcacgagtatcacacgatacgtggtagaaatcgtctgatacctgacaggtatcacatgatacctcgcgagtattacacgatacgtggtagaaatcgcatgatacctgataagtatcacatgatactttgcaagtgtcacctaaaacatgtgtagaatcgtctgatacctgataggtatcacacctgatacctactcgggatcatcccgttcgaaaacggattccgttatatagcagccttttttaagaaacaaagaaaaacgcaaacaaaacactcaccatgtgcacgtattcatccctgtgaacttatatgaatgcacacgtaacatgcatctaactgtattatatagtgtcatctggatttcaaaaaattttctatatgcttaggacttattcgtttcaaaggaattgtaaaggaaaagtacaggaataggcaatcctttgaaatggacactatactgtcattcgtttcaaaggaatgcaccaaactaaaaattcctatccctccacttttttagggaaaacaaaggaaaaaaataatccactccaacccaatgttttcaatcctttggattgtttgctacacaaccatagaaaaattttctatgtttttcaatccttaagtttatacatgcatttctatactatttctatgttttctttattcctatgttttaaaaatcctacaaaccaaacaagctcttaatttggtctggttccaatgccatcctatatgcagatattgacgtatgtgctcctggaaatgacgggtgtccggacgggatgatttgcagtaattttcccggcggacacaactgctcgtgtccagaaggagagcacaagagcaacaagagtggagtactcatctgcgagccggacctgaaacgatctttgccggacctgaaatttaaacgatcttaccggctcccggtctcagcgatcatagctatcggtacgtaacaaaaatgcaattgagcaaatttttttttcagagaagggtatattttttacccagcctctatattcaaccgaatatatgcagtcatttaaattaggaatttagcctatcgaatataaaacttagcccttaaataaaaatttgctcccatagagatttgactcagaatcttagggtgctactcatgtcactgtaaccattaggctacatgcactttcacaaatgcaattgagcttgccctgtcatcatctactctaatatatgcacgcacagctagcacgcatggactttaataagttcgataatttttatatgcttaattcaatatagaatatattgtggtcaaatttgtattttgaaaagcgcaaaaaaaagtcaaacatgatgtatatacatataaagtatttcaagcgtaacttagagcaagtttaataatatagccaaccactaactttaaatcatctatagtcaatttaatagccaactcatacacatagttaccaataaatatatatcgcattagtaatatgtggtcccacctatcataaacatattgtgtcttgtagtttgtgatacagctgactataaatctgtaacccgctactcttctcttcttatttctcttctcgatatatacttgctcttagactatcatatttttccctcgtaaacaggcgtcaccggtggcatcgctatcatcgtgatgagcttcctgagctcatacctagtacaccagcgaagagcgcttgccgacatcaagcgcagctacttcaagcgacatggcggcctgcttctgtacgaggagctgaacgcgaggaagagcaacgcgttcaccatatacaccgaggagcagctcgagcaggcgaccaacggcttcgacgagagcaacgtcctcggccgcggcggccacggcaccgtgtacaagggctgggtggctgcagcctccgacgacctcgttgtcgccatcaagcggtgcaagctaatggacgagaggaacaagaaggaattcgggaaggagatgctgatcctctcccaggtcaaccacaagaacatcgtcaagctactcggctgctgcctcgaggtcgacgtccccatgttggtctacgagtacgtccccaatggcaccttgtaccagctcatccatggcggatctgccggcgccatctccttcgcttcccgtctccggatcgcccacgagtcggcggagtcactcgcgtacctgcactccttcgcgtcgccgccgatcctccatggcgatgtcaagtcctccaacatcctcctcgacgagagcatcatggccaaggtgtccgacttcggcgcctccatcttggctcccactgacgaagcccaaatgatgaccatggtgcaggtgagaaatgcccagaggttttccggctagctccacaaggtagtgggttagacgacctgagtttaaagcctcaccctttctaattactccctccgtttcaaaatatttgacaccgttgactttttagcatatgtttgaccgttcgtcttattcaaaaaattttgtgaaatatgtaaaaccatatgtgtacatgaaagtatatttaacaataaatcaaatgatatgaaaagaataaataattacttaatttttttaatattaggtcatttcctaatattcgtgtctttttttaccatggtgcaggggacgtgcggttacctcgacccagaatacatgcagacatgccagctcacggagaagagcgacgtgtacagcttcggcgttgtcctgctcgagctgctcaccggcaagaagccgctctgcctcgacgggccggatgaggggcggagcttgtcggcgaggttcttggccgccatgagggagaacagagccgatttgatactggatgagcaggtgaagagcgaggcgagcggtgagttgctggaggagatcacgctgctggctctggagtgcctgcagatgtgcggcggcgacaggccggcgatgaaggaggtcgccgagaggctgggcggactgcggaagctgcaccagcatccatggacgcaggacgtcgtcgagctcgacgaggtgcggtgtttgctcagcgactcgccggaaagtatcagttttgaagtggacgccaccagtagtagcggatactgaaatttgaattagagaatagtgttgcgtcagtttgaaatttgagtcatgtctcttcttctcctcggtttgataaaatgtactacctccgtcccataataattgtatttctagaatttgaatttgtcccaaaataattatcacaatagagtactaatagtctcattaatcacttctcatttaaatttctttctattttaccctcgattacctttccactcttatatagtatacactacttcctccgtttcacaatgtattctatctagatttattaacatcaatataaatgtgagaaatgctagaatgacttacattatgaaacggaaggagtatttaataagggacacattatagtctttcttcttaaaccttaatatttgctaaacaaactagaattacaagttatacgagaggaaggtagtatgacttgtagacttgtagtcactatggtaacgctgtagccaaattaatttcctgctcaatacgaacagagcgaagatattagggtctcatcttttcgcttatatttatacttatcagctaaaatttgaatttttaactttaaatttgaagctgattttaaggtttttttcatcgaagtttatttttcagcctttacttttgcttttagatcactaagaatacgcatataaaaattttattcacatatttcttttcgtttgtaaataagatgttttgcttattccgcgaataagcgaaacgattccatttattacaacaatcctgctattttttcctctctaattacttaactgcagttctcaaaaaataatatttactcaaatgctgtacagtttagactaataactttgttgatggtctaataaaatgcctttctttgtaccgagctggcctagtacctatgccgatgctcagatgccttgtttgagaggcccgtaatcaattcccataacccacatacataaggaataagtctattttggctccctcatttcttgcccttggtcgaattgcatccctcaactgcaaaatcggatataacacctcccacatctccgaaaaccgttgcaaatagactcctcaagtggtttggaaggtggttttgagctgacgtgggtagttgactagttgaattagcaagtaggacccgcatgtcatcctaatcttatctttcttcctcacctctcccccctccccccctcaccaggagccgccggcgacagcccgtcccacggtaacagcagattggccacctgcaacgtcggcatcgcgtgcgcatgcgcgcccgcttccacgcgccgcctctgctgtccttccccattcctctttcatatcttcctctctctcccctcgcaactagcagcggaagcggcggtcatggcgtgttgtcgtcttcatcgtggaagcagaagcgacgctcctggcatgtcagcgaagcggcgcacatgggggaggatctcaccggccggctttgcacgggaggaggatctcgtcggccggcagtgacacgcgcgagaagtagatcgtccatgcacgcgcagaggcggacacgcacctaagaaagaaagagataggccaattacttggttagacatacacaactacagaacaccgcaatcactatgagaattggtcgctctgccatcggtgtggattggagctacgagatctaggaccttggaaacgattcttggcctgaaaaatcttcttggacgggagggccggcgatctggttgtgtggagattatgggtaccccatacccacacggcattattatccgactagttataggggataacttatatatatggaatatgtaacagatcatgacttgggtattacatttccttgtatattacagaatggcgtaaagtcctagtttggtaatattgtaaagtagatttaggaaattgataccgtgttggttaaaatttttatcttgtaatcctgcctctcatcctatataaggtgggcaggaggccctctagggggcatgagacaatctgattgtcagatcaataaacacccggtggattcaaatccccaaacaggagtagggtattacctctcattgagagggtctgaacctgtctagatccctgtctctgcatccatccacttttagctctcgtgcgctacccccttttcatattgccgaaaatttgtttcgacagttggcgcgccagggaggggtgcgtcgagtttcccgtcggtaaagtgcgttggaatcaatcaccaacatgaccggatcgtacacgcgcgtcattcaccgccgcaagaagcacggagggcgcgtctcatcagagcgttgagcgcctgccagatcgagagatcgcgccgatcggtcgtgtgctgtttggacttccggatcggcgagcagctacgcgtgaccggcagcaaccagccgccggcgcatgatctccgtcgacgtcgcttggtctaattcaatccggccgaccacctcgatcgatctacatccatgcggctgtatagtccacgcgtcagatcgatccgcatgtgcatcacatgacgagggtcaagcagggagcaagactatggcatatgcatctaatcttcttcctgctaattagattgattattaaatcagattgattgatggtctttttcctctttgctctttcttctggtgtatgcatgttgccggcgaccaaggtgttcaattaggcacggtatgattaagccgtcgctacgcaaggcgaagccgtccactctctgagcgaatccaactcgtgggctggacaggcatgcacgaaagttcacatgacgagatcgctggagatgtacaggatgtgtcgattcaaccgccatgcatggattaattaatccagccatacatgcattcaatcgctgagatttatacatttaatttgctgatattaatcagatttattttatttgtttccatgtgaatctcggagcatcaccgatggacgtcctgcgggctatggccaccacgggccacacatgggaacagccagcctatggctaatcaggagagaacacgtgcagaaagttgatcttaccgatcaacaagcaccattaatttacttaatcatgcctatatatttttatcattaaccaagttggtttgttgtcttgttctgtaagcacgccgagccatggatcgcttgattagtcctagcgacagagtgcaacaccagcaaccaattttctccgtctcggagtcagtccggtcgagaaaatcaatctcggcgagttcaacaatttaaatctccgactccgccgggttttttcccttccaacttattgttgtttattagattgatctctaaatatcagattaatctcttggtatttcctgttgtttacatgtaatgctgtggcactgctgttgccgattggtgtttccgcctgcacggctggcctattataccgtcgttgttgggcatctacgacttcactgtcggcctgcctccgtcgccgccgactggtgtcctcgcctatacggctggcctattatgccgccgttggtgggcatcttcgctttcaccatcgaccgccttctttcgccgccgactggtgttttcattgccattaataggcgactttgttcccacatcagccacctctgccgtcattaagagagatattacaaagctaagtcatcatttttccttatatgatatttttcttttcctctgcctcactacatcaactggttcgtcgttgactagtgagtcaggggctacagatgttatatcatattttttaaataactttcataatatttatcttgattgctcgtgacataatctgagtacaaaagtgcctatcgagttatggatttccatcttcctatgctttccgtttggtttgccaatggatagttgcctttgggccgattcctagcacccgagggcttgttggatggaccgaataacgcaaggtgctaagtattattcggaataaatcaaaagcatagagataagataatttattttctgctcttaataattgcaaaagtacccgagtagtaaattctgatccgtgaaactttgttccattaatgacgaactcatgttactcatatgcatgtttgggaagtgcctaggccgactcccggtgcttggtggctatgactagtcgggcagagtgtttaaacgtaatgagtcatctactcgaggaaatcaaaattgacgagaggagaaatacatatttataaatattttaaaatgcttgaatttttctcgagtattatatttacatcagatactactcatcctatctgtttgttctgtgggatccagatccagatatgcataaaaggaattcatggctttaagcttatctcctacgcttcaggaatggatcagtcagaacatcaccatcggcttgccttcgccgccgccgactggtgtctccgcctgcacggctggcctattatgccgccgtctgttgggtgtctacgtcttcactgaccggcttgccttcgccgccgccgactggtgtcttcgcctacacggctggcctattatgccgccattgttgggcgtctacgtcttcaccgaccggccgcctcgtctgccgccgactggtgtctccgcctgcacggctggcctattatgccgccgttgttgggcgtctacgtcttcaccgaccggccgcctcgtctgccgtcgactggtgtctccgtctgcacggctggcctattatgccgccgttgttgggcgtctacgtcttcaccgaccggccgcctcgtctaccaccgactggtgtctccgcctgcacggctggcctattatgccgtcgttgttgggcgtctacgtcttcaccgaccggccgcctcgtctgccgtcggctggtgtctccgcctgcacggctggcctattatgctgccgttgttgggcgtctacgtcttcaccgaccggccatctgccgccgactggtgtctccgcctgcacggctggcctattatgccgccgttgttgggtgtctacgtcttcaccgaccggccgcctcgtctgccgccgactggtgtctccgcctgcacggctggcctattatgccgccgttgttggacgtctatatcttcaccgaccggccgcctcgtatgacgccaactggtgttatcatcttcacggctggcctcgtcgccgtcaccgctaatcggcgtcatcatcttcaatgcaagctgtctacgtctgctgccgactggtttcttcacttccatggctgcatgattctgccaatgttgattggccttatcgtcttcactgccggtcgtctcttctgctgttgactagtgccgtcgcctctactgctggtttatattgctaccactactgatggacgttattgttttcattgttggccgacttgtctgacgccgactggcttgttcacctccacggctgcgcgtcttcatcatcattgactggcgtcatcgtcatcgccggtttgccttcggcgctgcccatgatgtcttcacgttcatggctggcctattttgcgctgttaaaaaacgtcttcgttttcatcatcattctacttcttccgttgccgactggttatgccgccgccaactggtgtttttatcttcatgactgcgcatcttcgccaccggtttgcttctgttgccgccaactcctgttcacgtcatcacggctatgcaactttgtcgccatggtggagcgacttcatatttattatctttggcactagcaaacactattgcctctacttcgcaagttttgctacttcaccagccacgacgtctacaagagcttgggcatctcggtatgcgtcaccaaatatgatgccgtgtcattttactactacaagtggttctacaattttcaagattcctactcggacatcctcaacacatatctttactcaagcaatgactactcgatgacaagaagctacagttctcgactctatgttcaattgctttccaactaaccaaagagtcaggggatacacaaatacaagactcaaaattcgacaagttttatgtcaagatgaagcaatcaatcaatcgacaagtcaactctgggagttattattttcgtcttcgcttcagagccgacattttatttcagcgactccaattattacactgattcaatgagttggacaacagcatctactttcctccaagtgaagcatctacaacatctataacactaagttctgcagtcatcttcgtaaatcaagaagcgttgcatcagccttctttatgcacacgctcgcatcaaggaaactactcgagctttgatatcttgtcaacagtttgatggattattgtcactaacatcatcaccagcacctctgcttcatcggccctgacatctccgttgttgctaatggatgattatgtcttcgccgacttattatttcacattcacggttgacctactacgcaaacactgatgagcgtcttcatcattattaccgactattttcttcatcttcatgattggtggatttcgccatcaccgttgatgcgtgtctacgtcttcgtcgtcgacttgctttcgttgccaccgactgctctatcggtgttgttgggcgtcttcatcttcactgctagctgatttgattgctgccgactggtttcttcgtctccacggctatgcgacttcatcacctttaattggcgtcactgtttttaccaccaccaacatcttcgtcagctttgatggatgatattatcttcatgttggtcatttcgtctccatgccgactacgtcagctaccatcaatggacaattgtgactataacagaaggataagctacatgcttaggggctcatcgacacaagcgcgagggttatatcttcaatttggacttgttccggatacatgcaacatgaatttgatgatcatgggtctattttctacgctcaaagactggactatttattattccctgtaagggttatcaaccgaatacttgcgccagtcagaattcaattattatatctattttggagtatcccataaaggataatcattcagatcagaagctattcatatgagctgcacttggtctatataacccgaaagatttattactcgggaatatgttacatgcgtcatcctttaaagggtgtcgaaggcatattttttggcctaggcctaatatgtctgcagcccatattttcaggtgtagcctgtcacgttttttagggacttaggcatctttttgcttaggcaaaagtgcgcgtgattatgtgcccaataccttaaaatccttttataccgcagttattcaactttttaggagttggtacaatgcaatttaaaaggtgccaaacagtaatgctttatatggctccccgctgacttttttatataagtcaaggcgctgtttgggttcataaagcaattgattggatacaatatcattgcgttttgccacgtaagtgtgcacttttattgaccaatattatggtttaggctgattatatattttggtcattttccaggcggttggtaaatcctttatgagtttatttactcggattttataccacatatgccatatatttccaggtgtggtggaaccatgtgtcttctagggacttaagcacatctgttaaagcaatgtgcgtatggcgtatgcccaatactttgaaaatttctttattcacaacatacaagcttctttatagttgttttgctatgtgaattttcaatgatatagccaactttaggttacactcatcatattttacaaagcggttggtatatcactcggatcatgttattcagggattcacaccgcatatgctacatattaatatcaagtcacttggttgactataattatcaaagccactcggttggttggattattttttccttaactatatgcttggtttgttcaattaaccacatagtcgggggctacacctattaggtgcatctagtcgatgcacctgactttatttttcagccctccacagtcttcagatttggtaaaagtactcgggagaccatggcaaagatgattgaagcactcggctttggagtaatctagttcgagagaagattatcttttcgactgtgaaggtctcaggggctactgtggagattatgggtaccccatacccacacggcatggttatccgactagttataggggataacttatatttatggaatatgtaacagttcatgacttgggtattacgtttccttgtatattacagaacggcctaaagtcctagtttggtaatattgtaaagtagatttaggaaactgataccgtgttggttaaggtttttatcttgtaatcctgcctcccatcctatataaggtgggcaggaggccctctagggggcatgagacaacctgatcgtcagataaataaacacccggtggattcaaatccccaaacaggagtagggtattacctctcattgagagggcctgaacctgtctaaatccctgtatctgcatccatccacttttaggtctcgtacgctacccccttttcatattaccgaaaatttgtttcgacacgttggggaggtggttgtgatgttggcgccgccgtcatctgggtcgctgccgccaactaatcggacaccactgccgagcgcctcttcaccgagcttgtcgtcctcccgctggctcaggcacatgcatcggcgcacttgcaccctagccccccgagggcgccggtggcattgtagctccgaccacgccaatcgaggccgtcacgaacagcgacggcgcagccgccgccgctccccgcgcgagaaagggagaggtgaggaacattgtgcacatctgcgcgtaaaccccttcctggtggtggccacgaccaccagctcgtagaaggagagctcggtgcgaacctctcggggatggcggtgagcgagtgcgcgcatgcgatagcaaaggaggcggcactgccacgggttgacatagaggaagaagataatattaggatgacatgtgggtcctagttgctgattcagctagtcaatcacggtcaatgtgccacgtcagctgaaaccaccttccaaaccactcgaggagtctatttgcaccggttttgggagattcaggaggcgttttacccagttttttgcggctgagggatgcgattcgaccaagtgcaagagatgagggaggtcggatggacttattcccatacataatggcccgtcagagtgcatgggccggaatttcgagcctaccaaacaagcccagaagtatcaacaggccttcctggatttgtacctcatggcacagctcgtaaacaccacaagattgaggcaaccgagcccagccatcatccagaagaagcgatcaggtgcccctcgttgaggtcgtcggggatccaccccggccggccgccggtcgccgtcgcccacgacacggccgtcacgacgagcgagctcaggtactcccccgccgcgacggagatgaacccgagcgccgtgcacaccgtcttcatggccggcggcgcctggctgtagaagaagtccagctgccccacggtggcgagcagctcgccgacgcccaccagcacgtactgcggcgcctgccacaggatgctcgtcggctccatcccggcgtgcgccgcgcgggcgcgcctcgtctcgaccagcgccgccgcggccatggcgagcgcggccatggcgaggccgccgccgatcctgagaaggtcggagatgcccttctctctccccgtcagcctcctcgccgccggcacgaacgcgcggtcgtacagcgggatcaacacgatcgtggtgatgatctggaaggtggccagggatgccggcgggacgtggaaggagccgacgcgcgtgtccatcgccatgccctgctcgacgaacgtcgaattggcctgcgccgtcgcggtgtagtagaaggcgacgcacgcccacaggggcagcatcctgacgagaatcttgagctcctccacctgcgtcaccacgcaaagcctccatggattgcgcggcgcggcgccctccgcctcctcgtccgacgccgtcacgacggcggccttgtcgaagaatctgatcgagcagttgcatctcaagaattagccaattacattacacctacagcatcacaaacaccagatgcaacgagagacatgaactgaccggagatcggcggtgtgctcgatcctctgaactcccttcatggaggaggcatcctccgataggtcgtagagaagggccatgtcggccggcggcgcgacgttgaacttgcggacggcggcgacgacgacctggcagactctggtgagcgggctaccgcgggttgtctgaaacctgtacgcccgagacgcggcgacaaggcaggagagcccgacggcgaggaccatcgccggaatccccaaccccaatgcccacccgtagtggtcttgcacccacaccatggcggtggtggatatcacggacgcgcagttcatggtgaagatgtaccagttgaagtaggagcccttgctgatgcgctccgacgtgtcgccgtcgtcgaactggtcggcgccgaaggacatcaggcacggccggagaccacccaccccaaatgcgatcatgtacaggccaagaaacaggatgatcacttgagctgaagccatggacgacgtgtccttgatcagcagcggcagaagcgccgacagagccgccatgagcatgccctgcaccacagattaggtacgtacagccatgaagctgattggatttgcattcatggcagcacacagtggggaaagtgatttcatccctccaggaaatatccctcgtttcatccatgccaactaattagtcataaaaaaattaaaaaaaatggacaacataaattaatataaaatataaaattaaatgacaacataaattaacataaattaatattaatataaaattaaatgttctctcaagggataaaaatccacatcccacacagtgactgattacttgccatcagccataaattcacggcaggaaggacacagtgactaattctaattaaggctgtgtttagattggtataaagtttagattttggttgaaattgaagacgacgtgactgaaaaaaattgtgtgtatgaaaaatttaatgtgatggaaagttagaagtttgaaaaaaaaaatttggaactaaacacaacccggatcgaatgaaatggaggggactaacagcgacgccgatgcagcagctgacgaccatggtgcggtaccttccccagtaggaatcggcggcgacggctccggccagcggcgtgaggaagcaggtggcctgccacgtcgacacgttgttggcggcggcgacgttgctctggtgcagctcggcggtgaggtaggtgacgaggttgaacgtgatgccgtagtaggccaggcagtagcagaactcggtgcctatccacaatcacaaagcaagcagaataagcatctctcctcagtgttgtcatagctcagataaccacatcaacaaagaagttcctcatttattttttttttcatttttttcttttttggaacaagaacacacaaagtgagagacacattaatcatcaaaaaattggcaagtaaaaaaggttaggaaataattaatagagctgcagggatatctaatgaagtttattaccaagaatcgggcggcatgccatccatccgcctgtgcgatgcttcagcgccgggttgccatcgacgccaagagacccatcagtggtgtatgcttcttcaacctgcagcaaccaaaatccccagcctagttagcactgaacgtatccatgagcggctgcttcaaattaactaggagtagctagttcaggcaaggctcaatcaatatttttctgcagggaaactgatgagaaattaaacaaactgcatcgtggaaatcggcataaggctagcagtaaggagattatgaacagcgattaattaattacctcgggttgtagcagcgccactgcgtgttcctgctgctcagtgtccgtggacgccattgccggagccggtcgagagctcgaggacaaactgtacaagctaatcaagacctcgagaggatatacaggacaaccttatcccgtaccaactctatcagagacccaaaaggaaaataaagcgaataaagattagtatacaagttaatttagatacgaaggagtatattattaattacctcggcatgcataattaattgtggtttctgcgacattgaagcctcggaaattattgttgctggctgtactagcgtctatttcttgaacaagactgagaaatcccttgttccttttgatttctttagtcagtagtgtcactatccgcaccgatttattcttggacgtttccttttgtttcttgtatgcgagaagcagatatttctgacctacacagtgccgtgatactacctccgttcccttgtccttagcgttgacccgtgtggtttcatttctatcaaccactaaaaacatctaaattttatcgtgtaatttgatagatgcaagtagtatataaacttatattaagcatataaggtacttcgatgactttaaatatgaaactgttgctaatgaatggttaaaatttgtatatgaatggtatctggtgacaatggatggacggccgatgttgcatgcagttgctaagttgcagttactactgcaactgcacctgatccgaattacactatgggttcgtctagttgcctgttactttttgtcacactgaaatatattctggtgactaacttagatagtttggctctatatggttataacaagattatcttccaacaaaataaatctcatacatcaataacttggaaatttttgctaagattttcttgaacttgctaaggtgtggtgaaagtatttcaggcgtggcaatgatgttaagcacacaacctttgacaagtttggtaagggcctgtttagttcacgagaaattttttagcgtgtcacatcggatacacggtcacacattgaagtattaaacgtagactaataacaaaaaaaattacatattctacaaatttattaagcctaattaattcgtcgttagcaaatgtttactgtagcatcacattgtcaaatcatgacgctattaggcttaagagattcatctcgcaatttacacgtaaactgtgtaatttttttttcatatttaatactccatgcataattgtgacaggtgaaaaatttttatttggaactaaacaggacctaactttcattggtaaatggtaatgatagcaacccatgtgctgtgactaaggccgtgtttagttccaaaataattcttcaaacttctaacttttttatcacatcaaaacttttctacacacatgaactttcaatttttccatcacatcgatccaatttcaaccaaactttcaattttggtgtgaacaaaaacacagcctaaactgaatatgcctagatgtaacaccttatctctttgacttcttttccgatgacattgatttggatgtgatatttggcttggcttttctttttccttttttttattgtgaactgttagtttctttttggctggaactaacagttcagattatatgattgcgttgagagcttctttaaaacacaataatatagaaagcatagcaataaaatgaatatataaggttggcatatcacggcttattaaacccaacaggaacaaaaccacattatttgtataaaataactgtttggtgtctcataagaaaagtaacgaaaacttaattcaaaaatatatgttacattgatttcctattgagataatttagagaggaaatccattgaaattttggctaaaccttttgctagaaacactccaaaatatagaggaaattttcctgtcctacgaattcctttgaagcaatcatatcatccaaaggctctcaaatgttttttttaacatgtaattcctctataagatatttctttgattggtcaagcaagctagaagaatggggtggtcatctatttcatatatatacgcaggtaattttcagggcaacccattggctccggtcttaggcacaactacaaaagtgtgaggaagatagtgagcttttaaaggctacatgccgtattcttaagacaaccgttatgcaactttttatcaattttggacggaggttcacaaacagaattcaataattgtgtactcttaatcttgggttggcagtctttagtttgttttttcttgatggttggtttcgtcttttaagtttctttgaacttcactcattttaagtgtgaggttgtaataattggctgtagctttttgagcaaaggccgggatactctatttcattatctaaaaaaaaataagaatgtggtggtagatatggccacaattgaataggtggcggcaaaggtggtggtgtttgtaacgctccgcttttcgcgagacgttaaaaactaattcgacaaaatcttatatgcgaaaatttagttctttgtgtgagagtctaagttgtgccaaggatctcaatttaatcccgttgttcctcctcatcgaaatcaaaatcctccacctcaaaaattcctcttccgattcgagtctccgaaatcaaattccgaaagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactcctccctctcatccaaatcccaattccggaagtcaatctctcccttccttgaactcgttgccaaatccttctctcgatttcgagaggatcgatcctcatccgaatcatttccttgacctcaccttatgctcccaagaacaaatacccaagtattccttttgaatattttccatgacttctccttgagtttcccttgatacatccctaaacccttgagttcgaatatcaaatttgaatttgaatccactcctaatcagtcttctctacaaaagtctattttacctccctcgggtgttgtgggccgtattccccctcagcccacctccctccctcaaccgtttctcctccctcagcctcgcacgtgcgttgcacgtgccaagccgagccgagctctctctgtttctccttctctctcggctctctctctctctctctttctttctctctgtttctctctctccctcgtcgaactccctctccccggcgtcgatttcccgtcgtcgctgtttgaatccggccgcgccctcacgtccgcgcgcgcgcgctcgcgcgtggccgaccgcccggtcgccgccgcgtcggccctgccgcgcctgccgcgcctgcgccgcccggccccgctgccctgccgcgctgcaccacgcagccgcacggccccgcgcgcatgcccgagccgctccacgcgcgtcctgccaaaacccggaggccgagctctccctctccctcctactcctttcccgaatcggcttggagcgagcctctctttttcccccttctttttccctttccccgaccaccgccggcgtcatcacctgtcgccgcctttgctgcacgcgtcgatgaccgccagctcgctctccttgaccgccaatgtcggttcttcctctctaaatcgacattgccatctattaaaccaagccgccccatctccctctcgttcattccctcgccaccaccgtgcccttgccgccttgctaccgccgtcctcgcctccctcctccattgcgcgtgctggtgaatccggcgtgtgcgcgaggagctgacgcgggactccaggcgccgtctccttccccttccccggcccgaggccggagaactcgctcccgcgtcggcggccgctcgtcacagcgtccgtctcggctcggtagtgcctctcccgttctccctcctcgctccctctcctctccttagctctgggcagtagtgcgagtagccttccagtagtaagctggcgccgccccgaccgccgccgctgctcgccgtaggctcgccgccgtcgccgcccaaactcggtagtagccgctcgtcgtcggccttcctcggtgtagctccacccaatccgactctagaaatgaactcaggaggtcgcgtagatgctcaagtccctaggaatcgagctctcgtcgcatcgtcgtcgtttccctcttttgccgccgccggcaagcgtcgccgcgattcgtcgtcgccggcctccctccggcgaatccgatccggtggctcactccctctcgtccgtcctatcgttcaaatgtactccctctctctcgaatcgtcgcgacgagctccggtgaactcggccgccgtccgccgtccatctcgggcgcctcctcctcctcctcccctttcgcccctgcccgcgtggccgaccacgtggcagcaacctcagccccgggcccgcttgaccgggtcaagcacctagtcagccgcccccaccgccctttcttctgtgcgcgcggtccacggagagcccttaggctgcgcatgggccctccacctcttggtccacccgcgtgccgcgccgtgagccgcgaccgtaaaaccctagcgccccgcgccgcatgaacccttccccgtgtgccgagtcgctgactcgtgggcccgtcccgggacccggcacgatggatccggtccacccggacccatccccctctctcttcctgcgcgccccgcccgcttgggccgcgccttgcccggccatgggccgcctcctcgcgcccgcgcccggcccattggctcgaccacgccgcgcttatcccttgggccgtacccgagccgccaaaggaagtctaaatctcatccctccttccttttcttatccaaagggattaataaatccttttccctttttcataaatcaattccttattcccaaaattccgtaaatcatttccttggtcccgcacgtcagtgacggtcaataatattcttgagaatattatttctataaatttcataaatcaatttccccttgttccacaaatatcttcctttgcccagaaattccaattaaacttccaaaattcatatctctcaatccgtagctctgattgactccgttttacttccagtatttccataaaattgagatctatttaatggcactactaattagtctaaataggatctttcttttggtctttgtttaggttttcgattgtttgcgtatagttgcggttaccggatttccgtcgatcgcgggttttcttgaagattcgtgaagcttcgtgaagaccttgagcaaggcaagtcaccctttgatcaattgctcctataattgaaaaatcaatattattttgtttgcaacttgcattattagaatcactcctataacatgcttggcctcggtttgcatgtcaaaccgacggacctacctagtagtcgcactaattcctgtaggctgtactaccctaattccttgtcgctccacccttgtggtacctcggtatccgtgctctctgagcgtgtataccaaatatcccacatacaccgttgattgtcgaaaatttgggaaatgggtttgagaagccttgaaaacccgacatgtggcgtcggtgggtttgaaaataaaatgagctgcgaaaactcgcgatgcgggggttgtgcctacgtggcactgtcccgtattcgcatataaggaccgattcctgtaggaaactcatcgaacataatcaaagtgcaaccacaaggtggaatgggacaccctggctaagtaactagtcggttcagggaaacctcgcatgccaatagttgggaaagccggggcggggtcggttggagccaaaccgggttcctggtaaggcaaggaagagaagcttgccagattaccgatcgagatggttggagtttgatttgtgaaaactaaaatgacctatatttatgtgatgatttgatccttctatgtggcatgaggtatccctgggtcggcttgggaaaggctttgttgcgagcctccgataccgacgggtgttcggaataagttcgtatcttgtgggtaaagtgtgcccctctgcagaggattaactaactgttcgaacagccgtgcccacggtcatgggcggatgtgaggtggttcccgtttcatagatttgtttgcctgtgctttgtgaaaagttgttgtggtgtgggaatcgtaaccagaatcagcctacgtggcagatggatgacctgagtggtcagaaacgaatctgtgtggttcgggatgtctgcgggcatcatagactaggcttcccgagtggaagcggattgctttgctgctgggcagctggactctgggagtccgagaaaatgagaaaggctttgggagccgattaatcaagtgaaatgactctgggagccgagaggtaatgatctgacccgggaggtcggtacattaccaattgagttgttgaaaagcatctcttaagtcgatttgagacgcgagtctcttttcagcccaaacttaacaagaagtgaatcacttagtgatttcaaaatgatttcaaacaaaggatttgcaaatcaaccttgcctctcttccaagcttgcattaaactcctaaattcccatgacttgctgagtacgaaagtactcacccttgctctatataaatatatatagttccttcgctctgaagctgaagatgaagtgaagtgaagattagggtttcgtcctggttcccagccgtcacctgtggtgttgggtgttagtccgttggctccgctgctactgctgttgttggtgtttcctcgtccgtgtcgtcggttgcattctcgggctgttctgagctgcaacctaagttaaggtaaataagtcctctatttattttaaggatttgcgatgattcatatttgtcaccgtgggtaccagcactatgtcctgggactggtaccgagatcgcggtttcgtaggaagcggttcgcgccgttattcctacgacacgcttctattaggtgccgttgtacggcggtgccggattggggtgtgacagttttggtgggagcaggagtagaggtgaagagaagggtggtggcgggggagattatgccaagtcaaatggtgaatacacaataatgaaaacaaaagtgatggtgttgggggtacggttagcaaaaccacgcggttattacatacagtaaccttttccattcttgaaaccacaataatcctcgtaccgggataaccactgcatggggcaggattacaactttagaagcctcccaaacaagccctcaaaacttaacaatccttccttgatttgtacctcatggcgcagctcgtgaacgccaccagattgaggcagccgagtccggccatcatccagaagaagcgatcaaggtgcccctcgttgaggtcgtcggggatccaccccggccggcctccggtcgccgtcgcccacgacacggcggtcaggacgagcgagctcaggtatacccctgccgcgacggcgaggaaaccaagcgccatgcacaccgtcttcatggcgggcggcgcctggctgtagaagaagtccagctgcccggcggaggcgagcatctcgcccacgcccatcaccgcgtactgcggcacctgccacacgatgctcgtcttctccattcccatccgcgcagcgcgggcgcgcttcgtctcgaccagcgccgcggcggccatggcgagcacggccatggtgagcccggcgccgatcctcagcaggtcgggaatgcccttctccctcccggcgagcctcctcgccgccggcacgaacgcgcggtcgtacagcgggatcagtgccatggaggtgagcaactcgaaggttgccagcgaggccggcgggacgcggagggagccgacgcgggcgtccatcgccatgccctgctcgacggacatcgaattgacctgcgccgtcccggtgtagaagaaggcaatgctcgcccacagaggcagcatcctgacgagaatcttgagctcttcgacctgcgtcaagctgcaaagcctccacggatcgcccgccgcctcctcatccgacgccgtcacgacggcggccttgtcgaagaatctgatcatggcagatgcatcttgagaattagtactatcggtttatcggtttataagatgttttgacttttgttaaaattaaactgttttaattttaactaagtttatagacaaatatagtaatatttacattctaaattagttttattaaattaataattaaataaacttttataataaatttattttgtgtcaaaatattactatttttttctataaactttgttaaatttgaagtagtttgactttaaccaaaatcaaaaacattttataacctgaaactaagggagtagctacaaattcaccaacagcaactcactggagatcatcggtgtgtttgatcctcttaactctttccatggagcagtcgtcctccggcacctcgtagagaagggcgacgtcggccggcggcgcgacgttgaacttgcggacggcggcgacgacgacctggcagactcttgtgaaagggctcccacggtttcgctgaaacctgtacgccggcgtcgcggcgaccaggaaggacagcccgacggcgagaaccatcgccggaatcgctaagcccagggcccacccgtagtggtcctgcaaccacaccatggcggtggtggatatcacggaggcgcagttcatggtgaataggtaccagttgaagtaggagcccttgctattgcgctccgatgggtcgccggcgtcgaactggtcggcgccgaaggacatcaggcacggccggagcccgcccaccccgaaagcgatcatgtacaggccgagaaacaagacgaattcttgagctgaagccatggccagagtcgaaatgttcttgatcagcagcggcagaagcgctgagagagacgccatgagcaagccctgcacagagcaaaagaccaaacttgaggtcccgagctgaattcatggagtaggttttaaattctcaaggggatgtggactggttgttttaatgtcactcaaatagttataaaaaaaataaatattaaaaaaacgtattaatatgtgatatatcattctacaaatatgcaagttaaaatttaatttctacatgtcacaactaaaaaaaaatactgaatatacgttaactagctgtaattcaatttttttccgttgcaatatataaaagttaaatttgcatttatatgtttgtgtaatgatacatcacatattaatactctttttaatttttttttccataatcatttgatatacaaccaacaagtgaatatcccctcaacagtatacagttactgattgtagtgggaattggttgtgactaacagcgacgccgatgcagcagccgaccaccatggtgtggtactttccccagtaggaatcggcgacgatggctccggccaacggcgtgaggaagcaggtggcctgccacgtggacacgttcttggcggcggcgacattgctctgatgcagctcggtggtgaggtaggtgacgaggttgatcgtcatcccgaagtaggccaggcattggcagaactcggtgcctatatatccaaaagcactcagataatcacatgaacaagaaattaagcacctttttcaaacagaaaacatcacaaaacacactaaattaaattaccaagaatcgagcggcatgctctccatccaccagtgcgatgcttcagcgccgggttgccatcgatgtcaagagacccatccgttgtgtatacttcttcttctgctacctgcaaccccagccaagttgaattcaggcaaggctgcaatgaaatttcaggcaaattgcatagtaaaaatagacatggcatcggcattgagtaacagcgagaccttggggtcaagcagcgccactgcgtgttcttgctgctccgtggaggccatggcgagaaccgatggagagatcgcaaactaagctattagcaccaggtgcgcgacctgattggtatactggtctacttatccaacaactctaccagaacccacaaaatgggaaaacaacaatagtttaggtgtggagactgattacagtgatatgatatgcagatatggtatatgattgctcttgcgacattgacgccttggcattttttttctggttgtatcgtcgatttctcaaacaatgacgagatcagcaagatcattattcttgtactttcgtctttggaatatattgtaggtcgtaacaatatgcgtctcgatctcatttctttcgatttctttaatcataagaatcacgatccacaccagtgtagtggaggacctgagtcatgtattgaactttctcatttattcctgtacgccacgtgcagacatatgtatatttctgtcctaactaccactgacatgacatcatctattgggttaatttgattaatgctattataaatgtgccaaattagaaaataatattaatattcgctatatcggctgggtatcacttgaattttttaaaagtgtaatcatatcatcgcaatcacgttttttatcatcagatagaccaaaatgaccccccacatatggaacccgtgtatcagtttcatcctcttcaaccctcccctttcattttacttcttcgtcccccccccccccgaccctctctctctctctctctcaagctgcatccgagcggagcggaattagaacgttgaaggccaatgggcggaaaggttggggagggtgacgctgcgcacggtgtcattgggacatgtggacactctttgggagcttttgcactgcttgcaggacggctacagcatgcgccgctctatttgtgaaagggcatgtagcctattggttgcagtgacctgagtagcacccaaagtcctgagttcaaatcttcatatgagcgaattgggttatttgagagctaagttccttgtttgataggctaagttcctaacttaaaaagactgtatatatccgattggatgtagaggctggataaaaatacccttctcttaaaaaaatgtgccgctccatgctcgacgggtgccacctcctcatccatctaagccaacgcccgcgagctcgtcactggcaagccggccacttcccatcggcactcgtgtgccctcagtgacgtcggcggccacactgcgaccatggctggtagcgagccaccaaccagttccttattgtctggttcgcgccgtgcccgctcgctcgcagcaggcatcaccaccgcgaacgccgccatcgccgcagggagtgctgcctccatggaggaccagtccggcggcttgctgttgtgctcgcatggctgtgcgggctcttggagacacggcgctgcttgatcttgacctgcgagatagacgcgacactccttccttctcgagccaacggcgagctcgagcaggctataggggcgggaggtcttgggagccaccgctatcgacgttgttgtcgaccccctcctatccgcaacattgtcgagccatatcgggatcttgttggcgagcagagagaagaaaatagaagagggaggagagaagaaaaaggtcgtgacagaaaacgtgacggagattgcatgattctaattttataattagtggcatccaaccaatatcataaatagtaatggtattttttttgatttagtatatttgcaatggcatggatcaaattaaccccattgcaccgtgtagcaaatggagaaaaaacaccaaagccctagcagcaggtggacgtggtttttctgcacctagggcctctgccgtccgatcgattaagcgattcgtgatgtatttcccaggtttcaatatacagcatgtaggtatcgtgtacgtccgaatcttaaggcgcatccagcggtaatgagcctaggtgcagcagcaggtctcccaaacaagcccagaaacatcaacaagccttcctggttttgtacttcatggcgcagctcataaacgctgcaagattgaggcagccaagtccggccatcatccagaagaagcgatcaaggtggccctcgttgaggtcgtcggggatccaccccggccgcccgccggtcgccgtcgcccacgacacggccgtcacgatgatggagctcaggtagtcccccgccgcgatggcgccgagcgcgagcgccgcgcacaccgtcttcatggcgggcggcgcctggctgtagaagaagtccagctgcccgatggaggtgagcagctcgccgacgcccaccagcacgaactgcggcacctgccacatgatgctcgtcttctccatcgccgtctgccacgcgcggacgcgcttcgtctcgaccagcgccgcggcggccatggcgagcacgaccatggcgaggccgccgccgatcctcaccagctcggagatgcccttctccctgccagtgagcctcctgaccgccggcacgaacgcgcggtcgtatagcgggatcagcgtgatggtggttagcatttggaaggtgagcagcgaggccggcgggacgcggagggagccgacgcgggcgtccatcgccatgccctgctcgacgaacgtcgagttgacctgcgccgtcccggtgtagaagaaggtaatgcacgcccacaggggcagcatcctgacgaagatcttgagctcctccacctgcgtcaccacgcaaagcctccatggattgcgcggcgcggcgcccgccgcctcctcatccgaagccgtcacgacggcggccttgtcgaagaatctgagatcagtggtgtgttcgatcctctcaactactttcatggaggaggcgtcgtccggtagctcgtagagaagggacatgtcgtccggcggcgcgacgttgaacttgcagacggcggcgacgacgacctggcacactctggtgagcgggctaccgcgggttgtctgaaacctgtacgcccgcgacgcggcgaccaggcaggagagcccaacggcgaggaccatcgccggaatggccaagcccagtgcccacccgtagtggtcttgcacccacaccatgccagaggtggatatcacggagccgcagttcatggtgaagatgtaccagttgaagtaggagcccttgctgataagctccgacgggtcgccggcgtcgaactggtcggcgccgaaggatatcaggcatggccggagcccgcccaccccgaaagcgatcatgtacaggccaagaaacaagatgatctccatggacagtgttgatgagctctcgatcagctgcggcagaagcgccgacagagacgccatgagcatcccctgcacgaacgaagcagagagaaaccaaactttgagctgaattcatggcgggacgcaatgattcgattgaattggggatcgagtcatcactaacagcgacggcgacgcagcagccgacgaccatggtacgataccttccccagtaggaatcggcgacgacggcgccagccagcggcgtgaggaagcaggtggcctgccacgtggacacgttcttggcggcggcgacattgctctggtgcagcacggtggtgaggtaggtgacgaggttgtacatgatgccgtagtaggccaggcagtaacagaattcagtacctatcagaaacagaataagcatcgcctcagtggacgaatcaaagaaataaattcttctttgttgaaacaagaacattaatcatcaacaaatcagcaactaattaagcataccaagaatcgagcggcatgccctccatccaccggtgcgatgcttcagcgccggattgccatcgatgtcgagtgacccatctgtggtgtatgcttcttcaacctgcagcaacgagaatccccagccaaagttagcactgaacttgttcaagcaagtcccaatccattcagccatgcagaaaactgaagtgcacagtgaaaatcgacataagaattgctgaggtgttcaggaagagcgagaccttgggttggagcagcgccactgcgtgttcttgctgctcgctggaggccatggcgaaaatccggtcgattgagagctcgtgaactagatgatagcacagccaccgagtcgagatatgggtctactctatcactcaatcagaaaccacaaaaagagagaaaaggaaagattcgttctactaatttaggtgtggatattagattactctggtgtggtatggtaccattcaaattgcgcttttctgacgttgacgcttcggcattttgttagtcgttgtagcgtcaatttctccaacaatgacaattgacggtaagatcaagtagaccattttttgttcattctactagctgttgcttatataatatcccttattccttttgatttattaatcatagtttttttttaaggacggatgtagtactactccctctagttctataataattgatgttttggacaaagttgaggtcaaacttttataactttgaccatcaataactttaaaaatatttagtttaaagaaactaggacaacatatatagatttgtctttcaaagcactataataaaagtaaacatgcatttatttattttgtatattataataggaaaataaggtcaaaaatatattttgtagaccgtgccattgtccaaaacgtcaattaaaatgaaaccggagggagtactagtctactacagtatagtggagagcttgtgctgtactgaggcccctgtttagttcccacgcaaaaacttctcacactgtcatattgaatgtttggacacatgcatagagtattaaatatagacaaaataaactaattacacagattgcgtgtaaattgcgagacgaatcttttaagcctaattgctttatgattcgacaatgtggtgctacagtaaatatttgctactgacggattaattaggtttaataaattcgtctcgcgatttacgtgcggaatctataatttgttttgttattagactacgtttaatacttcaaatgtgtatctatccgatattgaatattttcctctactcttggatgtgacatgcaaatatttcagtcccaaagtgacccgtgacatcatgttcttgacttttgctcagtgcagcaaattgagaaaaaaaaaactgcacaaattgccaaccatactactcctatacgtgatgtaagagtactagctagcacctcatctctttgggttttttcctccttttttgtggccgggcccttttttacattgtttttgggatttttttagccactagttttaaaagttcagattttattattacactaaccgtgccaacaaaataaagccaaaatcaggtgtaaaaagcggtagaaaagcgtgtgaccgagacggtgagggcagtacgtatgcacattgttgttggtttattagggtctcctctcgggcatgactaataacaatgtgcgacctcgaatctgatctcgggtagaagtttaggccattcccaacccaataattagaatggtgttcatagcattaaataagctgtcatatatgatgaaaaatgatgtgacaaatgaataaatgaggaaagagaagaaaaccatgagtcttgcatgagacatggtttctacacaacatccaagacatcatgtgaaataagtagcattaaatttaagtatagaataatggtgtttgtattggaagaatggagtctagtagtagtttttcgatgatgtgaagtttatgaacactatgtgtagtgttttgggttaggaatggccttaggtaggttctttccggatccggcttctctgactttggacggaaaaagcatagaagaatagtaaagtgtgcctggtgctacag

SEQ ID NO: 60807 - DNA, 8368 bp, Oryza sativa
tggttggtttgttgccttgcttagctgcaaatgtggaactctacattcccctgacttgtagtaaactgtaatttttcgcgagttgttgaaggcattttaattcgaactgacacttttacacttgcaagtgtaactgcaagctactaaaatggtagtagaatctaggggctgtaattcaagttacctttgagcccagcttatcttaaggttgtttctggtgcaatactctgatatttgctagaatgatagatgcagttaggaaaataatgcagcatattgttgtttagttctactgaataggtatgctatgtggtttctgtcacattcacacatcagtagttcacttggtggtgccttaagtgaagcgcttatgattcacgctgatgtgttgcagtttgtgttcaacatcaactgaatattgggtaggaattaatgtatgtgctccatttgccacaggatttcaagtctgccactctctaggaggaggaactggttctggtatgggtaccctgctcatctcaaagatcagggaggagtacccggacaggatgatgttgacattctcagttttcccctcaccaaaggtttctgataccgtggtggaaccttacaatgccacactatctgtccatcagcttgttgagaatgccgatgagtgcatggtacttgacaatgaagctctatatgacatctgcttccgcactctgaagctcgccacacccactgtaagtgaaaacatgccataattatggtactgtgctcagttatcgtactctgctctatgtggttattgatcattgatttcatcctggtacatcagagcagtttataatcagtcacctttatgtcagatgccactaccaatttactcttttgtgaagtacggagtataatgaattagctggtccatgttccccattgttgtgtgtttcatgcatcctggcactacttgatcaattaatgagtatgtctggaacttgcattcgaatacactgatactgaatatatagatgataagtctgtactacatgtatggggtctacagtgttgatatgaatatgggtttcttcatgctgttttacctaattctgactctgctttgtttctttccttttgcagttggtgatctgaaccatcttatttctgcaaccatgagtggtgttacatgctgcctgcgcttcccgggacagctgaactctgacctccgcaagctggcggttaacttgatccccttccctcgtctccatttcttcatggtcggctttgcaccgctgacctcgaggggatcccagcagtaccgcgccctcactgtcccggagctgacccagcagatgtgggacgccaagaacatgatgtgcgccgccgaccccaggcacggacgctacctcacggcgtcagccatgttccgcgggaaatgagcaccaaggaggtggacgagcagatgctcaacgtccagaacaagaactcgtcctacttcgtggagtggatcccgaacaacgtgaagtcgagcgtgtgcgacatccctcccaacggcctgaagatggcgtccaccttcatcggcaactcgacgtcgatccaggagatgttccgccgcgtgagcgagcagttcacggccatgttcaggaggaaggccttcttgcactggtacaccggggaggggatggacgagatggagttcaccgaggccgagagcaacatgaacgacctggtggccgagtaccagcagtaccaggacgcgacagccgacgacgaggaagaggactacggcgacgaggaggaagacgaggttgctgcctaagccacctacctgcctgccattcctctcgctctcgtcatccatcgtagatgatgattgagatgtgctcccttgtgttattattacctagtactgtattgcaactgtcgatctgggtcgtaagatgtttattttaggtgatttgatgctctagttactcttttttttccttgtgttgattaatggtgtgttgtcgatgcgaattgtgatactagctttaactgtggacttaaattactagatcctggaattgatactgtttgccagtaatatcgtgtgttgcgtgatcattattttttccactacgaatacactgcgatgtcattagtgggcgtgtgctaggatgtaaacgtggatgcagttgttctaagcctccgtggtttgcttgttatctatcttatacagccaaaatttgaaatctggaacttaattttaagttaattttggggttcattcatctttcatttcccatatcgacttttaaaatacaatggcatgtgtatataagttgtgcccataaattactttggggtgcttagttcatttcccacggctgatgagccgtagatggaacaatcagagctgcaacttttgtagtattcgttttctgagccctaaatagctataatacttatacttgtttggtttgttttatagataatggaatttatttgagacaaatcggagtcagtaatggactttttcaaattttttggattcaagaattgtatcgatgtcccattcgaacaggcatcaaagtcgttgtagtatagtggtgagtattcccgcctgtcacgcaggtgtgacccgggttcgatccccggcaacggcgtttccattttttttaatatgaacgcgtctagtccgaatcgaattttggtcgggtacatatattttttacaccgatcgattcataccaacgatcgatcctacattgacaagttccaatgttgcgttgctccggcgaatcagatcatcgtcgactaatggccggtaccggcggcggcaaccagcagcgtcaacgacagtatggacggctacctgcttagtagtgtagtgttctggaaaaacattccaaatggtaacaatttttttgccaatgccaacaaagattagcttcaaacaaaatggtgccaaattttggtatggttgagaatggaaacaaaccaaattttggtatggttgagaaatatcacaaacatcgatatttaatagtcatacgacaagagctctcaataatttaaaatttaatcatactatatgccaggatcaagtctgctcaacacaagcacaatcaagtgatgcagggacaaataccacgagtaaaacattactacatcgacattacaacaaaaattggcaatacagctcaagacatctccctgaatcttgccatagccttcttctggatgatggttttgtagctatcaccagcttgcgcctccagcgacgggtcagaagatttccgctgctgacttccaagtccagccctcacatcgacagatttagcctgcactggttccttgatgccactaccagtttttccgagaccctgaatatttgcgaaggaatagcaagcaaaagagattgccaatgtatactcaagtcagagaatattcgatttacacagcttccagactgaggaaatattggcaaattgattcttctgcagtcacagttaacttctcttgtctcacaaactactcaagcctactggagctattttccctcaagcattagtgatcagtaatttccacatttattctagccttacgaggtagagccaacaaacacaagtaaatcacaagaaatgatagtttatgggtcaaacaagatgataatataatccactaaatttccttgcgaggaagcctaccagcgagattcgacaatcaataagtcaatacattagctttacccataacagataaagatttgctcaactcagtcacaagtgcaggaaataaaattctacagcctatataatgcaacggcaagcccaatataaaaaacaatgagtggctggacaaacaaaaacggacaccagaaagaattattcaaatacaggcagcagcaaggaaagccatcaaagagtaataaacaaaattagttatagaacgtaccagtccttcttgccaacccatattgcgcagaatacgattgcccacattgctctcatctattgctctatcagcagtgataacctcataattttcagtattgccaatttcaccgctagaacgttcacccacccctggaggaaatggcattgaccccatctcacttggaccccttcgagggtactcaccagcttgacaaggaatatccagataattaatacaagtcgatcaagctatataaagagaaatagccttttattgtgccccctccgattgtgaatacctagttctactacaagtttacaactttatcaatttacgtatatttgtaatctaatgtttccttaaggtcatgccaaaaaatactccactcaactctacccatatcactgcgttttactatcttttagtttgcatgcttgtggtgttattgggagtctctggtcttattttattcaattcatgatgtgctttggtcaaagtgacaagtatctatgagtatattttacaagctaaatagaaagtactgtaatgacaaaaaaagctatgctgtggatggatagtaaactcttgtgctaaacaaatgaggctagaaaataatgtctgtgagagcattcttacttggatccagtccatcattatcacttccaagtgaagaagatgatccatatagatttcgcctttctgcagcccgatctctgtactgtgaatgtcctggagcctcagaaaaccgacgtttaccactccctgaaactccagatggagtataagatgctagagcagataattctgttttgaagggagcagaagtaggtgccccagcatttgctgttaacccacatgtgcttgttggtatgttggagaaagaatcagcaccaccagcatcagatggcgcatgaaatgcagtgtctgatctgactattcctctaccagagcctcttatgacacccataatggtagttcctaaactgttactgacaggtgtaggctttatatcagaatctatcatttctgtgggtgcagctgttcgtccaagagaattatagctagcaggcgagttcatgtccttagcatttccaacatcagatttaggcttagctttcactgcaaatccagttgaattgtgtaaattgtttaatttatcatcagcagagttggatggttccttgtcatcaaggatagcacgccctgcctggccttcttgatttctttgtttccacattgctaggacattattcatctttttcttattcgccaaaagactaccttttgatgccaacttgatctcttttgctctctccttttctttcttttctgcagccagcgctgcacttgcagcagcttgaacagcttcaggtaatgaagttttctcactttgtttaatcgtggctgcaggtgcagaaatcactacatttttaccactactttctgaggtcttcgtgctagtatttgccatgtccccagctgctttactgctgttctgttcactacaagggacatactgttgagtttgttgatcatatgaataccacactccagcattaccatcatagtaaagtcctgaaaacaaatacaaggttataaactgtaatactttaacaattgacatggagcaaacatttttttttaaaaaaaaggaaaattggaaaacatttcaaaaacaagtcacatggaaagtatttctgaattgatcatagtaagaaaattgtggcaatatacataccggtatttccatcataatagaatcctgaggctgaatcatagtaataaccagacttttcatcccaaacaaatccagactgtggagcagagccactgctctgaggttccgagttgctattcagtttgtcatcaggattgtactcttttggggcccaacctatagcatcatactggtccaaagggtaaaagaaataaaataataagcatcatgtctataatctgcataaattgtatgtgaaaaacaattgcaccttaccctacagggtgagaaattattggttttagtgcatcatttaatggagttacataacagcagttctcattttcttcaatgcactgtttactttcctgtgcacatggtgacaaattacaagtaggggctacaactgacctgctgagaaaatgatgcagcctcaatggcagctgcagcaaggctgtttgactgtgaagcccctgataccggtccatgtgtgcttttagcataagttacacgtaaaacctgaccattcttctcaagtgtaatcccattcgtagcttcaagagcttttgtagcttcttccacctaacacaattggatgcagataaatatgggagtagacatcaaaggaaaactcaacatttttcccaccactacttactgaatgaaaatggatgaaagcaaaacctctggacacatgagtaaacttatcccgaacaaggcgaatgtcctgcacaacaacagcatgtcattctctcaacagaaacggaacactgcaaatttcaagagtcataagcttcttcccacctttataggtgcatgcttggcaaattcatatcgaagcatttcctcgtcagcattttcatccagaccacgaacaactaaaacatgagttggacctgaaaatgctagtgtctaataaggcaactggcaaaatagttttaataatcctacaatagaagaacagagctttgcctagttcagatcccctttttggatggagtggagtagaacttgttggatcagctggtagagaatcttccgttcgtggttcattacactacaagaatagaatgcaattaggcaaaaaaaaatcaagagcttaaataaacaaacatacaatcagttagaaagaaatgttattcccctgatgcctttataattgtcatcttggtccttggagatagacaaagtagttttcatgacaaattcactaatggcattttccatgtgacacatcttattattttgtttatatttatactagtggctaatgatccaaacatcatgagttaatccaaaagcttacagtttatgcaattatgacactacttaatttgcaacttctcattaacaatagggatgtgaatcgaaagggaaaacagtactccatcaaggaaatcgaggacagagaaacaatccaagcatgctagattggatttataaacagaaatgacatcatgcaaacttctgtaagacaatactaaatgcaatgggtattgcgatgaagaacacgcctacaaaaataatttacaacaatacagagtaaaacatacctgaaaacatgaagttctgcgagcaaagttcatgcatccacatatagtacatatccaatcacatggcgcagcagcagtcctgtgcccatagttataccttgtaaaattttcttctccatgagaaggcccactcatcccactagttggtttactactgcagtaaacaagttgccagcagtaattacagtggaagaaaaagatataagtatatacttttgcaaaaggtaagatgcatgtaaattgttttttctcaatgtgtccttctgcaaaactaagcttgatgcaagtaatacacactagacaaagacatgaataacatccaaaagaaaggaacgagcaacttaacacactgtgaatctttaacacaccaatggtagattgactgttttgcatcgcaagcttatcacaatataaaaacatttacatgaccttagcaatatgctaccaaaataattagatatttttgtgccctatttggtcagtcatatgctatttggatcattgtattgctaatgcaatcacatagttcaattgaaaaaccttaagtgggaaaatagtgagcagtgaaacaacaaaaggcagagccacacgagaatttggtatatgaaagacatgctccagtgaaaaattactattacatgatgcacccagtttaaacagttcaaccattattgaaccatcgaatatgctgcaattgtgttgttcacacctcagtatcacgtaaagcagactactcaacaatgttacatacaagtaaactggtgaataaatatagacgacttcagctattataagaaaacaaaaagggcacgtacctgtactgaaaaaatacctttctaccatcaattagaaggccattgtctccaacaccttccatcattctgcgggcagcttcctgtagagtacaataaaatttctgagcatgacactacacgacggtctgaacaggtaaggtgatagatcttttacggttaataccacagtagggaagtcgataaaagcaaatccccgagacatgccagaagatcgttccttaattacgcgcacactacggagagggccccactcagcctaaaagatatcagactccaaatgattaaatcgaaccagacaatacacttgcaaccagtttaacagtttatgaagaggaacttgtacaagaatctggtttaggtcatcttcattagtcttctgggac

SEQ ID NO: 60808 - DNA, 6588 bp, Oryza sativa
ttttggcgtcccggaggcctcactaacaaagtagaccggccgcttcacctttccgcggggccgatcctcttcgctaggggccgtatctccagggcgctcttcatccgagaggcagcgcggggcgccctcggcttctgcgccgatatcctcggggtaagagggcgacaggcgcggccttcccgcagtggcccgaggctatcctgagggtcgggggcgcctgacaccgtcggacaagcaggcggagggccaactccggccgtcgggggccttgggccgccgttcggcttgggggcctctcggaccctgacttctccccgtgggtagcgctggaagagttcccttccggaaccgaggacggcgcacgcgcgcaggtccgggacgccgccgaccacatcgtccacagcttcgagggtatggcccctcggctcgcgttcgccctcgactccgacgaggagggcggcgacggtggtgcggacgacagcgacgacaaggctggtgacccgggcgcgtcggagtgagcccccaggcccccgccaatcttgaatagctttttctttcttcttccgaggccttcgggcccccttcttgtatagacttatttaatctgcaaccaaataaagaggaaatttctatgtcaattctatttgttgtgtgtatgagacgaggatggtctgtgccgcggtccttctgcgtcttggcttgatcaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgaggacaggatcgagcacgagcgtgctaattcaagccaagattcttcaaaaggaaacaatggcacagacatcgtccttaggaaatcgaaaatgcttttattgaaatacggaagagaaaaaagataagcccccggccaaccctgcacgcccggggggggtgcggggttggcccgagcccaagacctgacacccgacccccactaggggtagaagcgacgagggtgttcgatgttccacgggttaggcagctctgtgccgtcacccgtggccagccgaacggagcccggccgggggacgccgatcactcgatacggaccctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggcttggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccgggaccggaggggttccaggtccatgcctcctcctttcgagccactcggtccgcaagctgaaaaagctccgcggtagtctggggctctttggaggcaatcttttcgagcatgcggttgtgccgcacaccccccctgaacgcgtagatcaccgcgtgtgcagggatgcatggtatggtgttgcggacttgacagaaccgctgaatatacgagcgaagcgactcatcatcgcctcgctgtaccgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcagtggggttgacgctcccatcgtacttctcggtgatggtgggccggaaccttgggggccaacggacattccgaagactcgccacaaaggctctacagccgacaccacccgccgggggcacggagggctggtcctcacgtccgtgtcgaggtgacactctggacgaggaagcgccctccgttgcgcggggagtacgccggctattacgccggcgctcgatgtcgaggcgggcatccggctctccatgctgatcctcccgagtcgaaggtgccgacgagggagtggcagccgaatggcgtgcaacagccgccgctcgccgcgccctccgccttgatgacacggagccggtggtagcggcgccggaggtcttggtggtggcggaccgtccaccagcacccaggcgctgctgtgccgtcatgaccaagttggccacgtcgtccagccatcgttgggctggagactccgggtcatggacgacgggcgggtgtcgtaggagcgcgccagcagcctgaagcgcgccctgaggcgtgctgccgtcgccgtagacgaggaggcgacgctccccatctcgccgttctcctgcatcacctgcgactggtgatgctacggatttgtcgaccctctcaagcgcctccccctgcttagggctttggtgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggtgatgtatacaggttcgggccgctgcgaagcgtaataccctactcctgtgtttttgtggatttgtgtatgaatgagctccaaagtgtcagccaacttcttccccgttctaagctctaaatctggaaagaatcaaaacccctcctctatgggcaaggtcctccttttatacttcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaagtgccaggccacgtgggcgattgcgtctgcctcaagcctctggtcatgatactcccggtcccatatcaccgacatataccatgcatccctgcacacgcggtgatctatgcgttcagggggggtgtgcggcacaaccgcatgcttgaaaagattgcctccaaaaagccccagactaccgcagagctttttcagctcgcggaccgagtggcttcgtaagggaggaggcctggacctgaaactcctccggttccggagtggccagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggcagatggtgctctgtccacaacacctccctccacaatctcgcgaactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcatgtgctcacgtctctcgacggagcttcaaggctatgaagcgagagcttctggccatggcccctacccatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtctgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggattggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatattctggttaccatcagattcgcatggctaggaaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagagaccttactctcagatctagcggaaacttttgagaacctccgctccgcccgcataaaactgaaccccgataagtgcgtgtttggtgtacctgcgggcaagcttctcgggtttttggtctctgcccgaggcattgaggtcaaccccgagaagatacgagctatagagcggatccgcccccccagcaaacttagggatgtgcagtgcgtcactggttgcatggccgccctaagtcgtttcatatcaaggctgggagagaaggcgcttcccttgtttaagctcctcaagcgctcggggccgttcacttggacggaggaagctgaacatgcccttactaagttaaaggcatatctcagctctaaaccctaaaccctaaaccctaaacgctaatcccagtcctcgaaaagcgcgggtcggggctagtgcctggggagatccgcatgtcgagactggccaggccgggaacgtggtgaccgagggttatgggtgacccgattgtgggtttttcccgaatcccccccggaagttccccacgccccggggcccggttgggttttgggcccggtttggcgattttagctgaccgaaccgcgccccc

SEQ ID NO: 60809 - DNA, 3000 bp, Oryza sativa
gaacctgtatacatcaccgtgtctcgtgtgtcttgcgggcagacgatctttccagatacagagggagagcgagagcttgagatttcaccctaagcccccggccgaactggcaaaggggggcctgcgcggtctcccggtgagaagccacgagctccgtcatctggcgcggtcgtggaagaatggagacctgctggagacgcaagtcagcccctccgtcatcggcggcgctcgcccgcgccgtcgtggcccttaggggctctctcctctgaggccccgacccccatcataatggttagaatggaggcgcggtcgggatcgctgcagagggggaggatctcctgaggaatgcgagacacctccgcggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcgaagggcgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggactagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtgcactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccatgggaagggaaattgctctggcataacgccgggggctactgtcggtgatatgggaccgggagtatcatgactagaggcttaaggcagacacaatcgcccacgtggcctggcaccttcggggacgtcgggcccgagggtgaggtgtccgccctcctcctgatttcccccgagggggggggtcgggttgcgcttgccccggccccgagggccgaggcaccccgacccccttaaggaagtctgcgccacacatatgggataagtgagcacagctgtgctcacctaacagcatttattgcagtctggtcaagcgtgtcacgctgtatgcagcgcagtacggcgcgttcctttatccggtctgtgaccagtcacagaccggtcagatcacgggttaggtggcgactggcggtctgacgcacgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggacggcgaccataccaatctccgtccataaagagaggaaaagtccagtttggaaagaagagggtgcatgtggtatccccttgaagtataaaaggaggaccttgcccatagagaagggggattgattctttccagatttagagcttagaacggggaagaagttggctcacactttggagctcattcatacacaaatccacaaaaacacaggagtagggtattacgcttcgcagcggcccgaacctgtatacatcaccgtgtctcgtgtgtcttgcgggcagacgatctttccagatacagagggagagcgagagcttgagatttcaccctaagcccccggccgaactggcaaaggggggcctgcgcggtctcccggtgaggagccacgagctccgtcatctggcgcggtcgtggaagaatggagacctgctggagacgcaagtcagcccctccgtcatcggcggcgctcgcccgcgccgtcgtggccttatagggctctctcctctgaggccccgacccccatcataatggttagaatgga

SEQ ID NO: 60810 - DNA, 2470 bp, Oryza sativa
ggtggacaagaatgaccagtctgacattggtcgcgtcagcaacgggcaaccacgatcccacgttgcgcccgtctccgccgggagtggaggtaggtgtgggctgtcccatcgaagtgtcattcggacagcgaccataccaatctccgtccataaagagaggaaaagtccagtttggaaagaagagggtgcatgtggtatccccttgaagtataaaagaaggaccttgcccatagagaagggggattgattctttccagatttagagcttagaacggggaagaagttggctcacactttggagctcattcatacccaaatccacaaaaacacaggagtagggtattacgcttcgcagcggcccgaacctgtatacatcaccgtgtctcgtgtgtcttgcgggcagacgatctttccagatacagaggagagcgagagcttgagatttcaccctaagcccccggccgaactggcaaaggggggcctgcgcggtctcccggtgaggagccacgagctccgtcatgggtctttagccactaaataatctggaaaaagctcttctagaggagattattagattatagtaatctggcttatagattataataatatagcataataatctacttatttgtttcagcttactcctaataatccagattataataatcctaagctgaatcaaacagagcctatatttactttagcaaaaaactcgatgcatgcaccatccccactatttactagccaatagcaaatcaagatattgcatatgggttataagagcaggtacaatagcaggctataagccagctataaacatattttaaagagattaataaagagagagaagagcagaagggtactgatctgtagccagctacaacacggacttcaatacgtaatgtgtgtatgacaggtgggaccaggtattaatagtatagtaagcaactattgtatgaatcggttattacattggctatagatgaataggagctagtagtgggctgcactattgaccttgctctaaatacttgtgtgcatggatgcatgcatcaatgtccatttactccaatgcacaaataacgaatagacttaatgaatgaacacaaatatgtagatcatttagaaataatttgaaaaaaactatatgtagatcaatttggaatggagggagtatatagatcaatttgaaatggagggagtaccacatactctaccaaattgttttcttcagacaaacatggcatcaaacatggaaaataagacggtgactttctttcaccgtgtaccaactttccaattaattctcagcacaagctgtttcacactaaatctcctgaatgaatgctggctgttttgaagatgccatgtggtaatcacaatgaggaaagcagctaaacacaccacacactgaaatagcactatttcagcaaatgtagcacatgcatctacacctactagaaaaagactgagcaaactgttactatctttcggcagtcaccagcaacactatgaggttgcagctcaagcggtcaacaaccagagtagctcaatgccaggaataaaacaactggaaaatgcctaaattgttggagctaacaaagtaacaacaaaatcaaaccacagaagacagcaggttatatggaccatttatgaaacaagacagcaagtaggtttaatactagatatgaagatactacttcgtagtagaaaggaacagagcatccaaaaggaagtcagagtcattaggcatcatgattcatgaacagacaatctcttgttcccagtgaagatagctagaaaatataaggatgaaaagagatacagttggacaagacaacactatccatttgaagaattgacgaagcatgatagtgaagcacaaaaatttctgaacattgaccatcaataggctgtaagtaaattacattagtagaatacaaacactgaaatgactagagttgaaaagcaaccacattggttgctacaaacaatcgaagctctaactatcccaattcccaaatgctcattcaagtaacaaattctcttgctcatcattgaataggcaaaccaaagatatatgatatttgaattgtaatgttacattgttacctgaacaatctgctatatgtacaaattaagcagcaattttgctatgcctacaaacaataatactcatcatatctttcttgatattatctactacttacacaaaatcatcaagcaaaaggtagcaaaaagatgcaggtgatgatcaatttccaaatcataccaccattatcatctagtagcaatggcatcggggtggccatcttccgatctccagctcgtgatctggctcctcaggctgcgggtgaagacagaggaggaggatctcctcccacccgtgaggaataatctcctgaatctgcagttgcatcatgatgcctaaagcatgcaaacatgttgcgaaacaagcgtgggatgatgc

SEQ ID NO: 60811 - DNA, 593 bp, Oryza sativa
taatttagtcttggtattttacagttttcatgtccctcggccttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctga

SEQ ID NO: 60812 - DNA, 553 bp, Oryza sativa
ttgcgttgtggtcgtcctcaccaacgccgcaacggcgtcacgttcgcgagagatgggcgcgtgcgtggccggggagccgccggaatcttggatcttggcagactctctcgcgcgatgaggacggccaagaaaccgagcggattctgtagcccaaatgatgacaatgtccttcgttcgttccaactaacaaacacaacactgttgagccatgagagggacttggtactggcttgttttgtttggttggttgggtcttttgaaatgacgccaaagagaaagttagtgtttttgtactttgcaggtttgggcgctgtggatggacacagctttgtttcttggaaaagttgaaaagggactcggtttcaattggaagcatcctacagtactgacgatcgatacatgaacgagcatccatgtaagtacgttttgttatgtgccgcgtgacgaaaatgtaggatggaagatgggaattgattggcaaatgggattttgctaattaggccacccccaattactctcttattattgctccgaataaatagtttttttcctg

SEQ ID NO: 60813 - DNA, 1195 bp, Oryza sativa
gacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaatcagcgaagcatctacctaaaatcatactagtggtactatgagtagagtgtccactagttggggttttgtttaatctagggtgaacaaggaaataataacaataacaataataataggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaagctttattgcgtcagccgaggggagggggcgcgcggactgggtccacgggagtggggcccacgagacagcctcacggtccacggtggaccgggcgcacccgggctcgcaccggccggcgtcgtgggccccacgcgtcagccgcacccgaggacgtgggcggctgacggccgggccccacgcggcggccactcggcgcggccggcgggagacggcgcccgcgcccctatggtcgccggcggcggccataggcacggcggagcggcggccgagagaggggaagggaagggggaaaagaggcggcggtcctcggctcaccctaggtcgacagcgacgacgaaaaag

SEQ ID NO: 60814 - DNA, 1059 bp, Oryza sativa
aagtatagccactcctcgtggttttgtcaatgtataagtcatcattcacgatggcattagcaaatggttttatgcttaactagttaattttgtgtagtaagactagtgagcaactacaaacacattatgcacagactacagagttgtgccatgatgatgaattatttgaggaaaaaaaaaaggaaatatggactgaatattgtggatgtttgtcatgctattgactaagatactaggtcttctgattaacaagtcaccttttcaattgttgtaccttcccattttctcttcaaccttttccttcaactccttatccccccccccccctcatgtcatcagaattttctataaaatttgccatttaagaaaatatatgatgtaaattagttggagcttgaaaatgttacagttacaaaagcaagtatttacggcagaggaagcaatttttttctacatagtcaatatggttcaaatactgtatgcgtttgttcgatacaggtatctgtttttttgttctttctgtgcatccttaggatttctcgctcttctgacttgagatattgtagctctaagcctgtaatagaatccaatgattgtcttactgcaatactatttcagcatgttatccaatttgaatctacgcatacttactgttggttttacagtggatctcaattaattgtgattatgaaatttctcttgtcatagctgctgcttaccctagccatgctgtggacatggttcccataagaactcttcaggtaagtttttcatcttcatttctctcattacatggtgtgatgcaatagattatagttgcacaaaaagtgacgagggcattagttcagacacttcatatctgggcatgtgcatctggtgaaactttgtaagatgcacttatctttacagtactgatttgactagtatcaattccaagttgctaattctgcaacttgcttgcctgggatcatcagatgttacgttacaatgaagctttcaggatgagaacagtgctagcgcagttggcaggggcagtcgtgggatggaatactgttgctt

SEQ ID NO: 60815 - DNA, 94820 bp, Oryza sativa
ccggcaaaggggcaagccccctttctccccctcctttttcccttttcctcccgccggcgtcatcctccctgtcgccaatttggccgctagccggagcgtcagctcgcgccttgaccgcgcaagtcagtcctcgaaccgacattgccgtcccctttaaacccccggcctccccttacccctcctcttccattcgtctccgcgctgttgccgccgccccgtgctctgtctcgcctccgccgtccttcgccgagcgccgggagagccggtgcattcgaggacgcggaaggggacttcggccgcgccctctccttccccttccccggcccgaggccggagagattactcccgcgccgtcggcctctcgtcacagcgcccctcctcttctcggtgatgtctctctccgttctccctcctcgctccgtctcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgatagcgtcgagttcccgaagccgcgtagatgctctcaccgacgggaatcgacccctcgtagcctcgtcgccgtttccctcttctcccgccgccggttgccgccgccgcaatccgccgccgtcgagcaaacctccggtgaatccgagccattggctcgcctccccctgtcgcgaacaaccgcccggtgtgctcgcttctgcccgtatcaccatggttcgcttcgccgctcgccgccgccgcccgccgtccattcgcggccgggtcgtcgtctaccttccgccggcctgcatggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtgcaccgcgttcctccccgcccgcgcgcgtgcgccgcgtgctccctccgcacggcgagccgagccgttgacaagcgggtcccacccgggaccgcgcgtggtgagcccggtccaccggactctctctcccctcccccgcgcgcgcgcgcgcttgggccgttttgggccggccggcccattaagctcggccgagccgccccagatcccttgggccgcaccctagccgcccgaggaaagtctaaatttcctccctccttccttttctttctcttttccaaaaaaaaagggatttaatttaatccttttttccgttagaccaaaaatccaataatcttagaaattcaatatcttcccaaccgtaaatccgtttgactccgttcaacttccaaaattcatcaaatctcgagatctatctaatggcacgcttagaggtcgttaatagggctttattttcgctgtttgttgagttgccccatttcgcgtgtagtttcggagcccgaagacccgcagtgcgaggatttcgaggatcaagccccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaatgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagcgtaccccctcttcagaggtcattaaactgttcgaacagccgtgcccacggtcacgggcggatgtgaggtgattcctagcgtagttttgtttgactactgcttgtgaaattgctgtgtgaaaaggggttcggtgtttgaaaaatctgcagctgatgggatcagctaggcccgggtggccgtttgaaaagttgttggcctgggtggccgtttgaaaagttgttagccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcagaaacatcagcctttccttgaagcctgcattaaacacttacttcccatggcttgctgagtactcccgtactcacccttgcactatataaataatcccccccctagttgctgaagaagatgaagcgggtcctgctgatgaggagttcttccaggagcaagccggctacaatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataggcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttggccatcgcgaggctcactcttgctgcgccaatggaccaagacgacctcgtcgactggtggtccagtgctcgatgatcagtggacaaatgcaccttgcctagcctcgactctctcatgctactttgtgtcctggtgcctgtggaaggagaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcactgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgccgtatccccttctggccagtctgcaaaacagcccgggccaagtcagataaccatgcgcgtcatcctcccggtttacttataataatggaaagatatatcagccgctgcaccaccacaacctatatggctatattactagtgaaataacaaagtacatatgtttaaaattgtaaaatttaccagacagggtgtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagcaacttacatgaaaaaaagaaagttaatgcaggagcaaactatccagctaaggatgccatagtacttctgaaactgttgagattagttaaatcactcctgctgacaaacaagtggaagttgttcgctgtcagaggctgagggaaataatgaagatcgtatttcatatgattcaaaaagaatgtctgtttctactgtgaagttttaactgaatgtctgaatacattgcaccaccttgatgaactaaagaagaagaaaaactagcatggcatgctgataagttttaacccgtttctcgaactaggcttacacagtgttattagttccagttcatcagacagctattttgtgcatcgaatctcatggtgtcaaattcaatgatcaaactaactagtaaaattgcagtgaaaggcaacagttttctcaaagctaataattctattaaaacctggaaccggttaaagatctgatgaacttgtatggtatcatcaaccagctttgtgtatgtttttcaaaacaacaacaacaacaacatcttttgtgtacagacgaaggaagaagcacaatccaacactaccacacctatcaacataaaaaaaaggttgtgcatggatgcaaagaaaagaagagattctgagagggataaaataggagtaccttggattagtactctctatctttgatgatcggaattgttcctcttagcttgcggcactgccttttgagctcctcgttctcacaacgacagacatctagttcttgcaatgaactcggaaggccacccttgggcagtgaacagatggctggacaccagtcgatctctaatatcttgaggccgacgagtctgtgtaacccagtggggagggactgcagcttccggcaggagtaaaactcgaggtcctggagggaggagaggagcagaagggcctcactctgctccttggtgatgcgctccacctcatgattaaaaccaatggttagcttggtgagtgatgaagaaatgaggctgcagattggtggtgcaaggacccttgcaatgtcatccgtttgaagctgctgcagccgcgaggggtcagacctgacgaagaatttgggggtcatttggatgcgaaggtctgtgagttggccatggtcgagcagagaagacaagccctcaccacttaagtccatacatttccatatggttaatctggtgagagagctgaggtttgagaggggagcaagagtctccatgcctctcacatcactcagatacatcttttgaagggaggatggaaacgggaaacaagacaaggaggtcgagtagtaggaggagaggaaagtggggcaaccccaaatagagaatgctcgtagggagtgcaggccttgtaatcctcctcctatgcctcttaagcctccttccatgccatctacaagagaatggatctgcaggatcagctctgggatttcgctgatgttcaactcctgaagttggtgaggcaagagcaatagtcctgcttcagctgacactttctcatcctctcctcttggttgttgctgctccagtccgaaacgagcatcctccaacttattaccacaaggtgatgatgacgatgccaacattgttgtcatctgcttccccagcacaccaagccctcttatcttattacatctccttgaaataaacatggagagtttggggaaatgagatagaaacaacgtcaattccttcccgctacaaccacactcaaagatctccaatttctcgattggaaactggtagctgacagtgttctcagattcaagatgtgacatgacattgcttgagtcagatatagtgagtctcctcaaacatgatagcattaggaggtattccagcggcaaaggagggcatttcttcaaatccaactctttcagatcagttagattaccaaaaaccaatctcctccagaatgcaccatctagatgttcatcctttcccttgactagcatgcataattcatattgcttattttttgagtaatccaactgctgaaaatccaatccaactccttcaatcagcgcacggcatggagagcctctccaaggaatgggagggaatgatgacagctttggacaattaacaatctcaagctcctttagtgtacggagttgggtcaagttcatctcttgctccgatcgagggcatgtggaatgtgaaaatggcaactccgtgagttctggacaatctcttatgatgagcacctttagcagagagaacacaaagcaagaatcatttccaacccattttgctagtctctgtatgccaacaagctctaacctttttaaattcggaaagctcctctctgttgtacaaaccagggattcttcaccatgctcattaatcaacaacaacttccctagaggaggaaatttgttccagtctacaccatcaagacgaagagtttgcaagcctttgatggacaagttaacacccaaccatgaagggcaagtagtgcccccacgcccattaatgtgtagctcccgaagattgctatgtggtttaagactttcaaggatatgctcttcttgtaaagaatcctttgtcaaacgtttaatatcacaatctaatatcaacttgtgtaagcgacttttgtttgaaagttctgcttcctctggtgcctgcgcattttcaagattatagatgcccaatgacccttttaggtcttccaactgccccagctgtcttagtgcaaatgcctcaacttgtctttgaacttcaaatctccttaactcttgtaaacattttagctttcccacactagcaatttcagagtgaagattatcatttgggacaagaaaatgccgcatccttacaaggtgattcatatctcttggtaaaccaaagtgaccactgcattgtctcacatcaaggatcctcaggtgataaaatcttgaaataatgttggacagacttagttcaggaaaatatcccttattaatccttaagtaacgaagatgaacaagatttgaaaagttgtgcaacatattctccacagcataagatgctacagacaacaagatgacacggagggcttttgctttacttaacaaattaccaaaaggaatgacaaagcttccattgttttttccaaatatcattagagagtgtagcttttcgacatcaagcctcttacttagtgtgccaaaatccttcttaatattttcaaaagttgctctgtcgtttacgtccatgtcatctatcacaatagataagtgccgtatagatggcggaatttgcatagacattactttagtattacttatagaaagatattcatatgatgaaaccttcaatgctaactcatgtagtaggtcatgcatagtgtagtaaggtgacccatcttcattcacatcttttatgaaaaatccataattaaccaaatcattcaaatatctcaacccaatatcttcaattgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcagcattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaaggtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcagagaggtaccttctcttgatgtttctggcagtgtggtgagcgttgagcacaaggccaaggagacagccgctggcatgctcatcggcggcctcgtaggtgccatcgagctcgtcctggatgcggaagtagtcgagctcgtcgagcacgtcgtcggcatcataggcgaggccacggagctccaggagcagctgctgcagcgcggggttgctggtttctctgccacgggtgttgtgcagcatcccctgcgcgtagagcagctccatcttgatggcgccgacgtttggcccgagctccgtgctggccgcccacgcctccacgaaccctcccgacagcgggctcagcgccttgccaaccacccaccgcgccgcgttcacggccgccgactccattgatctgtctggtctctactccgctagctaagctgaggagagtgggagggatggaagagctgtggactgcgagagaacaaagcagtccaggagtagtagagaagggaatggtgaatagcgagcagacagtgaagtgaaggactaccaaaccacggcagaagtattgtttgttttctgaaccctctgttcgaactttaccaaatggtgttctcaaaaatggatttaaaaaaaccaaagtcgtcctgctcttcttgaatctgatgccattccgtgccatttggaagataagaaaaaaactaaacgtctaatcagcccccaaaaccataattagaacgcaatagtaaaggtacaggcggtacagccaatggatttacttaaatctgttgcgattgcaaaggtgcataatgccagattcgccactgttcattcagtaaactaccgggatagagcaatttgcctgcatgtgggatgtggcacagaggaagaacagatctgataagcaacagcctgtgctgtatcagtgatcaaagtaggcatgaacagaaacctgcaagcaaccaaatggaagtaactgtagtgtagatgcagagagcttaaggaacatacgcttcaaagcgatttgcgctctgggggtgcaggcacacaagaagagtagcctcacgtacatcgtggccggcgcagcggcggcgatcgtgtggaggcgcgtgtgctcgttgccggagcaaggccggcggcgggagcggagcccctcgccgaccgcccacccgccgagattctccgtgtctaccactctcgagtctcgagtgagtctccgatggtcgagtccaaccccaacaaccaaacagtcccgcgtgcgcatgtatgcctccactccctaggccaccccaccacatgtacacacacaaataactctattaaaaaaaacccatatattttgaaacacctctattaagagaattcggtttatttttgtttcacaaaaaaatatttcacctagtatactcacaatgttttactgtgtatagatctaatgttgcagtgaactgaaatattccattgcaacaaaaaagcccacatattttggaaaccccctattaagggaattcgttttatttttttttccaccaaaaaatgtttcacctagtgtacttgtaatgtttcaccatgcctacactcccctggctcaccacgtgtccacacacaaacaactctattgcaaaaaaaaacccacatattttggaacccctctattaagggaattcggtttattttttgttccacaaaaaatatttcacctagtgtactcacaatgtttcactatgtatagatctaatgttgcagtgaactgaaatattccattgcaacaaaaaaacccacatattttggaaaccccctattaagggaattcgttttattttttgttccaccgaaaaatgtttcacctagtgtacttataatgtttcaatatgtatggatcaaatgttgcagtaaattgaaacattctttcgctatttgctgaaacattgtttttatataaggtgaaataacacccgatttaaacgagtgaaacattttcagtctacttagtgaaacaattccgatatacctggtagaacatcgtgcaacatttaaaaataattcaataataagctaaaaaaaattcgtcggaatatatccatgtgtggtcttgttttaaagatttaattgcaacgaatttaatggtgcaatcggatcatgatttggataagtaatttaagagaaaaaacagtttaaagtaattttgcacgtaaattggacgctgacgtcatgctgacattagcgcccgatttcaccccctcccgattgggcgcctgaccaggagtcgtcccatttcaggtcccttaacttacaccgaatcctattttcatcccggaaccgaaaaaccagatacaacaagtctctcaacttataaaaccggtacaaacaagatccctcaataatattatccctaattttaactcacatacacctacgtggctaatttgactaggtcttcgtcctacgtggcattgattgacatggcgcttacgtggtagtttaattcgggaaaaaaaatgaaaggagcaaaattgaaaactaaataattaaaacaaaatatggggtccccatgtcagtcaaataagataaaaatagtgggactcacatgtcgatgggtcccacttcctccacctcactctatctcctcaatctcttcaccgaggcagtgccgctatcgacgacaacacaccgaaaaggcagaggagatgcgaggggatagggtgggagccctgcccatggcgagaacgcagtcgaggtcatctccgtcgcccccaccgacgcctagctccttgtctcctctagcgacagggcgggaatggagcggcgtgctattaacaccaaaatttggtaagcccgaagtcatcatcggcatagagtcactatcggcttcagagtcttggaatcggccgatgggagttgtcaagtcgccagcaattgtgttctatatgaagtcggatcaattaaagaaaatttatccaaaagagtccgagttcaaggaggatgcggcatgacaagtatatctattaattaagaatagtatgttagttttcttttatctctagaaaagtgtgtttatgtttttcgatacctaatttataagcaatccccgttcatcatctaaaaatccaatcatattcaaaaccactttgccaataatctttaaatttaaaaactaataatctcactagtgaagtgaagtggagcggagagtaaacatactattgagtgagctgatatcgtcatatcatgcgcctgaaaaggtaaagaaaaactattgcaaagttaagaacctcttcctgatcaacaagtaatagctatttgctctcagaggctgagggcaaaaatgaagcttgcattcatatgatttaagaagaatatgtgttccaattatgaactgttaagaattaataactgaaacaagtgttacgaatagtagaagaatatgaaagatcaacaagagtacatgacttgtcaatgacacattgacttgtcttccttaaaacaatacaatctctcaaaccgtgtcattaacattttgcataagttttagttcatcagataactactttgcacactgagtctcagacatcaaatttgacaaggagctgaactaacagatcattaatttccgtgaaagcaaacaattctctcactgacagaacagctgaaagattaaaaaagagaacagtgacaaaataagtatataaccaaataaaggagcgacagcgaagaacttatatgagatgttagtgtagacgctggaagcggaacaagttgacgtcttcacacttatcaacacaaaactgtgtaggatgcaaaagattatgcagaggcgctagaataaggcccatatcaatccaagatgaaacctgcacagcaggttacaaggttgatcagatcgatgagtcaagcagtgcgtgcattttaccaaacagaaagtaatcgggtatgagttgaaaaggggcatgtttgttacctgtaccttggattattagtactttctgtcttggatgatcggaatggttcctcttagcttacggcactgtcttttgagctcctcgtttttgctctcactgacatctaatacttttagtgatctcggaagaccgcccttgggcagcaaacggatggctggacacaaggcgatctctaatctcttgaggcgggtgagcctgtgtagccctgttgggaggaatcgcagcttcgagtaacaccaaaatcggaggtcctggagagaggagaggagcagaagggccgcgttttgccccttggtgaagtgctccacctcgtcgttccagccaatggttagctcggtgagtgaggaagcgagaatgttgcagacaggggcaacaaggagccatgtgatgtcatccgtttttagttgcaataatagcgagaggtcggatccgacgaagaagttgggggacctccggacatctagctctttgagttggccatgggcgatgagagaactcaagccatcagctcttaaatccccaaagtcccatatggctaacttagcaagagaattgaggttagagaggggtgacagagtattcatcccactcatataactaagaaacagttcttgcagggaggacggaaatggggaatgatgcgaggaggacgagtaggaggacaagaaattggggcaattccatatattcaaattttttatggagtgcagaccttgtaatccttctcctacgcctctgaggcctcctgccgtgtcaaatactaatgccagctctgacatttccccgatagtcaaatactgaagttgctgaggtaagagcagcagccctccatctgcggctgctttctcatcctcctctcctggttcttgctgctcctgtccgagacattcatcctccaacttactaccagcagacggcaatgacgatgctgacattgctgtcatcccctgcttcgccacaccaagccctcttatattctcacatccccttattacaaacattgagagcttggggaaatgggatgacaacagtgtcaattccttcccgctacaactacagttaaagatcctaagtttctcaacaggaaattggtatctgacagtgttctcggctttgtcctgcaacaagacattactcaagtcttgcatacagagcatcctcaatgatgacagactctgtaggtgttccaatggcaaaggagggcactttgtcaacgtcaactcttttagctcagttagattactgaacaccaataacctccagaatgcactatctagattgtcgtcctttcccttaactagcaagcataattcagattggttatttgttgagtaatccaactgctgaaaatccgatcccacttcttcaatataagcatggcatggacagcttgtccaaggaatgggaggcaatgatgacaacttttgacaatttacaatctcaagcttctttagtgtagggaattgggtcaggtttgtcccttgttctggccgagagcaagtggtgggatgtgaaaatggcaactccatcagttcagggcaatctcttacgatgagcacctctagcagggagaacacatggcaagcatcatttccagcccattttgacaatcttggtatggcaactagctccaacctttttaaattcggaaagctccgatctgttgtacaatccaaggatttatgaccatgctcattaaccaatgacaactcccctataggcgggaaattgttccagtcgacacaattcagacgaagagatttcaaacctttcatggacaagttaacacccaaccatgatgggcaagtggcgccaccatgcccattaatgtgtagctccaggagattgctatgtggtttaagattttccaggatatgttcttcttgtgaaggatcatttgtcgaacgcttaatatcccaatctaatattagcttgtgtaagcgacttttgtttaaaagttctgcctcctttgctgccttcacattttcaagattatagatgcccaatgatccttttaggtcttccaactgccctagttgtcttaatgcaaatgcctcaacctgtcttttgacttcaaatctccttagttcttgtaaacatttcagctttcccacactagtaatgtcggagtggagattatcgtatgggacaagaaaatgccgtagccttacaagattattcatgtctcttggtaaaccaaagtgacccctgcattgttgtaaatcaaggatccttaagtgataaaatcttgaaatggtattgggtagactcatttctgggaaatatcccttattaatccttaagtagcgcaaatgaataagatttgaaaagttgtgcaacatattttccaccacgtaagatggtgcatacaacaagacgacgcggagtgcttttgctttgcttaacaaattaccaagaggaatgacaaagcttccatggtattgtccaaatagcatcacagagtgaagcttttcaatatccaattgcttatgcagtgtgctgaaatccttcttgatgttttcaaaagtcactctatcatttacatccacatcatctatcacaatagacaagtgccgtatagatggtggaacttgaatagatctcacattagaactacttatagcaagacattcatatgatgaaaccttcaatgctaactcatgcagcaaatcaggcataacgtagtaaggagacccatcattttgttcatcttttttgaaaaatccataactaaccaagtcattcaaatagttcaatcctatgtcttcggttcttgtattttgatcatgtgaatgcaaaatgtctagtcctatccataagtgaatcaattgctcactgtcaaagatgtaatcttcagggaacaaagcacaatatgtaaaacattgttgtagatggaaagggagatagtcatagctaagctttaatgccggcataatatcattcttaccagtttgtaattcccattctttactatctaggattcctgtccaatgatcaatatcaaggtgctttctcaacaatcttcctacagtttttgccgccaaaggggagcccttcaattttttggctatcatttttccagtctcttgtaagttaccatgatcatttactgttttctcatcgccaaaagcatatgctttgaataattcccaaaacattttaggttccagcccttccaattgtattgaacaattagttgttttaaccatttccgcaaccgctggaaaacgagtggtgactacaattatgtttccctttgattgtgcttttttgaggggtgctaatagctgcttccactcatcctcataaaccaaattccatatatcatccaggacaagcaaaaatctctttgatttcaacctttgctcaatcaaatcatccggccaaccagagttctcttcattgacttttggtatcgacttggcaatctcctctttcaatctatacacattgaaattgagagagacacaaacccaaatattaacatcaaaatggttttgtacttctttgtatatttgctgagtgagagttgtctttcctatccctcctggaccaacaattggaatgacggttaggtccacgtcacagtaatcaccctcaataacgtcattgataattgtacttttctcaccctccctcccataaaatttaggttctatgaaatctgaagtggtcacaggacgattcatagcaatgctgcttggaagaacaactgcatgccccattttcccagagaactcagaattcagactcattgcaatgcactggccaatgctgcggtttgattccagcaactccaggttaaggatggtggcgaccttggcacagactggttttagctgctcgacgatgtgcttcattcttgtcgacagatccaccctatcaaacttcagctttggtgttttcgtggtgtgctctatgtgcaatgctttgcagggataagcgcagcagaggaaccggcttctttctgtagaaatgtttcaacggtgatgaaggtgtcacagccgtcatgttcagttacaaaagagaggcgtggaaggtgttttatattatcgatgagatagatagtaagtagtacctcgagcattggaaaagagcttgtgaatacagccgctgcctgcaagtgcctcctcatcattggcatggcgactctcttccccattatctccgcatgagcacgccttcttcttgatgtttctgactgtgtggcgtgtgttgagcacgagtccttggagacagcccttggcgtgctcttcggcggcctcataggtgccatcaagctcgtcctggatacggaagtagtcgagctcgtccagcacatcctcggcgttgtaggcgaggccacggagctccaggagcagctgctgcagcgcggggttgctggtctctctgccgcgggcattgtgcagcatcccctgcgcgtagagcagctccgtcttgatggcgccgatgttggggccgagctccgtgctagcggcccacgcctccacgagccctccggacagcgggctcagcgccttgccgaccacccaccgcgccgcgttcacggccaccgactccattgctctgatccctgcaccgctagcaagctgggttagagatgagaagcaagcagtggcagacgtgtaggggagaagaggctggaatgttactctggctaagagagaagcaagcaagcacactggcacagcgaatagagaagggctaaggaaacgtcgtgcagactgcagagttgagatccgatcggtgtcagtctggctgggcaaattggcttgagtgtaacatgcttaggcactacggcactaccttgccgcatttttatttggaatcagaaatcagtaacatgttctccctgcatggcttgctggctgcaatcttcagaggcttccctatttttgcctgcagcaagaatgttagaaatgcgtggttttcgttccagtcatccagtgccggacaaagcaaaagtagttttgcaggcttacagtacatctgtttgctgtgcaagtactgcagaggcttcaaaaggaagaaaaaaaagaaagagagggtgttatgaaagacaaaatggcaaggtaacagttatacaacaaagaagaaacaagtgttggaatattcagaccgggaagaaagcacaagcattcaaaatttctcaataaaaattaaactatccttactggggtaatctgttttccatttcttataaaaacaagcaggtttattttctacaatgacacgccatatataattctctgcagctacagagagtgtatacaatgatagttaaagataacttaaactcacaagaatacacgtaccttttttttccttataaaacaggcagtttatttttttcatcaaagtcatcagaacaccatggcaacggaacagaggtgcagacgttgcaattgaaaacgagcatcatgccgcattccccggtttgttcagttgaaacgaccatgatctggcataggcctcatcttttcattgaacaatattaaagctgccatataaccaaataattgatgggcaacttgcccactttcaaagcaattaacatggctgtacaacatgtgctctccttgagcgcagttgactatccattaggttctactaataatcagaaatctccgatcagcatcagtattcattttctaacttcagtttttcttgttaccacttgtgacctcctcttggcttagaacaacatgccacattcaccaaacgccagagtaaatatcaagaaagcaacacctttctggatccactaaaccatcaactgcgttggctgctatctcttcatggtatgttcatgcaggttgtgatctccaggttgccattcatgcctgcaacatcagtatgaccatgatctgccacttgccgcttgtgcaggttctctccagaggtgccattgcatgtgtaccattgccatttcaacagcaatatttcaggcttcacttataacacctcatcttttataaaaactttgatcttcagctaccacatgcttgaccacttccctttcggctcttttggtacttacctacttatcccacataaacttcatatcatctccaaaaaaaatacaaatttgaatgtgtatttcttggaagctacaacttcagttgaccggactcctaggccgctcaatttgaaggaggtggtttctggcgcccccaaagcccaccccatagccaccctccttcccacctccttcctttttcctctcattttcctttttccctctctttctactccagatccgttttcttgcgtttttgaagtcgtctggcgacttggtggtcgtcgggctggcgagggccggatccgcctatggcgcccctggagaaatacggattggaaggcagctgtttagggcaatgtggcggcagggaggtgtgctggttgcgctggtcaccggttgctacttgcgtctcctgcatgcgtgcggtgggatggcggatcagttgttggtgacttgatggctgtcatgctgatgaggaccagatccactggtggcgctccaaaaaagcttcagatctgatggtggtcgttcagggtggtacggcggatggtggacggccatgctatggcggtaccacctgatggctgtcgaccgacgtgacagtggtgatggcattggtggtggccgagggaggtggcagtggaggcggttaccagtcggccttgcactccatcgatgtgtggtcgtgccatcgtggttgtggtggcagcgaggactggtggcatcggcactcctgatggcggcgacgggcagtagtgaagttgggtggtgtcgggggctagtcctccgatccatcccttcctctgtcaccggaggagagggctggtgatgacggatagtggtgggggctagcttccccctgcaacgacggatcaacaaataggtatggtgatagttgtggacttgtatttcggccatggtagtttgtgatgacgatggcagatgctctcggtgtcagcatcctagggatggcagcgacttgacgaggtccgatgcccggttctgaccatgaccaggtgaggacgagggatggtgatcgtcgatgacagggctagttgacgatgcaatggtcgtcggctcgcccaacgcggataaggacgatggcaatggaggctcttggtgatggcatcctagggaaggtaggtaccaagtgagcatcggcgccaaggtctggttgcggttaggggtcgacggcagtggagcatctttgacaagttcttgattgtaaaggcagcgcgtgtcatactaggcggctccacgacgctctagaagcgacagtgagatcgatcgtctacagagaagactggtggtgcggcaaggcggcttcgtgacgcactaagggtgttcaaaatgcggctgcggcgtaggtgttttggatggcgacggcggacagagggcataaatgttggtagcagatggtggttgtgttccgtagaggcagagatggtgcgatgataggtagctcggactagtttctattctcctctttccccatattgcgctgcgacggaaagaataagtcatcgatgaaggttggagctaaatcttctaggtttttttttgtgtgtgtgtgtgtgtgtttagagtctaagaactcatgtatatgttttggttgtgtatatcctttgtggatatagaggccggattaatgaaaaatccattatctaaaaaaacctacttcagttgaccttatagcacaatctcatgctgattcctttcaaaaacttcagttgaacttttctcctcttgcagggtacttctccctaaaagctgcggcaactctgaacttgattggcatatgcattgttgcctactcaggctaggcagtgaccttctagaacaatgcagcagataagcaaagaaggctaaaatctcaaaaagaatgtgattaatgtatataaataaaatgcaatataacttgaacaagtaatatgcaagtctctgctgcagcatgtaatgtcatgcatcatgaattttttgccgagacggccgaaggaggtcacccaaattgtattaaggagaaagagagttataagttttacattaatcgactttagacagtcgaggaaaaaaagcggtcaccatagggtgacgcctctaagagctcttacaggcactgattaatctactcgcttaaagatctctgcttcatgaatagaggatatgaaaatatggttgtgccataacttcattgattgattagaccatatgtatatgtcaacatatactgtactagacctgacgaatcctagtttgtgcaccatgcttggtgtatgccctagacaacctatgggggaaaaaatcaggtttctaaaatggaaacgtccaatggaacttctttatcagcttgagaatatacatatcttcgctcgtgaccagtacgataccagcttcgtccatttggcatgttggataatatcatttgagcaactgatggttccaacaaaagtattactgtctctactaattagtaagtgaatggctgacttttgaactaactgttcattgtgttcgatgaggatactaaacccagagatcaagacatgcatgaccacccaaaaacatgctactcatagcatacactgcatgttacagacaccgttttatatgttaatttaacaattcaaaacaaagtaagcttttacctgcattctggaagttaaaatggagaaatgaaggatccaatcataactgattgtatatgaagatattggatgtgctctaacagaagctcatgttcttaaaatagaacttccatgcagacattgtgtccagaactgaagatagtgtcaatttcaactaaactgtttacatggacatgggaacacaatatgagatctgttcagttgatcctagatagaataagggagcacagaaagcagcatcatagtcatgctattgaaaccaaaggaattcactattctacctcggttagttggttggccacttggccttaaacaaaccacaaatcgatgcgtactaaactgcgaactatttttctataagagctaagtgtagatgtagacatgaagaactgattgactgtatgcatagaaaaaaaggtcattgaggcatccagactccagaaaatgctagctttaaaaaaaatccccaaaaagaagagatcctgaaatcccctttctgccattgctgatgctgtaggattacttggacaattgctactgctaataactgctggtactactcccaattaagcgcacacaaatgaacctctcgtaaaatgtgcactacaataagcaataacacatgccgcatcagtaaccaatacagccatgaacagcgaagccaaaccaaaccaaacggaacttacgcttcaaaagcagggtggattctggagttccgcacattgctgccggggacgcggagcgcggattctgcgaagcccgtggaggcgtcccgcctagagccgccggagcgcggcggtggctgaggcgggcgccgcctcaccgcgtcgccgtcgaccgccatccgccgcgagaaggagccacgccgctcgggaggcccgagacggagagattttccgctccgcatctccagcatgcaaatgggccgggctgaaggcccaattaaggcctcactcctttccgacggcccagtatttgggctcaccaacctctcctatattgcactttgtctaccattgctggacagcagtttttgtatgcgaatgactttattagtactggcatatgtcaaagcaattatacgagaagttggatagagaaatgttaatctgcaaccataaaacatctttagtgcactttttttcttataaaaacaatacaaacagttcatatacaagcgcacactcccacatataatgcacacctgtcacgtttgatagcaacaagatgccaacgtttttccctggagcttatggatacataaaaaatagaaagtcacccaagtcttaatacaatgatgcgtaatatttatgcgaattctccggaaaaaaaagtcagagagaatgcgttgccaagttcatgatctgcagccatcatcatctgatatttctttgtgcattgcggtatcgccgtccgtccaggctccaaaacagcccaggaacacatacgcccaaccaagtcatatccagcgtcccagaggcactgaaaattttcagaatcaaaatagatcaacaccccccccccccccccctctcactgtctctgcatccactcacctgatttaatttgaagcttcaatcaagcttcccgtatacatagagtacattcatatgcacagaactggattcaaactagttttttttagataatggattcaaactagtatacatagagtacatgtacatacagcataactgctgttggtacacacaacaggagtgcccgaatggattggctgtgcacttgtttagcagcacttctgattttctttttgattgcaacacttctaacaggatgactaagatcctgaaaaaaaaaacacatacaaaagggcatgtggataaataattggagtgaactcttttgttttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgttgtggggaacggcgtgaaggccttgttctgggaggataactggctgcagggagaatccatccgctgcaaggcgccggctctctatgctgctatcccggctcgcattcgcaaaaaaagaacggtcgcagaagctctgtctgataggcggtggatcaaggacatctctggtgcccttggtattcaagccattcttgagtatttatccctgtggcaagacattcgtgcagtgcacctcacggaccagcccgatgtgctttcgtggagatgggaggggtcgggcaattactcttcccgatcggcttatcaagcattgttcctagggataacccggttccagtctaccccgatctggaaatctctcgctccacctcgatgctagtacttcgtctggttagtggcgcttaacaggtgctggacgggtgatcgattgaggaggcgcggactgccacaccccgaccaatgtgtcctatgcgatcaatgcgatgaaagcatcgatcatctcctggtcgcttgcccaaagtcccgctagttgtggtggatggcactgagggccattggacaaacaagttctctgccgacgaacgaagtctccttccacctctagctttgcgatagccgaaagagattgaccaaggcagctcggcgtggtttcgacaccattgcaaccctcgtcgcctggacaatctggaaagagaggaatagcagcgttttcaatcagcagcaaaagacttgggcggaagtggcaagggcaatggccgccgaagcagaactctggagacttgcgcgagcagccattccggagttcttgccacagccaactgtcgagaggtcgcaacatcggataggagaatagatcttttggggcaattgtattcctgcatctccccttcacttcttgtatttcctgtaattaaactttttttccatccttaatacaaatatgcgctccttgcgtattcccaaaaaaaacgaaactttagcagcacctttcacaaaatatatctgaacttaaggagccgagcaaaactaagtcagctgatttatatcatgtgcctgaaaaggttaaaaaaactatggcagagttaagtaccttaccgcttcctgatcaacaagtgatgagttatttgttctaagaggctgagggcaataatgaggcttgcattcaatgataaagaatttttgcctactgtgaaatgttaagaattactccactgtgttaaattgaagaatatgaaagatcaaatgacatgcaaatgacatattgacctgcgttccttgaaacaatacaatctgtcaaactgataacatattgtataagtttcagttcatcagaaactagttattttgtacagcgagtctcagccagtaggcccagagtcggcccagtatcaaatttaacaatagcaagatcgtcgacggacagtgtcaatggcaggaggtgggctccttgcggatggcacaatagcgatgacatagcagagtactggagtagccagggcctgggggtagtttcagtggtcgggatcagtgttttttctgttgcacaggtcccggccttgcctgttgtgattgaaatcactttgtaaccttttctcctccaatctaataaaatttggtcggcgtccttcagccatgcccagcgataaataaattaccatgaaatcccacaattcttttttcgggaatacgcaaggagcgcattttttccattaagagaaataaaagttatttacatttgaaagaaaaaaaaacagcacgggactgatacaggacaataacagacaatcctaagtctatctctcacgctaattttggcgaccaaactccctcctgaattacagcgcaaggatcgccgggtttgctttacgccaaagagaggcttcgtccaccatccctctggccacatccgcccaagatctacactgctgattgaagatccgaccgttccgttccttccatattgtccatgctaccaatgtcaccaccgtgtcgaagcctcaacgatgtgactcacttagcaccattctgctatcgcacatccattggtgaaaagaagcttcattcaccagcaggcagttggggtggccgattgctctcaaagtccaccaccaaagctgccttgattctgggcagccgactaggatatgatcaatgctctcatcctgctgatcacagagaatgcagcggtcgggatgcggcaatccccgactccgcaatcggtcggctgtccagcatctattcaacgcgaccagccagaggaagaaatgacagcgaggtggtgccaacgagttctagatcggtgtggattcaaaggcaattcgtccaaggaacaaagctcggtaggtagattttgaagtgtatttgcttgagctttcccacttccaggagagtgagtcgggctctgcggaagaacaatcaactgactgaatcagcgaccaaagtttgaggtattcgagtattgcctgagtcccaagcgcgccacttatgtccttgatccatctacggttagacagcgcttcagccaccatccggcgcttccggatacgagtagagacatgatcgtagatggagggtgcaatagctcggatggttcctccttgcaaccaattgtcctcccggaaaaggattgtttgctcgttacctagctgacagacggtggaggcggcgacaaggtgaagttctttctgtgtgcaggggattaaatcccacaattctctcactgccaatacctattcagaacagctgaaagattgcaaaaagagaagagtgcgatcagacagataaccaaaaaatgagcatctaaagcatcagatatgaactcgtatgaaatgacagaccagtttttgtacacgtgatggaagcagcacaagttgattatcaactcaatggagatggatgcagagaagattctccaagactagaataaggcacatactaatccaagaaagaatctgcacaggatttcagaacaatcaggtttttcaggtagatgaatcacacagtattaacgttgcgccaaacagaaagtgaaccgggatggctcaaacaagagaatgttcattaccaatcaaatcccagtcgctgtctttgatgattggaatggttcctcttagcttgcggcactgccttttgagctcctcgctgcctccagagacatctagtatttctagtgaacttggaagaccactcttgggcaacgaactgatgaactcactgcacgagatctctaatctcttgaggctaacaagcctgtgtaacacagaggggaggaactgcagccggcaaaaactaaaactgagctcctgaagggaggagaggtgctcaagggccatgttttgctccttggtgaagcgtttcacctcgttattgcaaaaaatggttagcttggtgagtgagggggagaggagtctgcagatgggcacaacaagcactcctgcgatgtcatccgttacaaggtgctgcagtgatgaggggttgatcccgacgaagaatttggggttcttgttgactcgcagccttgtgagttggccttgggcgagcagagaacacaaatcctcgcctcttaaatcaccacattctatgcctaagttggtgagagagctgaggttagagaggagcgacagagtctccatgccacttacacggtcaatagacagatatttcagggaggaaggaaatgggaaagatgaggaagatgatgagtaggaggagaagaaatcagggcaatcgataatagtcaatgatacgagggagcgcaggccttgtaaccctccttctatgcctcttaggcgtccttccatgttttctccaagtgaatcgtggtggaggatcagctttgagcaacaggagatgaacaactcctgtagctgggtaggcaagagcagcagtcctgaagatgccgctgctttctcgtcctctcctcttggctgttgttgctcttgtccgaaacgtgcattctccaacttattaccagaaagtgatggtgaagatgccgatgttgccgttatctgctgctcagccacaccaagcattgctatcttctccaatctatacattgtcaagtcagagagtttggggaaatgggacagcagcagcgtcaattccttcccgctagcaccacactttctgatcacaagtttctttactggaaactggtatctaacagcgctcccaccttcaaccatcaacaaggaactacttgaaccatttatttcaagcttcttcaaacatgataacatctggaggtgttccaacggcaaaaaagggcattttgtcaagatcaaatatttcatctcagttaaattactagatgcaagtacttttgagaatgcacaattcagatggcccttctttcccgcaacccacaagtgtgatttagattggtataaatttgagtacttcaagtgctgaaaatctgatctcacttcttcaatcagagcacggcatggagagtttgtccaaggaacgggaggcaatgatgatagcgttgggcattttacaatctcaagctcctttagtgtagggaattgagtgctgtccatctttgaatatggcaactctataagttctgggcaatctcttactatgaacacttctagctgagagaacacacgggaagcatcatttccggtccatttttctagtcgcggtatgccaactagctctaacctttttaaattccaaaagctttggccttctatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcctgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacattttttttgaaaaatccaaaatcaaccaaatgattcaaacaactcaatgctatatcttcagttcgtttgttttggtcctgatgtgattgtaaaatgtctagtcctatccataggtgaatcaactcatcactgtcaaacttgtaatcttcagggaacaaagcacaatatataaaacattgttgcagatggaaagggagatagtcatagctaagctttaatgctggcataatatcattgtcaccagtttgtaattcccattctttactttctaggacacttgtccaatgattgaaatcaaggtgatttctcaacaatcgacctacagtttttgctgccaaaggggagccctttagttttttggctatcatttctccagtctgttgtaagatagcatgatggtttattaatttctcatcaccaaacacatatgcttggaacaattcccataactcttcaaattccagcccttccaattgtattggacgataagtcttttgtactatttctgcaactgctggaaaacgagtggtgactagaatcacatttccctttgtttgtgcgtttctgaggggtgctaatagccttttccaatcatcctcattactgcaattccacatatcatccaagacaagcaaaatcttctttgacttcaatcttcgctcaatcaagtcatctaggtcacccagttgctcattctcatctaggtcacccagttgctcattctcaactttaggtattgaatcagcaatctcttgtttcaatctgtacgcattgaaattgagagagatacatacccaaacattaacatcaaaaaggttctttactgctttgtaaatttgctgagtgagagctgtcttccctattcctcctggaccagtaattggaatgacggtcaggtccttgacacagcaatcaccatgagttatgtctttaataattctatccttctcacccttcctcccataaaattcaggctctatagtcgctgaagtggtcacaggacgaagcatagcaatgctgcttcgaatggtgcgatttgattccggcaactctagattaagaatggtagagactttggcacagactagcttcagctgctcagagatgtgcttcgttcttgtggacagatccaccctatcgaacttcagctttggtgttttcatagtgtcctccctctgtgatccccactgtttttcttttctaggcatgtgcgttgcagtagagctgtggtcgatatcagtagagccggtgtcgttgtcgtcttcatcggtacagtcgtcatcggcatcatgttcaccagctaaagagaggtcactgccggcaacagctttctcgtcacctccgcccgagcaacaagcagaaaggtacctcttcttaatgtttctggcggtgtggcgggtgttgaggaggaggccatggaggcagcctctggtgtgctcgtcggcggcctcgtcggtgccgtcgagctcgtcctggatgcggaagtagtccagctcgtccagcacgtcctcggcgtcgtaggcgaggccacgcagctgcaggagcagctgcttcagcgcggggctgcgggtctccctgccgcgggcgttgtcgagcatcacctgcgcgtagagcagctccagcttgacggcgccgacattggtgccgagctccgagcaggccagccacgcctcgacgagccctcccgacagcgggctcagcgccttgccgaccatccaccgcgccgcttcaacggccaccgactccatcgatcccaacgtgcgctgcagccggaatcgcgcgagctgcacgggcgtaggagcaaagcaagctgcagcaaactggtggaggagtagtggataagtggagtacacaagtgctagctgaacagctcgtcagttcttgctggcaatctcaacttgtttgttgttactactctgcagtggaggacccagcatggcagcatcaactagtccattggttgctacttgcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaacgttgggcacggatatccatagttgcacttattttgggacggaggtagtagtttgattggacagctccatccatccagtagaactcttgtttgcacaatcaagaagaacatagcccgatagatccaacagacagttaaccaggctgcagtgtgctctgggtctctgtgcagaataatgttttctaggttgccattgttttctgcagctccagaatgccagtggtcttgatcaagcaggcatgtgcctgttaaaggctgtctaagcaggtgctccccaatgattgctggtgcaccatacggagtaggccttttgcaccagcagcatttggcttcatttgcaatgccttaatatttgagaggagctctgctcttgaccaatagcagctgccatttgcttgatccacagagccctttagggaggctcttatggtaatgatcccacacagtcttcgtataatctccaagaatcagatgtgcatcagtgcatgtccaagtcttcgaagctgatattttggttgccattttctccacctgtttccaaaaccttgatgggcacttctaacctgacaaatcctagttgtgtgccatgcgcccatgcttggcataatggcatatgctagaaatagaaccacacacacacgcacgcacacactcgaaaataggttttcaagaataaaacagtaagaagattgtcattagcttgcaactcactgtctctcctaaatcctagtcagtgcaacccattgcctgacttgtactaaatggttcatgaggattgcctgactcgtactaaatggttcctgaggatactaaaccaagtgtgaaaaagttataagccaaagtttgaaatattgtgaggatcagaagtctatatccttacatgctccagttgatcactaaggcactaaacactcaatagtaagagcatacactgtgtattaattgccgccttctatattctattttaccagtttattttttagaaaacgggtaaaaccgggcctctacatccaacgcggatgtatgcaaccaaatactttaccaattcacatcaaagaaaccttaaaatgcattctgtagtttaaaatgagaaattaaagccatgcagccaatcataactgcatctatataaagatattgggatcgatagacaatggccattgggttcagatagtgcctatttcagctaatatgtttacatgggagaacaatatgagagccattcggtttatcctagactgaattgcggatggcagaaagcagaatcatagtcacggtatggaaaccaaaggaattcgctcttgtacctcatgtattaactatttctctaagctaaaaatgtaatgaatcgtccaattgcagaaatgaaccatcgattttatgcattgaaaaaaaatcactgagacattctagctcctaggacatgttagcttgtggcacctaaaaattccccaaaaggaagagatcccaaaatccaatcccttgattcccttctgcatttgtagatgccaggtttacttgcgctgactactatcaaacatacacgtgaaagtaaatagcaaaatggacatcacaatcaaattcaataagcaataacacatcctccatcactggcgcatgaacagcaacgcggaaccaaacagaaaccgctgccataaatgggggagatcaacatacccttcaaaagcggagtggtctctgcgggcgctcgcagcaacagcctcgcccacacgttgctgccggcggcgccggagcgcggcttccacgaggccgtggaggcaccccggcccggccacccgccggagcgcggcgagacggaggcggaggcagaggcgggcgcccacctctccgcctcgccctcgccggaaggaagccagtaaggctggaggcccgtgaccagagagagattttctctcccgcgtgccaacgggccgaaactaagtggcccacgttgaaggactccaatcatccggcccagtatgtggggcccacaaaccgcccggttgtcagcatgggccaggaaccgccatgcgggccccaccctcctcgaaacccgcgtcgagtggggacacacggcgttggactggcccgcgggtgaaaaggccacgtcgagccaagccggcccacgagggcggcgacgacgcgttggcgttggtgcggcggggaggcaacacgccagctgtcccgtctccttccggccggcggcgaccgtgcatgtgactgacgctgcaatgcccgggctgtgtctgtgtgcaccgccacgccacctgtctctcgcatcaccgtcacgtcaaggggatgcatggctagtggggtccacatggaggtggcacagggaatatcggcctggtctactacgagtaatctcctccaatcatcgctatctgatctgattaagcattagcagatgaaaattgctatgcatattatcccattatttgatggggatttgattcatgtagaatttgatcaatggttataaatgttgtagagcatttggataatctatagttgcgtgtttatgttcgtacatgagcaagatttcgtattcatgcttgcataatggcattgcacatttgcgtgcatcggcgtatgctgcgttttacgggtgccatcgtttggcatatcggtggaataagtcaaacggcatatttacaaacgaaaagtaatttgtgaataaaatttttatatatgtattcttagcgatctaaaagcaaagactgaaaaatatacttcgatgaaaaaaaatcccaaaatcaactcaaaatttaacgttgaaaattcaaattctgactgataagcatatgaatatgctaaacgatggggaccgtagtattgtagtattgttcttacatggtgtttccagtcgttagcggtcagaatccggttaaccttaccaactggaaccaggatgtctctcctctgtgcagcgttgaccgcatgttaattgcagcatgttcctgtgcctggtgccagagaatttccgcagacaaattcaatccatacaggtaacggtctagaccaattcgcaagtactactagtagtagtatagttctagcaaattattttccattttagaattgagattattatacagtacaggaaaatacatagttgagaccaaatcgtacgtgcagggcagattcggccataactttcacacaattggagtacagtacagccgtgcatgcaaatgaagtaggagtaagtcttgtccacatcgtactaatactaaaaatctagctgtacttccactactgggatttccctgctgcttcctttgatggcaagatggaaaccggccggtgcaccgttttccttccagatttgcacgtaccaccacccacttgatcgtcttcataagacagtttttactaataaattaatttttatttcttaataaaccgttttagtattactagaaaatatgggtaatcgatgaggctataacctaatacaaaatgtcttaatacaaaatgtcttaatatttttagcattgcaatgtgttatattttatagattagttttctattattttttctgttttataatatatatatatatatatatatatatatatatatatatatatatatatatatatatatatatatgtaatgctagaaaatattataatatgaaatagggggagtacgcggcagacggggaggagaaaaaaaaatcggtcactaatcagaagtataagacgaggagatcctgctacttcttccccatcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaaggtgaggaggtgcctagtgtgaagtgtgctttgctttgcttcgttttcttttcagtttgggggtgaaatgaaagtttcaggctttctcgtgatccttgattcgtggccacgaggggttcttagactagatcagatcttcgtggcacctgaattacttgcatactgtacaatatcattatttctttttttctatgatctgtgcaaagtgcaatacagctcaagtgcaggtaaagcttgcgtgttctatccaatctttcttctttcgatggttgcttgtagagcgatagttgcttgtaaactgccatccgattcgtcatcctggctgttgacctgtgttattccagtgatctatgaaacgatcgatctcgtaaaacttaagtttctttctttctttctctgtttgcttagttctgaaattacttgctcctgcatgctccatttcttagaggagtgcaattgcagcactactatgcaaaaagcttgtgccctcttttggagctgttctcaacaattggtcccatcatccttgtcatactgatccttaggagctcatatccaagttgtccacttgtggttttggatgatctcatcagaatcggctactaattagtactccaggtttgacttggtctggcctatgtatatctctggtacggactgtttctattgggaacaagtcgcgtcttgcacatggtatggagcaggtgttcctttcatttgcgaataaacctacatgtctatgtactgaaaatgtcaatttttgttaggttggtcatgatattcccagggacaagatcatggttttgtttatagggctattctactactgaagaagttttataaccagccactctgtatttttagttagcttaatattttcttgcaaaattgtgatcttgtagaacacagtggaaatggagttcttcactgagtatggagaagcaagccagtaccagatccaggaagtcattggcaaaggaagttatggagtagttgctgctgcagtagatacccgcacgggtgagcgggttgcaatcaagaagatcaatgatgtgtttgagcatgtatcagacgctacgcgcatattgcgtgagatcaagctccttcgtctgctccgtcacccagacatagttgagatcaaacacattatgcttcccccttctcgaagggagttccaagatatttatgttgtttttgagctcatggaatcagatctccatcaagtcatcagagcgaacgatgacctcaccccggagcactaccagtttttcctgtaccaacttctccgtgctctcaagtacatccatgcaggtaagcttaactactgataatccccaattccccaagaacctacttgaccaccattaaacacatagttctgttgatttatcaattaacatggaattctagcttattctctgataaatcatctatattggcacagctaatgtatttcatcgcgatctaaagcccaagaatatactggcaaactcagactgcaaattgaaaatatgtgatttcggacttgcccgagcatcattcaatgatgccccttcagcaatattttggacggtaaggtgcttatatgagattttacattcctctttaagtctttatgttattaattatgttctactttgtgaaggattatgttgcaacgaggtggtaccgagcacctgaattatgtggctcatttttctccaaagtaaggtcttcaacactagaattctttcaatcaagattaatgcttttgtggcaccatagatgaactggtctagttgtttttagcaatgctttcttttttttttcctttttctttatctatccaacttacagttgtgctaaatgaagtatagaaaattaagttatttttctttttgttgatattttagttgtttgtacatacaattttctatcaaagctgcgccacttgaaactggatgagtaacattcttgtagagaaacaatatactgtgaactcttttgtgcaatgctgatgctctagcgttccatgtgttttatgtgttctaacaatagccaatttgcatacagtacactcctgcaattgatatttggagtattgggtgcatatttgctgaacttctcactgggagaccactatttcctgggaagaatgttgtgcaccaattagatattataacagatcttcttggaactccatcatcagaaaccttatccagggtatgtttactttataccgattctcatatatccttgaacctcctattcagtaacattcaagaagatccaattctctaataagatgaaacaatcaccttactgttttctgcgtctctgcagattcgaaatgagaaggccaggagatacttgagcaccatgcggaaaaaacatgctgtccccttctctcagaagttccgcaatactgaccccttggctcttcgtctgctagagcgtttactggcatttgatcctaaagatcggtcttcagctgaagaagtaagctcaagagaaagcatagcatcctttccaaacctcaaaagtagtttttttttaaaaaaaaaaactttcagaaaacacacattttttatatgttatattctcttccaattttcaggctttggctgatccgtacttcgcaagtcttgctaatgtggaacgtgagccctcaagacatccaatctcaaaacttgagtttgaattcgagagacggaagctgacaaaagatgatgttagagaattaatttatcgagaggtacaaagcaatagctcaagtttcctgctttgtgttaataataaaattttcagcttttcaagattgataattatgaaatgcaaacagattttggagtatcacccacagatgctgcaagagtatatgaaaggtggagagcagattagcttcctctatccaaggtggagtcttgcattaatttttctttctttcatcagttttaaatttgacgtgacaaagatgaatatctggctttgttccagcaagttagcatggtgtacaatatacttctttgcaccaacaaaattgccttcgccaaatactcttgttggcaaagcaaatttactaagtatagtagtaatttgctttgcagtgctatcatgagttaatatctgatctattcttgttgctctcattttggtatatctttatttccaaggctcctttcacccgaaaattgcatggacattgttacaggaaacactagccatgtgtgcatctaatatatatttatcatgtccttgcatggttttctctcctttttttaccgtgaacatagctattctgttaatattgttatcttactgcagtggggttgatcgcttcaaacgacagtttgcacaccttgaggagaactacagcaaaggagaaagaggttctccactgcagaggaagcatgcttctttaccgaggtacataatgtggcaatatcagaaatcaaaagtgcagacctacttactttcatatcaattattgtactaacttctccattgattttgcatataacagggagagagtaggtgtatcaaaggatggttataaccaacaaaacaccaatgaccaagagaggagtgcagattccgttgcccgcactacagtaagccctccaatgtcacaagatgcacaacaacatggatctgctggccaaaatggtgtgacatccacagacttgagttcgaggagctatctgaagagtgcaagcattagtgcttccaagtgtgtcgctgtcaaggacaataaagaaccagaggtactgttactttgctgcctgaaatttgtctatgattcttataagtcggcaaagttgcatagctatgcacgatcgaacaaaagtataagaaatgatgcgtgaaaagaaaaggaattgactggtttgttgcataggtagtaactccatttccctttgcatttcccttttgtttttgctatcctttaggatgattacatctctgaagaaatggaagggtcggtcgatggattgtctgaacaagtctccaggatgcactcctagtgcacaacgatgacgatgatcagtgcaagattctgtgaggcgcaccagatgctgataatttccaagcagaatgctgcactgcaagtttggactttggacaatgcaagtatgcaacagccagcccgagatgattggcatcttcttatgctcatccatgttcacatattcttcttgccattgtgctgtctgtcactacaggacccctgcatggattaatgtattatccctctgatgtaacactagattagtccatctgtccatggaggaatgaatagcaagcagccagcttgtgcatcatgtgggcatgttcattttccagtgagatctagtcatatccatgctttttttgtaatggtatatgaaacagtttatcagtgagactctggtccattcctctttgaagaactgctgagacagtgatccattcctctttgaagaactgttcattttcagtacattaagcctagtaaagttcagatgtttgagttcggtgcttaataatcatgtcacacgaattttccaagatgaatgccaagtaggagtagtatgtatgagtgtacaattgcatcagaaattcaaatgaaattggcgaataccagacgtagcggaggagattcgttcgaagtcacaggttttggcggccgcgagtccgacgacccggaatgcagtttcgtacgttggagctggcagcacactgaagaaattcctgtagctgaatgccttggagagatgtggtatgtgatcacaagctcttacttaaaaaaaaaaggtaaactgcataaaccacatgttttgtgatcaaagttgtagaaaatcacacgtactttgatattcatgatgcgcgttagactactgatcgctagcattagcggtcatttctgagtgatcccatttccatttcatcttctgctactcaggatagtgaaaacatctgaagaaatggaagtctgaactctgaacaggtaaacccaggatgcattccttagtgcgacaatgacagatgacgatgatcggtgcaagatttctgccagacacaccagatggcaataatatggaagcaggacactgcacggcaagtttctttgaactttggacactgcaaacagtcgtccaaagatgttttgccacttcttatgagttatgcccacgcacaatgcacgttcatctactcttaccatcatgttactcaattcagatgcaaatcatgcaacattagatatttagattagatctggtccatggaggaatgaagactggccagcttttccaccatgtgagcatgttcattttccaaccaatggcatgtgaaggttatcatgtgctgttcctctgtaaaaagagctgtgctaatagatcaagaagcatcacctttcgcatgcaatgttttcttgtctaattgatcaataactgagccacacactcttttacaagacacacagacatcttcaagtgcgcagatgaaacgtcttccagaacacccctccattccagtactgcgagcaactctattgggagctgaatttactgactactgaattacagaaaggcaggagacatctcatgacgattttcttcggtcagaacagttgtcttcacaatattcttccaattcacaacaagctctctcctcagattgacccttgtccaaacagagcttcataagatatcaagttatgtgttactaaagcataatgagctagaccttaagatacaatacaacaatgagtcaatgacagacgtctgaggcaagatctgtacatactggcgggtagctactcaacgaaggggtacatttggcatcttaattggaacactacactaactgactagctgctagctaatccgggagcagcagatttctctgggctcaatccttgcattgaatatatacatagctgccatcactggtcgccaacataatcagaaaggactaactcttccagcaagcataagcatgaattcaggaacaaggcggcgtgcaacaggtacagcaagatgctgggcagatgtatctggattgtcattgtgtatcacagtaacaatctcttcgagcagcttatccctaccaccccggagaggatcctacagcacacattaatcagagaaaaagcatcaagtgtaagaactttgtgcattcaaattacactgccaaatacaccagggcgtgatacccatgttggggcaataacaaacatcaagcaatacagtttatacatgatgatcagttgagacagttaattctttgaagggttgaaccttcaggccctttctcttgtaaacaaattacaatcacattgtatactaagccgataacgcctttatattggctgaaggtacttagttatactacccaccataatggttcttaaatcaaagactatgaccatcttgaaatcacaatatagagaagaacaacattacatcgaagaatgaataattttatatctagaagaaagaaaagtaccataaaagccaaaaagaataaaatgtctaaacaaagcaacccatatccaataaccactaatgtaacaatagattacctgaaggaacaagtcagtatgcgtctttccatcatacaagaacagatctgctttagcgccattctgttgtaaagcatcaaagaaagcctcgctgcattttttcaattaagtcaatcaatagaaatagtccaatatggcaatatccataatatagaagtttcgtcagataacacaactacaaaagttactggtgaggaggaaaaataaacaagtgactaaatctcctaaatgaaagctagatggtagcactagaatccctaagaataacacttgtttcttcttaactagtgttaactactcaacaccaacaggaaatggcacaacgacatgatgttgcactagacttatctcttcttcttgactagtgcaaaactacaataagattcaagaagaaacaatttctgactagtctatgtttttcttcagcatgccaaacaacatggaaaattcatttgaaatggatgcagacaagatcagggcactatgaagtataaacaatccaaaagtccttagaatacccaagtccctcagtttggtttagtcatctcattttgtttggtcagtaacagcatgtggaaactttatcataaggcatacttattataaaataatgtcaaaaaggtttaaatgagtttcatttcactttgttcgagagaaaagtttcatttcacttaacctgagacattcatctcctggaagagaaaacaactgaataagtatatagttggtttgtccaatctaatgatttcgaatcaatacgacaagaaaacatgcaccatgtgatcaaccattccagttgaacccacctctcagccgatggtattgaatagtcacttgttccatgaaaaaggaatattcgaggtaatagagatactgcagacctagcagctgggtccttaaccatcaccagtggagaaaatttttgcaacgactcctcgccttccattatgctgtgaaacatattgttgaagtggagttttagtgtatataaagataatcaacatgatatgctcacatagttcaatagttatgtgggagttgttgtggaggacatgaatacaatactatgctacttttaactagctgtaaacaaaaatatacctgagaaagatcgatcggtacaggccacgtttatggaaatgatcgaccaagttaagaagattatagctgtagaaatcataaatcaactgtcaagtccgatacaccagaattcctgtatatgtgaaccattaatgaaactactaaaaatgtaatataatctcatattaacaacaaaggtaccaaaatgatccataaattacaaaggctgaacatgaatcatcaataatatttatagagtgagcccaattgccacgtcacttcttaaaaagggaacttctcatttcttaaatctggagcagcatattacagctctgctcacaaagaagctcagcagactacatgatatattccactgcacactgttgcaaatatttgacgatacaaacaactgaaaactgaaagtagtgtgtacatgcgcattctcatacacattataaaaaatgcaagccttgctgcatgtcacctactgtaagtgtaaagagaataggatattacccgccagaaataccaaaataagcttttagctgtgcaatgctccaagtggaagcatctccttcaccagattctttaatagcttggtgtaagagagtacaagcagcaatatgagcaccagcagattgtccaacaagataaatcctgtaagtatcatttagatagagcagatacggacaagatgcctcaatatatgccataccaaaatcagaacgctgagttgtttcttgtattcataatgcttcagaagttccatatgtaagatctttataccatgcagtgcctattactagaaccctagaatatataaatagccaaaatgaaatatgtctctgacgcaatctaactcacattccactgatggtatcctaattattaatacagtaacaatttgtgcacatcagcgcatgagaagggcatacgttggtaggaaccattttgtaattgcaacagaaaagtttgaaagtttgatatcattgtaagttatgaacctttcaggatcacctccataactagctatattattgcagacaaaggcaatcccttgagatgcatcttctaccatgtcaccaatagtcccttgaggaaagtttctgcaaacaaataattggtatgctccatgaaaatggtatgaaccctcattcttctatatgcatatttggaatttattttgagtacctgtaatcaatgcatgcaactaagatgcccctctctgccaagcgcctgcccaaaagggccccccaccctttgtacctgtggatgtgatatgtataatttgccattatagagtcaacacacaatctaaatcttactggaacttcaggtagtaaaaatacagaaagttggagaccaggatagtacatacttgtacagttttactcaccctatgatccaagctccacccgtgacaaatgccacaactggcttcaacccagttctatcggtaggtatgtataaatccagcctagataacgaattttcagggttcaatatatgaacagcataatagactatgccaagtacaccaagacaaattaaaatacaaatatgagcatagcattatgaaaaagatagcaagaagtacctgtttcttggttgttctccatatacaacacttctacaaacttggctcgagaagaaataataatatacaactgtattaaagaaaaaaaaaagagtcaaggccatctccattctgttaaacactttctgtggtaatgaaatttgtttttccttttgaaaactggctaggagctctagcactaactaaggaagaggatgtgggatggaacccatgctagtcttaaggtttcaaaccagcggatgggacaattgtgatctcaggtatataacacaaaatcctactgaaatactacttatgaagacatggtgaatcaaccaaagaaaaatgtggagatgtgccaagcaagtgcaaatgctttctctccctcaacaaaagagtaatggcaaggctaaccttgaatgaaacctggcatgagcaagaaggtgtaacaacagagggctaggaactgcctgatccatctgtagcctatcctgcataaatcagacagagacaggttattgcaaagaacaaaacacgaaaaggccatactcccatgcacaatcacaaaagcagtttagcatctgatcttagtagaaagcctagaaatgatcatttagctcagtggtaaacatgccatgatacaatttccccaaattacagcattaacacaaacagatcgcaaggttgaagtgatagcagccttgtagtagagtagaactatcagaaatggaattggcgagtacccgaggtagcggaggaggatgagcgtgaggcgcgtgagtaggtaggtctcctcggccgcgcggcggacctcccgccggaaggatccgctgcgctgccggaaccgctcgctcaccaccacccgccgccgcacacccccacctccacctggcaagagcggcgcgtcctccgctgctgctgatgcagcggcggcggcggctggagatgacggcggagcctcccccgtctcgctgggccgggctgccgcgcggtcagcgagctccacctgcatcgcgactgacaaaccagccggcgacgtgcgatattcccccacgtcgtcgtgactcgtagcgctccctgctccgggcaagacgtagcgcggccgcctctcacgcaacggcgaggtcgccggggagagatggcggtcgttctgcggcggcgctccggcggacgacggcgaagaagagaagatcttctcactggagggaggggggggagctgacaggtgggccaccacatggcagcgaggagtatttattcgaagagcccctttaattattttcgtattaccagttaaatccatccacgatcgctaatccaaaactgcacgcgtctgaaccgttcgatctgaggtgcggccagatcgagaaaagagtagttggggagcgcatatttacattttggaccttactcttattcgtatttgtgttgcggccatatcgagaaaagagaagcggggaattagcacatttacattttggtccttcttcttattcgtatttgtgttgacgggtaccgtggattccaccggcggcgcagagccggagaccggagggcggcggaactccggcgagctcggcggtgaccgacggtggaaggaaggtgcattgttcgtcagtacaccaagctctcatcaactcgccgagcgcttcccctccctccgctccatccatccatggcgtcctccccgcctccatcgacggcgtcccccacctcctcctcgccctaccggaagctcctccactccgtacgcctcgccctcgccctcatcttcgcgtgcgattccgagtcctctcccctgatgatacactttgtttggattccttgttcggtttcagttgatttactgggcggtgcagcgctgccggatgtcggagtcgccgtgccggctcacggtctccgtcaagcgctccccggaacccgctggttcctcgcccctgcgtatatctggtagtgcagctgcgcgcttgcgccgttgtgatctgttgccccttccttccgcttacattcgtgaactactgcagtttcagatactggagttgggagcaagctggaggagttcctggagctagatgcattggcgcgtgagacccccgtggagaaatggggtatgcgatcaccttctctcgctcaatttccctgtttgctggttgtcagtagcatcctcagactgcggattgcatgagatgtgtggttctgttgttaacaacaccgctgaatcatctgggaagttggtttgtacggtatagcctgttaggtacggagtagatatggagttcaccaagtcatcagaatttgcttaagatatattatcactacatttgatatgttcatatgtagaattgtagatggtcttgatgggaagatggatatatgtttttccctgacattctcttgggcaacaaccatgtacctgacactgtgccatgtatcttcatttggtttagagtttgtcataactcttggttcatcattcattgtctcacactaattctttccatctgcagatggtaccctcttaatcacaactacaggtatgcttcgtatctaatctatgtgttacatggttccactgctccatttgtgccatactgacataaaccatttcatcttgtctatttaatactttcaccttattctaaaacatatgtttaagttatcatgtgttgtccattgttctccatggtcccatgctgctagtgctcattttattatctctttttggagtggaaatcccacaaagcctgagaattttcccataagagctgcaaaagttgatagcattgtgggcatacttaaatcggtcgaaccacagtagtatgccatgaaattcgctgtttcactttgctaaaacttatatttgaatcttgctgtctccttggttcctttttgttccttttttgcatataatgtagttctgtacatactgtctaatttattcaaaatggctttattggataaaaaggaattctaaagtcaaaggaaatgttaaatatttatgttgcgtatacttatcttgttatgtttcttcagatattttccagaaattctgtgtgtatgtttattctgttttgaatacatgttatgacacctgtggatccctccacaaattagcatttgccatgcaaatacataaatatatatgttgtaaactattgttttattatcttaattctatgtgtttattcaatgctattgaactttttattgcatacttttccaatctgtaggaatcgatgacaaagctatttatcgttatcaatttaatcttcaagaagacacatcttcaagcacaagatttaccaagctagtgaccacgtacaaaagtcgtgctatattcaggcaggtcctcttgtgttactttgatgtgacctatggaaatctggtgtttgttgaatcgtttatgcctttttcaacacagtggaactgaagtatgcctttgcctgccaactgaagctgatgttgatgacttaatattatggttggttggttttgtccgcaaggttgtattaaggaacattcatattttttaaatgttttttcaccataattttacctgcccaaccttagcaacattagtgatcgttgtaatttgttatcctgtcaataatagaatcctcataacaatcctatattacagacttactatagtcatttgtttccaaatatgatagaattagtaacattatgttgctaaccatttctttttgcgcgattgtcccgaatactttctaactagcatgtttctgttgttgacctttgcagatattcgtgctaagagcatctgtaagtatttctgaacttttttctctagttgtaaccagtgtgttcttcctattttctttgttcactatgttttttttccatatttcataatgactgatcatatttatactcaccattaatccctttaatcctgagtccttaatcctcaagtcaaaatgccaaatgctattcgtccatactgaccatacacactggtgctattgtgtgtctatctcttagcagcgggtgatgctgttctctgaggatgtgtttttcttgttagaataactgtgtcatttacaaagccttctagcttatcccgtatcatgtgtggcgtactgctctaacaacagtacattatcccgtatcatgtgtggcgtactgctctaacaacagtacatttcatgccacttatatcatctaaatcgaatgtgcagattgcattatgtgaatactttttcacacactgcaggacatgtttgatgtatttctatatgtgttcccgttttatatggagtctcatacctttgtgcatgatgtgcaaaatgaaaatacatgttcctgtatttatttatttacttctgaaaattcacaaatacaaaagtaacaaaacacggtgttcattggtctatgctacagggcaaaacaactgaaaaccctaatattggagtttcctacagatgcatttgtttgataagttcttaacagccatctgatatcatatcaccaatttgtctgcctgcattttcagaccaacaatattgtgtatcctgagatgtaattaaaggatataaaactgatgatcatgattcatcctcagtacttggttacattccattcctccgaacatgtctaattttactttgtgtttgcatatgtccagttttagttgttgcacagtaaacaggcctagaattagaagcatctatctgcttttactctgttttttcttattgtgacctcttaaatggttgtttgatttcttttgtactactcagaatttagcatgtgagctctttgttgcgcaaacagacagtgctggatcaggagacgtttgtctgtcacaagattctgatgatgtccatatttccattaccacatcaagtattgaccgtctagtttctggccttaaagattatgcactctcacatgctaacacatctgacaggtgtgaagcatgctacatgaacaggtaaacattgcttgctgagtttaactctagacatatttgtttatttctttactttgctattggaaatagatttatgatgtgtgttatcttttggattttgactttcagtggaagcttatcattagcaatttagcatccatatttaatcatttttctggaacttgcacttgaatcgctaaacaacaggtttgaagttaatttatgggtgttttagactttgtgtcacataggaaaagttgtcgctcatgaagcggtaaataaaataattgcagtcactgattctgaatgtagttatgaaaactcacttgtgcacacacgaaggctgggggaataagtcttatcccatcacatctaataaaatctgaaatgtattaatcaaatatgcacaattgagtgtatcaacattatttaatgtgaagatatcagatcctgccgcatttgagctctagaattgtatatatcaaggcctaatagctttcttttgttaaacaaagtaccgatctatcagatgaactgcttcaggtggccaacagtgtctggtgctattcgctagatttgagtaatgtctaattgccccattttcccatcacccaaagtcccaaacccattcagcatttcagttcaacctttttaggcatgcttgtgtatcctacctttcggtagcctggtatgtagtagttgaattcagtcatgtgcatactaatgaataccatatgtgtatcatctatctctgcaattgtacattcctcaaatagctttgattacatagttgatagggcttgtatgttttgctcttctgccgtctcacttcagagatcgcctgaagattggaactggaacagcaaaatatgtagacaaaagaaaagctaaagggcaacttgttgaagtagtgataatgcttgcacctacttcatctgatttgagctgttggatgacaaattgttcatctacacaggtttgcaccataggcctctaagttacataaactaattatgcaattacattagcatacttgttcttgtgatgtctaactggttatgggtgtagtatacaagcaagagggcctcttgtgtggtatattcttgcttgtatttagtaagcttataaaagttataacagcatggcgtccaatgtttatgctgaaggtgtggttcaagtatgctcactgcttccactcaatggtgaattgtctattgtaggttttgcattttgtagagttcataccatgtccaatctcacaatcctccctcagtgcgctgatgagcatagactggcaaagctacggtttcaagtttaaagggggtttcattgatgacgatggaaatgctgagcttcaatgggataacatggcattttctcatgtcgatattgccattcacacttaccacgaaggatatccagcttttgttttgtgcatgctttcttttttctagtgatggtgtcgcctgtctatttggctgtggatatctctgttggatttcccatcactgtatttggctatccttgacctgctgtagctactgctgttgatgaatggaagagctctcaacctgaaaggcatcttctaagaaaggcacttaagtctgcattgtttggattgaaagcagaccatgcagaagactttctcagctgccatggccagaaggtttgtgccttctacactttgctgttaaccacgtaactggtgtgtttgttatttccattccttacttgtatgtattttctgcctgttataatttataactcaagaaaaactattgttagacataaggtagtactgaaccgacacctgttagatttagtgcaacctcaatgcaacacttcttaatctgtgccacctgccaacctcgcaaagtgaccactttctgtatagttgctcttttggtcacacaaattagattgacgtcataataagcttcatattataatttctgtaacttatcatcagaaataatcactctgttggttcctacctcaatgtgaatatcatcttcactttccttgatacttctttcccttgaaatatcaagtgtgtgtcggctttatactacgaggggaaaactgtatagggaagaactggtgtgcctactgcctagtacaccctagcaaaattaccactccccttaaataccgaacaaagactagacggcaatattgttcagcttgggaatgggctttgtaagtctgtatgccctcaactattcttgctagttttcatcaggacacacattgaatcttagtttggtggcaagccacaaatgacatggcctaacatttgcgtactgtcagttcaattactacaaacttgaaaaatggattaatctgatattctagaacaactttcatatagaaagttttcacacgaaacgcaccgttttacggtttgaaaagcgtgccatgagtatccaaaagttaatccaacctaaggtaacttgatgtaacttgttattgcctacaatttgatgtaacttgttctttccataattcaggttcgcgagtatgtccctgatctcgcagaatcgatagctggcttaatcttatcatccaatgatcaagagttccaagatgagtgcatcgctcttctcggcctaggctcagatcaagatctcacagaaggggcggttagatcctgcatcggtgagaagatgaaccgtatcgtagagatgaatgacaccaaggagaacgtagagcacaacgcaccttatctgttcgagtgcgagaggttcgatgaagattatagcctactggatgaagacgacccagatgaggatatgattttcgatttctagcatttccaattgtctcgtagcactcctaatccagagatctcctatgctgtgagagagctttactttgaccagagaactttataaacactaacaaagactgctctctgagactgtttcctgcctcgtgtaaacaaaattcagacattgttacgtcaaaaattcagaaactgcaagtaattgcccatgtgctgagcatctctttctgttcgttctcgttcatgataatatctgcgttcaataactccatgaagattgtgtatactataagcatttttaaaatagtgccaagtcaaatatttttaattgtgactattaatagaaaaaaataaaaaaaaatcatgtaaaattaatattagtagatttatcattaaacaaactatcgtactatacaattatttgtatttaaaacatattacttttatagatattgttggttaaagtagcatctcgaaaaccgtgtcgaagtccaaaaatacttatattttagaaaggatggatagagtataacattacagacaaattacattatttttgtagaaaattccacaaaatttgagttgaatccttgccttcttgatatcagaaagacgcgtgagggcgtgaggctggatgcgtgtggcctcctgacctcgcgtcagactcagagccccatttgcttttacagaatgtgaagcgtcctcgtctcgtctagtcctctcctcctcctcctcctccctcctcctcctctccgctttcgctttgaccaaacccaaaccacgcgcagcgctcccatcgcccagggcaacgccacgaaacctagccccaccgactcgcctcgcctcgcctcggaatcccccaacaccagagcgcggcggcgaccatggagccctcccccgtcggcggcgggtccgcctccgggtcggtggagcggtggcgcgcggaggcgtcgcgggcgttccagcactacctggatcgggcggcgccgcacacggcggggcggtgggccggcacgctcgtggccgcggcggtgtacgcgctgcgggtctactacgtgcaggggttctacgtcgtcacctacggcctcggcatctacctcctcaacctcctcatcgggttcctctcccccatggtcgacccggagctcgaggcgctcgacgccggcccggccctccccacccgcggctccgacgagttcaagcccttcatccgccgcctccccgagttcaagttctggtatacgatttttcctgattcgcttctgatcctaggcagcaaactggtgtaggtagttggtgatgcgaccgtacaaatgtgatttcttaatgtgaggttttgatcgaaccagctgagatggtttggatcatcaatattcaattcaccgaccaacacatgtgttccactgattaatcggatgatgaggtagtagatggataggcaaaggcttcactatgaatgctaacctacggcttatgcagattccattgggagttactacttaatagggctatagataattttgatatggtaattgcttaggttgtgcatagctggaaagtccgcgatgaatttttctagtggagctattgcattttttgcgtgctcttatcctgtttagttgttggcttgtgatgtactagtacagtaacttttacctgtttgtttttaagttcagatattatattacgtaacatcttcgtcaagcttacaattttttatggaacttagttcatgagctgcttttacacgttgctttattgacacttgttcacaaaacaagaggcacttgctgttttatagcatcgaattttatttcttaaaaagatcaggaatagtaattgcattagtttgtcatgggcacatcatgccactgtaattaaacacttccctatttcgtgttctactgccaatgggtttggtttctttgtgtgcttgtgttggcgtgtctagcaaggcctatttgcgatgcaaatgcaaaatgtcagctatgctaactaatttattttttttcaggtatgccatcacaaaagccttttgtgttgcttttctgatgacattcttctctgtattcgacgttcctgtcttctggccaatacttctctgctattgggttgtgctttttgtcctgacaatgaagcggcaaattgtgcatatgataaagtacaagtatgtcccattcagcataggaaagcaggtgagatcattatgatatgtatgcatagttgatagtgttttcttctgccatttggaagttcagtagttcatactgcaccatatgttaatcttccaagtggccattactttgtgtatttggtcctagtcatgatagctgtcttgggggcagtaaaaattagaaaggccctttatttgcaattgcattgggggcttgtcagagttacatccctagtaccttctgattaagtttgtacttactgcactaagattcaagagtaaatcatatgttatgagtaggagctactggccttgtcttgatatgttttctcatagtgtgatatactcccctctgttcatcaatatcggtgtcaaatattagtgatcagaggtagtatcatagccaagcacatgtaagatgatgacagtaggtgtgtcaccatgagaagacatcgctaaccaatttagatcactgacttgttgcgctacacattttcctttttcctgaaggagttgcactatacaattttttaaatgtacaatatattagcttactgaactacattaattccaatgcagaaatatggtggaaagaaaggcccgggagccagtacgtctaaagactgagacctggattgcagatccctgtgttgctcttgaggcaacatgctggcatggtggttttttggtaccagctactgacagtggatgtacacctccattcgctagtcgagaggagcttaaagagactttgcatcggttgatgaccatttgtgttgtatatcagattcttctgtgcaatgactcgttcatttatagttcttgtgctgtgcggctcttgtgtggacgagtaatgaacctattgagtcaggtgcaatgcaaatcaaaactattggggcttgacatggatttgtactggaattcaacatgctcgtttccagacggggcccttaattactcgcatgttagtaacacatttgttattctatttagagtcctatgaaggttgtctgttttgtgtatgcgcatgagccattcggtaattgttactcccttcatcctacattgagcatccaataatgtctgctataatgtttgtgcaccaagaacaagaataatttaaatcacatcgatcaagacgtcatgtataatatgcacacattctctcctaatgcatgagttggttaaaacacaatgcacaattccactctgcctttagcatgcacacattcttacatgatgtattaattgtgctctaataaaatccttatacatgtgatcaatttgaaaaattaattttagtttttattatatgataatcaatttaaaaagaagggagtactatcttaactgcactaatgattggtggccaagtgatttacaacctctgatgcccatcgtaaaatcccaagctgttttagcctgtgctaagtcaaaactgtcagcctaccaggcagtttgtaactaactgcaaatatggtaaccaacccgctggctgataggcggggccgaccgttcgctccggccccacctgtcagccagcgcatgatctctactcttttttatttattaggaggttgctgcgctgcggaggctgcatgcattagcgcggaaattctcaggctcgccgtcgacgaggaggaggaggaatcgggaggagatccgagatggcggcgagggagacgtcgcgccacgcgtcgctctgcctgtggctcgcgctcgtcgccgccaccctctctctcgcccaggtactcgattgatgatgcttgctcattctgtttatatcattcacattgcccggatttttccccttcaattcttagttgccaccctatcattagtttgccactctccctgatctgatctgattactcgtacgtcactcttctccaatgtgttcgattttctatttgttttagaacttttgctctctctgttttctcttttcaggcggtagaatcagaagccgaattgaccaaggtcaccaccaaggtcttcttcgacatcacaatcaatggcaagccggcaggtttgtgcatcctgactccctgatttcttgagttcaccaaaattttgttattgcctgcttctctggtaataatgccatttatgtatgttgaagattgttcattgtttaatgaaatcttccattatctaaaataatgcgtgtttgattgatgatatgctcattgacgtttagattgtttctacttggttgttataggtcggattgtcatggggctttttggaaacactgttcctaaaacagcaggtataacatcaacctaattacttattgttttcaacttaattgtttttgtctgagacacaaattggtaatggtctctgcatctgctctttgcagagaacttccgagcaatttgcacaggtatttcttcccaaccgtcatactacatttcttcaatgtaatgctaccgatttcatacaaattatttgaaattatacaatttggtcagctatcccaattcccaaacgtgaaaggctatatgtccttttagttttcttctctaaaagtgtcaaatgaaaaggcatattgctcgcatcctttttatgttatactatagggttaatacttattggcatattcggtgttacataagttatttcctttatcactctggggcctgttggtacttactgagcatgccccaagtcatgtactccagttgatttggctactatagttcacgagatttggagagagagatgtccctccaaacattttttttaaagaaaaaattgcaagcgtgttggcgattgaacacgggatatcaggattgaaaccacacaccccttgccactgcactatcaagtgcatctcttggctactatagtttcatgtagcaatctcaacttcacatttatacaggtgagaaaggacttggcaagagtggcaaacctctctcctacaaaggaacgccattccacaggatcatcccaggcttcatgatccaaggaggcgacaccgtgagcggcaatggaaccggctgtgattcgatctatggtggaatgttccctgatgagaacttcaagatcaaccactctgcaccaggtgaactgcttttcttgatatcccagttgtatactactatattactgcacagaaatttcattcttttgagcagcaagtcctcatgtttgatttgctggctggtcattggttcagggttgctgtccatggccaactatgcgaaagatacaaacggatcccagttcttcatcaccaccgtaaagctaacccggtaaacttcatcagctcctgagagctgagaattagttttcgtgcaaattttctttttgtttgctagaaatcttccgatcaaattgtaattttgatcatgacctactctttttgtgttgtttgctactgcaggttggatgggaagcatgttgtgtttggcaaggtgctttctggaatggacgtcgtctacaagattgaagctgaaggcagtcagagtggtactccacggtccaaagtcctcatatcagacagcggcgaactgaagtgatcttccattaacagaagcttaataacgagctgtacttacttaccgtgaattcctatcattggagtatgtgtgcacgtcattagtgccatgcattgtttggagcctgtttctgctgattataatgtgacctgctttgtgtaattgttgtaaaatgagagtgttctctcaatattttcccatggcaattcagattggatatgcaatgcaagcttatatacatgcgaacacaatgtcatattcctctttgatttagattattgagcggattattccatgaattatcaatttgattatgactataaattaaataatttataaaaataaacttaataaatagtttaaaacacgcatttttaagccttgtacaagaaaattctttttataaaaaaaatttaaagcgttgagcaaataatccgtttctataattagaataaggtttagtttgattgtgaagtttggatttttaatggcacgtaaaataagactagactaattaagtattaattatttaaaaattatttgttttttaaataaacttctaaacaaaaagtatttggaaaaaaataaacctttaacagtttagaaagctaaactatgctcacagtaaataacacccaaactaactttcaaactaagcctaagttgaaaagaacaactcgatagaatctaaaatttttatgctctcttgatcgatttatctgcatcaccactccctcatttacacaaaacaacccgcaatcgaaagttacaaaaaaaaaaagcacctcaatgagtgtgattaatgtggagttaaacacgaagatctttgcttgagacagaacccgacactgacatgtagggcccacctgtcaggcagcgcatcgctttcaccctcttggctactatttcttcgtggactcttgggcagagtgcggagaccgcagtgtggagcaacagatctatccatccatcccatcctcgatccttcattcctgcccggcggcgagcgagagagaggcggaggagatccgagatggcggggagcgggtggaggaggatcccggcggtgaggaggccgcccatgtcgcgcccggcctcggtctgcctctggatcgtgctcgtcgccgccaccctggcgctcgcccaggtgctcatccacctcgtccgtctccactctccaccacgcctcgctcctcctcctgcttccccgtatctgcgtgtgatgtgatgcgtgtgctctccgatctgattcgattgtttgtgctcgtgcgctgatttcttgatctgtttgatctgtggatccaattggccctggtgtgctgatttgttagaattttgagtggtgcctctatgtgcatctatgcgtactcacctttttttttttgttgctgtttaggcgaagaaatcgaaggcggatttgactgaggtcacccacaaggtctacttcgacgtcgagattgatggcaagcccgcaggtttgtgttggccccctatgtttagctctactaccatatcagcataatatataagtcttcaggcagaaagaagaaaagatatgcatagtttgatgtgtctagcattagcaaatacggagcagtaacaatttaatttgcattaattgtgtcccaccgttgtgtataagtgacttgtgatgggctgatgtcatatgcagtgattattacagttagagttatcagcatttgagattgacctgaagctaactctattatgatgagaatttagcttcttctattgttgtttatgtttaaggagaaacgttgatgtgatatttgtgtatgtactatttataatgtctttcctgttaatgattgccttactgacatttattattttttcttgtattgccataggacgggttgtcatgggacttttcgggaagactgttcctaaaacggcaggtaccatttgcttatcatttagttaggtaacaggaaattcattgtcatatcacaaatgctaatgattcactatatcttttttttttcctacagagaacttccgagcactttgcacaggtatgctccctgatgatttatactgtttttattacattagatgtgttcattcatcttctgctagagtttccagatggttaatcccatggcaagcttggtagtggcagcatgtagaatttccagcattgaataacactttctttgccactttaacctgaaattatttttgaatgcacaacttttgtgtcattatcaagtttggccaatcaaatatactgttacagttgactagttaaaaattgatgcaaaaatacatcagctcagctgttgtcattattcatacgcaagtgtagaatattatgaaaacccataaaagtatttacttcatataatgagagagatcccattctggacagcgaatagcactacaatctgtgtggtagcattccctgatgcctacttgtggttattatacgtaatctaagtttgggtttgatgtagcgctttcaactttgttgttatacaggagagaaaggaactggaaagagtggcaaagcactccacttcaagggaagtgcattccacagaattatacccagctttatgatccaaggaggtgacttcacacttggtgatggaaggggtggtgaatctatctatgggacgaagttcgccgatgaaaacttcaagatcaagcacaccggaccaggtaattttcgttatttcctgaaccatttttttactacactatagacgcattatttgtgtggtagaccatcaaatcatccttgtttgatttgatctcatgtttatgcaggcctcctgtccatggccaatgctgggagagacacaaacgggtcccagtttttcatcaccactgtaaccaccagctggtaatcgtcgtttcctcactagcctttgtaatcatagcagcactatttctaatttgtactgaagacacttcaatctgttgaaactatttatttgattaggttggacgggaagcacgtcgtgttcggtaaggtgctgtctggaatggatgtggtttacaagattgaagctgagggccagcagagtgggtcaccgaagagcaaagttgtcatcgcggacagcggcgaactgccgatgtaatgagctgaaatgatgtttcactgaagctactgctactgcttctcgttgtagaactgttattagctgctctgttttgctatgcttctaccccgaatctggttggagtaaatttctgttagactataacagcgtgcttatatcgcctcttagttgtgggcgatttggagtgaactagcataaaaaggtcgaaactttacttaagtcgtcttcttgttctaagtcgaattatactttgaagtgacttgcttactgttgagcgcttgatctgcgtctagttcagacgaagatattctagattcattgaactgcaacagactaaaaaaaaaaaacctagatcacgatcgattagatttgagtggattaatttacacaaaccaaccacctcgggtagataaataaaatctgtatgtttcatagattctcactgacacatgaaaccgaggtaattagagagagaattaaggccgatgcaaactggagtaatcctcaaaacagcgtgattccgtgtgccaaaagaggacaaggagagagtcctgggagttagaaccagacacacccacagaccgcatctagaccgcgaatctccgatcgggcggtggatagcacagcatccaggggaaagccgtgtcagacacgcatctggaccgcgaatctcagatcggacggtggatagcaccgcatccggggggaatccgtgccagagacgcatctgggccgcgaatctcagatcggacggtggatagcagctggaggaaagccgtgtgctgctccaacgagcctaataattggcggccgagtcagtcagcctcccgacccatcaaacacaaatagggttagcgagaatcggcggcggcggcggcggcggcgagagcggagagagacaggagggggcaaccgcggcggcggcggcgggggggcgcggagatgacggggaaggcgaagccgaagaagcacacggcgaaggagatcgcggcgaagatcgacgcggcgacgacgaacaggggcggcgggaaggccgggcagaaggaccggctggggcaggacaagggcggccacgccaagctcgagtgccctctctgcaagaccaccgcccccgacatcaagtccatgcagatccaccacgaggcgcgccaccccaagctccccttcgagcccgacaagctcaacaacctccacggcggcggcgccggcgccgccgccgccgccggtgaggccgccgcctcctcctccaagcccaagcccggcgtccgcggcagcctcaagaagtaaccgcaatcgaatccatcatcacccgaatctgctactactaccgcccgccgccgctcgctccggtgtgcttacttgctgctgcttgctgttttgaattattactactgtgtcatgatgtgccgtgtgatagatgcgttgattcgcgcacatatacatatgtgaccgtgttccgtcgcgtcttcgtcggcatgttttagctatgatgtttagtttatgtgtcactactctatgatgctgtcaatggtgtcaatggatgataatgtttatgtctgtcactgctcaaacaattgctaaatctgagtaaagaaaaaggtgatggctaaatccgtttgctcactcacttccgtttcgtagcaaggatgaattggaaatttgcaattgtgattagctgattattatctttgcggtgtcaagcggcatcttttttaacttggtgatcataggtatcatgtggggcatgttattctgcgctgaacccatgactgatctgcttttagcattggaagcacagtaattaggagattctacctgtttagaaaacatatgttttttttatttcatagttatgcgcctgaaaaacaactgcctcttcacaattagaggtaattgcaacatggaactgatgaaaaatgggcctgttgccctgtataagggagttagttgcgggttgatgaaatcgtggtacagtgttaaaaagaacacttctttcagttctgaattttagatgcacacctcacacggttcagttttctctgtcaaatttcacagttttcctaatgttaggactagtgaactccttaatctccgatatgatctgttaaacatgcagatggctctatgccaagcccttcacagtgagaagttgcatcatttgtttcatgtgatttccactattcgtaggtagttcattgtggttgtcatttagtcatctgagcatggatttaccaatgcagcggtgtgcagatacaaggcattccaggcttctaacttgtcaaaaaaaaaacaagttttgtctatttgattggtacctaaactaaactaccattgaggcttaacaccataaagtgatgttttgcactaatttatagcagtgagatgcctttctaaagctcatggactttagttagtgcagtgcccactggggaggcattgcaatgatgtgatattatggtgcttgaagcatgggggaggcatattatggtgcttcaagcatgggagaggcctttcacttttctttgtatgacatggaatcaggcagtccttagatgaaagtcatgaagctctgatgaagtttttatgtggaaaattttgactactcgaacttctgctctggcaatttggcattagatgaaaatcatgaaactctggtaaattttgtccagattatttggatttgatcagaaccagatgatatgatgtagtgctgcatcccttgaaggttttgaacagtatagtttactgaaatcgagatgccagaaattcattgtgcaatcagagtgttttatataaactacgccgtgagaccaggttgttgcagaacaagaatatgcactagacagtaaggattttgcatacagtgttttcctttatatactttacactaggtaatacaaaaaagtaacagtgtgtactgacaatttacatcacatatataaaacaaatgaagcaacggaatcattactagacagacacaacgaaagcacaatcctggaattctctcttttccttggacagaaactattgtgctctcaagacataaacttgaacaaagcaaagaatacattgggtcccatcatcagagaagaacagctgtcttgccgcaagtaatcaataactcaactctgtttcagattgagttcccaggcctagagaacaacctgctgaagagaaacacaaaaccaagcctaagatcagtcattttggaaaaatctctgcaccaaaataacaaaaaaaaacacgtttccagttcttttgttaattaagtgtggtacaaatatgaattaaatctttgggtagctttaggtgcataacttttcaatattacaaatggaacatcagatggtaacaatatacatacgatctattatgcgataagtagaatcagtaagtaacaagctatttaaggtctacctttaatcactgaagctgttcctactggtgaccaccagtgggctgtaaaaacaactgttgaagctggaggatcactgaccattgttagccaatggcacctccattgatgaaaaaatggctccttgatatgagctcaaaacaatggctattgttcaaacttattttcagcatagagctcagtattctgatattcctgatgatggagatggaacataaaccaactacaaattctaaaagtgatggaaatcttgacgtaggagtataggcgagaactgtatttatacgtgaagtaattctgcagctactgttcaggacagctcatttaaggatcaatggagccagtgaaagaactttcctgtgtcttgggagttggtggatcctcatcctccacaagaagagggtctaaatatccaattgccagtaccctttgcgcctcattgtaacgggcccaggtaacaaggtatagaccagcaatgataaagactcctccaataatgctgaaaagtagaatggaaacatacaacacgtgattatgacattatgtatactttgaagtttcttgaaattctatagtttagaggaccaaaaaggagtttttctaaaatagtatgggagtgaaatgaacaaagcgatattggcaatgttatctgtaaaaaaaacagtttttatcatattttcaccggtattaacaccaatatgaagattatttgtctggagagtatcagaaacaattaataaacacaatgaagagcgactattgtctggaacgagtatcagaagcaactaatgaacgcaatgcagagcgactacagttgaatgaatcccaaatttcagaaaccgtcaaatggcaaagttcaaagaacacatttcgcattattacatgccagaattttccgttataccttccaagatatattggggtaccaagaaatatagttgacaggatggtagaacatgctggttggagtggattgtagagggcaaccagagaaggaccaaggattttgtttgaccaagtcatgattgcgtaattcaagcaagatgcaacaattccctggtgaagcaaaccaataaattcagttagaacatgctagaggaggatcataaacattagcattgcattggtcatacacaagtctatgtaatataagcccaagggaatataaacatgcttacagcatatagaatagcaatgatctcggtcgttgtcaatgcccattcatggagcccattggttgtaactacccctgtcagcaccatgaatacagtggcaaatgaataagagtaagctgttaaggataagctcgcgggatattttatcagcactggagcctgcacataagaaagcaaccctgtcaatagacattctttttccaacaaaaataaagacattttatcaacatatagatattaatcttcaccaaggataagatgttccaaagtttgcatcacctgtatgaccagataagcgcccatcaggaagcagttcccaatgaggcagatgacaccaagattccatgtttctagaccgtattggagcatggccgatgtcaaccattggggcgtgtaagaattgctgctccatgtgccggccaggacattctcacccacaccattggagcctcctcctcctcctcctcccatgccaatcaaggatggacctctatagaacaccatcagcacggctccggagacgcacacagccgtgccaagaaccttgacgatgccgtccttggtgaagatattgatcacctcaacactgcaacacgcgtaatttcactcaattcagttgaaatttgaagccaatgcaacatcaggagtagataattttccaaatcatgaaccaattttacccgacgattgcggctaggaggaatgtgaacaccggtatggctggctggaaggctgcggcgtaggaggcgttggtgaagctgaggcccagcaggaacaggagctggttcccgaagatcctggagaagaagagatcgatcgataagatgagcagaaggagaagaagaagaagaggaggaatcgatgaatacccggtgaagccgaggagagcgaaggaggcgaggaggtgaggggtgagggggcggcgggtgcggcgctcgcggaagaaggcggcgggggcgaggagggcgagggcgacgaggtcgcggtagacgcagaagacgatctggttcatgccgacgttgaggacggacttggtgaggacgtggtagccgccgtaggcgagctgggtgaacgccatggcggcgtgcgcgcgccacgccttgtccgcccacagcagccgcccgctcccgctcacgctccacaccgacgacgaccaccgctgcagcatcgtcatcccctcgccgccaccccgttccctccccatctccggcgaccccgccgccgcgattcctgcctcctcgccgccggttggtgtctcttgcttttgcttgagcttgtcttggaaggcgtctactgactactgctgctgcttttgatccgtttgtttatttatttatttattttgttgattgatgcgtctgagttttcgcttgcgtggcaagttatatattagtagaaaatgtgttgagcgccacgcacgctaaaaggccgggaagaagtcatgcatttttttcattttttttctaaaagaaaatatgaaaccgggagaaaagtcatcagcgttgcttgtactcccactatgtaattcatagttatagaatacgttatatcgatatgtctacatctatactgagatatttttatattaggatagagggattatgtattaatcttgtgtacggcttgattctaagtaatacggagcactaatcatatggctggagtaatggtcttattttttttcttatacttatgtttattagctatttttttagaaaatttttattagtttaagtttgaaattttaatcttaaatttagagttaattttatgggtttttcatcgaagtttatttttcaccctttactttcagatcgctaacaacacgtatataaaagttttatttataaattatttttcgtttgcaaattatgaggccgtaagtatcaatatgtcatttttcaggagaaggttgtcacctggatatcgacatatcgtgactggttttttctcgaccagattttgtaagattctcgattgaggaaaagaaaaatctcaccatacacagggtgggtgcgccactgcttatcgtatctacagtactcccctggcaattcactgcttttttcagttagtaaagagactaccctataatcttttcgtcccaaaatataaaatattttaggtgaatggaacactttatagttttctgtctaaagagtgtcatattcatttcaaatctgtttatcttttgagacgaagaaagtaattggcataggctaattataaaaccatatgagtaacctaaaatacttatagatatcggattttatccattatttcaaaaaagaaacgatgtaacacatgattataactcattaacgcaaggtgttctcagactctatggtagtttcgtttgtgatttatttttttatgttcgagttgtacggtatcatttttatttttcgggtctctgattccgtttccaagagagaaaaaacgattgcataaacattttgaatattttttttgatcattttcattcacagttattgccatggaggaacatgtgagtgagatagttgaacatttccttcttatccagaacacaacttccctggtggtggtggcccttcttctttcatttcaaaaaaaaaaaaaaaagaaaaaaaacacccaaatcaacacagatcgtaacttggtggcgggcgggtgagaggacagcaggttaaattttacattaattttttttatacattaagatagtattaaattttacactgaaacatgtgatacctttccaaacatggtaaaattaccctacattatataaaatatgttctttttgattgggtaaaccactctgtttttcaataaagttaaaaagatcaaactgaattttcaatttttgataaaaatttatttggatttcatcagttttatcaatggatttcgtgaaatccgatgataccacccctgagccgattttaatcactgtcgggattgtgaacctagaggatagagcgcgtgaatgctgagatgaggcgtgccgcgtgcgtggctggttgagagcacctacatttcgccgtgtttatctccctgatgtatcgtccctttcgccttgtgactcgtaccactcatcagacggttagggtgtgtttagttcacaccaaaattaaaagtttggttgaagttggaacgatgtgatggaaaagttgaaagttcatgtgtatataaaagttttgatgtggtgaaaaatttaaaagtttgaagaaaaaatttataactaaacacagccttaatgaatcgagagcggcagcggcagtgaccgcgacgagaagagaacgattgattgattgatcagccaagatataaaggtagagagcggtgaccacgctgtaatatgatgtgataatcagatgctagcattatgtcctgcacctgcactgcagattccgtttcttcgctgccagctaactgttcaaatctttttattttctttttgggtgatggagtttaaatcattttttgaatgaacagtgttcagatccgtatcatatgccatgaactgtagcgattgcgatggacaccgacgaccaaacacacgccggggaggtagggattcagtgtttattattattggtcgtggagagaaatctgtacagctgtgtattgaacatttttgtgtcatgtctgatgtgagtgattctgtttaatggttgatcgctaatactatgtttacagttacattcctgggctgggatgaagaggccgtatggtcacattcgtggagtatgcaatttactttacttacgccgtgtttagttccaaaataattcttcaaacttccaacttttccatcacatcgaaactttcctacacacataaacttccaacttttccgtcacatcgttccaatttcaatcaaacttttaattttgatgtaaactaaacacagccttataagttattttatgaaattattagtaaagataaacagtagtcaagatttgcggggtgaagtcaatcgtaccaatttatctaaaagaatatatagggggtgtattaatgtattacgtagtactattattcatgtaatattagggtgtggtatttgacacgcctctttagctttgaagttcagcaagaaaaatatggtgtataagcataccacgtcaaacataggaaagtccaatattcttttaaggggacacacataaactcactccatatttacatcacatcacacgcacacaccggtggagtataagaaacacatattatcactccgtagtggctggggaaaattattaggaggaataagagtttaaaaagtgggaactgttaagtctattatttaatcagagaatgtgagagttttagaaggaattgagaaggagagtaagcgaacttccacctcttcaaaatcttggtaagagtaagtaattgaaatggaactctcttctaagtacagcaagataaatatgtgtcgtacatcatcacttaaaattcaattctcatctataatccttatgattcttatttctaccaccaaacaaaagattaggagtaaaataaaactcgcatgatcaatcctttcactaactctctcctctcaacggatccatgtcgtctacagtgtagtagagaagtttgtgagtctgccacagtaaagcagtacatcaaacactcaaacagtgatcaaatattgtatgcaagtactgtataaacagtaattcttttattatttaaatgattagtgttcacattaagctgctgtagcactttgttttggacgatccaacaaaaaaaacagcataccataatgcactgcattgtaagcagggttcgacttaccgtccgtaaccgcgcggttaccgtggttattggccttaccgcggggtacggtaatagaaaaaccacggtaacctccttaaattcaaataaatttaaaaaataatttgaatttttaaaaattttacacgatttcgtacgatttttcacggttaccgcggttaccgcgcggtaaccgtgcttatcaccggggcacggtaaccccggccctggcggtttgggaaaccctatttgtaactccctctgctgactcttcatcactgcagaggatccgaattgcctctaaactctcaatcctcctctcatctctttgtcaaacgggccgacttaatcgggacctaaacgcatgttatgcgtgtatccttttacccacccggactaaccgaagtcagttccggggaaagcctttccggcagcttgcgaatgtcaaggccctccgaaagtcaagaagagaaaatgacggcccacataattcagacggcctgaagctcgcagggaaggagcggcgggctgggcctccgggattgaggaacacttggcccaactcaaatgtcagcgaatgtcaaggcccagccctgagcaagctccatcatgagctaaacgcgtgaattttacaggattttcatatgaatcagtttaattcccgtaaaattattccaaaaatcctagattcggaagaaggccttagaacatatgattcaaccaccataccaccatgattccagtgaaattactgcctgaactctgaacaaactcgtggtagacaaaatatttctgaacgtctctgaataccagcaaacctgttgggactctgaacttggtaagctctaatcaacaaggctccaaatctcaggcagcatatctcaaggcccaaccatgaaacacagttggcaacaaatggagtagctagctagcatacctcgatctcagtttgattcgattgaacatcatggatgaaccaccatgattccagtgaaactgctgccttcaaacaagagttataaatatgacattttctgaatctctgaataccagcaaaccaattggtgagactctgaaaaaatggttcatcacaggatagctctgatcatcagggctccaaatccaaatatccaatcatccaacgagtgatttgcaattccctaatccttacctaccactctgcaggtacattacgtgtgtaattgtgtcaatgcaggagccgcagttaagtcagtgtcaataggttgatccggaccccagataaaaaaaaaaaacggaaatgcagcagaagcagcaacgcagcaaaagttctccacaacaagcaaagaaacagccgttcagacttcagagacgtggcacaacatcaatatgccatgaacccatccttccatagtggagcatatataataaaacctgggcctgacgcagagctgtcaccaccaccacaaagcagagaaaaatttgggactgacgaaaacgactcatgatctaaataatggttaggtggtcatcagtgttggtgtgttaacctgacctcttccttctatcacatgctcacaggtcgattaagcactaacaatttctttttatattgcaggcctctgcccctttggtcagtaaaacataagagctgaagaaactggaattcagatgtgcttcgctaatcaggcgaattcaacaacgaaaatgaagtccttggaaattcattgggaactcgcatgagacaattctgaattgttttttttcctgtcatcagactgaaaggcacaaatatttttgttaagaaacaattggagctaccaggagtttatccatagaatgtctgaagcagtgcagggccccagtagaacagtaaaccccgagtggcaagtactcaccaacacagatccactgattgatttgcaaaatcttcatgcgacttacagatgtcaccatgggaggctcaattcaaagcatgctaatgtaaaacatgtggttttccatgacaaataattagagcacacagatttggaatccctttgctaagtgcctctaataccgctgtcaagaaagctgcataccaaccggatgaacagcacggttgaagagaagatggccacacctaacctcgtcgcaaagaaacaaggtcgctctcacaactaacactctctgccatacttgggacgacaaggactcccaaagttcaaaagccaaggtgatttgggtttgactcttactctacttcaagatcctgagttactaacacacaagccaagttaatttgctcctgaaaaactttcttgtatcacaaatcacaatgccaagcttattcctcaatgttctttttttttttgtatgatgacgagttaatcttcatgacaatgccaaagtttatttcttcatcctcatataatcataattccaagatatctttttcttcccaagaggaaattacttggaatgaagcacaactaacaaggcaaggaacaaagggttcaaagaaccctgtaaagaataatacagatgcagatttgcacattgcaatgcaagtatgagcatcaagaacttaagttgagtaacagagcatttcatgatacagtaccatatggagccatggtggcttggagcgcggaggaggaagacgatgatgcggctacttcctgacgggggtgttgttgggagcgtgcggcgagccctcgaagagctgcttccggagcacgtcgtggaggccatcgaagagcttcttcttgacggaatccatggcccattcgaggcgattgagcagctcggtggagttcttgttgtacatgaagaggccattgtagaggtcgaagctgtcgctgcaggtgttgtcgacgaggcggagcagcgtctcgtaccccttggtgttgatcggcgtggaccggagctccagcatggcgagcatccggccgacggtgtgggtgaggaactgcgtctcggcggcgtgcgcgtcgtgctcggcgcaggtcatctccaccatgcggcacccctcccgctcgaagatgttgaggaaggcctcggcgcgggcgcggcgcgcggggcagtcgccgacgcggaccttgtcgaacacgaaggggaggccgtcccagccgtcgcgcgccgactccgggccgaacatggggtgggtgcagatgacgtcgaagtccggcgggagcgagccgaggaggaggttcctggggaactccttgacggagagcacgtcgacgaagagggtgttgcggcggaggcggtggacggggagcgagcggaggacggcctcggcggagaggatggaggtggcgaggagcaccacatccgggtggcactcgcagaggtcgtgcgggtcctggaagtaggacgcgccgacggatgcggcgagggaggagtagtcggagcgggagtgggcgagcagcgtgtggccctgccgcgcgaaggtgcgggcgaggaactggccgaagttgccgaacccgacgatggcgatcttgagccgctgccgctcctccaggagccccgccgcgcgggactcgtagtcgaacggctgggctgcgtcgatggcgcggatggtggtgccgcccccgcgctgcggccgcgcgcggaggggcgccgccgccggagacggagggcggcggaacgcggcggccgaccggaattggtggctcgccggcggcggcggcggctggtggaggcagtgggtggaggtggaagacgacagcatctcgccgcctctcgcgttggatgcttcgggggttgggcttggctcactttgctgcctaccttgctctggagttgtgggctttgggggaaatcctaaatcccaattactagtaattaagtgagctaaatgatggtgattagtcagtcaattaattaattttgtgggctaactgatgaggtgattagtaaattgatcaactggaggacagaacggtgttattcgttgggatggatcatggctgctaactagtagtagagtagtagtaggagtcagtactctaatgctgatagccagattaaagagagagtaaactaatgcaagagagcagcaggtcagtggtgatagccagattaatagagactaagctacaagagagcaacaggtcagcggttggagaactattcggttgagcattttaaacactgtttgcaggggaaagcaaggtgatttgagcttacttgttgacttgatttgagcaagttgataactttttcaatggacgttggtggaagaataagttcttttttttcctaacaggaataagccttgttcagctttgaggtgaagtggtgtccatgttcgcttagcgtttcatttgacagttgtcaaattgcagagtttcttttttgtttttcagtcgactgcaattttggaaaatgaaacacagagttgaatttattttgctgaaaggctcttttagctcttggaaaacatcaacgatgttagcaaaaaaagggcaaaaacctgaaactcaatgtcttggatatgtctatttggtaattggtacagatactaggcataaaagagtaacaaattcgtaaggacctccattacaaatcatgctcagttgagcattatatttatccaggcataaaagagcaacaaattcgtaaggacctccattacaaatgagggcctttattcagtgaattcaaaagataccatgatgccaaacaagatattttttaaattaataaaagtccctcgggtacaagcctacaacaaaaggcacaacaattcttctacagaagacaaaattcagtcacatacattactatcgcatcacaagtcgattagcagctgcagtcaccaaacaccagcaacccgtggaccctggtggccttaagaaaatgaccaagcatatgtagctaatgacatcatataaacggcagagcgatcttctgtggagacatcatgcagattatacaacactgctcattttcttctacgatggcgatgactatagtgccgttcggagtttgaataatcagaagcacttgaatcagagtagtgccagttcaccttcaatgtccttgaatgcttattgctctcataaggccttgattcagtgtactcccgcttatccctcgatctctttgaatgcctatccctgtcatgcgtgctcaagtcagtataggccctcttctcctttgatctccctgaatgcctattgtgctcaggagaacttgagtcactgtagtacctcttttcccttgaccttcttgaatgccgattgctcctagaagaacttgaatcgctgtagtattgctcatccttatgtcccattgagtgcttctcattgtccgaagtactagtgtcactgtagtggtgcttctccctcgatcggcttgaatgcccattttcagtcatatttcttttctccttcctatgctctctcttcggatgcctccttgtatctctatcaacttcaacttctgaatcagatgaagaatatgactcagtgacatctcttttcttcttcctgtgctccctcttcggatgtttccttgtatctatatcaacttctgaatcagatgaagactctgactcagtgatatttcttttcttcttcctatgctctctcttttgatgtcttcttgtatctctaccaacttcaacttttgaatcagacaaagactctggcaggtgtttcttcttgtgctttgatttttgcttgctttttctagcttccacctcagcaccagaaaatgacgaatcagaacaatattctttctttctcttgctccttgatgtcctgttgctcttctcagcttcagagtgtgaagattcctcatgagcagcaggctcagcctgcctatgcttgcttttactcttggagcgtttctttgatttgctagcagaaaagttggaaagaagagctggaatatcacatccaccaagaaatcctgaaatataagaaaccagtataatcagccaatatactagccataaattaaactcagaaatatgatgaaagtttgtcaatgcacagctgcatgctatccatattctacatgatctacctccatattcatcaaagatgtcctcggctacaatctgctgattaggatcatctgggttgtatccaccacgtggagggctcatgcctggcttttgcctaagttcccacttcaaaggctggcaaagaattccttgtgttaaaacattttgaagtttaaccgaagtacagtgagaaaaggtggcaatggcaaaaatgtgcatcttaattgttgacacgctcaaataaagaaatatatatctttaaaactgctgattcaatattcagtactctatccatagtattccacttgatgacaatttcaagagctatcttcagatattaattacccaagcttcaggaaaaaaaagcaactgtagataagttgctatcagcaatcaaattatatgcagttattaaaagggagacaagcaatacaaatggttgacagagatctactacttgcaagtcttgttacaggaagcttatttgaatgtaaattgcaacagggaaaacattttgacaaaaaaaacctaacctcacttgaatcagtctgtgccattatagctgtaagaggatcatcccttttcagtcggctctcctcgttaggcatgatcacatccttcagtgggcattctcggtcaccactctgatgaccatagtttccacaccttaaacatctaacgttacgaacttcaactccaaatggtttaaccctcgcaggagcacctgtctccaacctgagagtacaacaaaaacatattaaatcataaaatgctacttaagagttatctcaaggcagcacaatgatgctctaagcctactcccatctaagtcacaaaagttcccagatcgatggatcgaggaacgtgggacgtcatctttaaaaaagatggaacaagaggggtatacctcttctaaaactatggaacgatagatggaacatgttcctagtttttccggaacgataatccggaacggtgtacccaatttaaggaacatgttcggtgttcctagtttgactccctggattgtgctcttcttttttcatacaaagtcgatagcgcgatggcagatggctcgaagcgacggcaagatcagcgcgatggcttggcactgcgctgccgcggacagcgatggaggagaaaagcgggtgcgacacgcagcgcgcctcaatttctccatcctccccttcacgatggcggcagcagtgcagcgcacgctcatatatgcacctaggcgcgatggcagcgagctgcaaagagcaaaagcagcggtcgtcccatggagcgatgaattctgttcggaaattttggattgcctttcccatattttgctcatcgtagctcgttcctccctcatatcatcctgctaagttcctccattgttcctaccgtgtactggaacgacaacccacccattttcggaacgaagttccgcctagttccagttcctcgatccggagcgaggaacttagctaagttccacgttccctgtgacttagactcccataactcacaaaaatgtaatgaaaatgaatgtcatgtttgatcatttgagattggaaaaaggtgaaaatgaaaataaagtgaaaagggtaattgtttgggtttggaaaaagaaactctgtatgtcatactgtcatgtagtgattgtttcaagattttaacacaaaacaaggtgaaggaagtaaagtaccttggagcatttttcagcacttcaaattcttgttctgttggcaatggccggccaaaaacatcttttggcctgtttttcttatctggacctgcgtgggtcttgtcaagttccttatcaggcctgtattttttttttaaaaaaaaagttaaagaaaatatagagaagtgatatgagcagaagtaatagggttggtagaagcttgataaatgtgaaataattcatgaatcacggcagggaaaaaaatgctacattacattgaagaggtgcttgcagcagcagcactttgggttgcatcaccttcaccagacctcctcttctcatcttcaatttcagctgcttttgcactctctgcgttgtagccaggtgggcggacatacatgaaactcacagctttcattatctccatctgaacttgagaaacagattggatatcgacaaccgtgaatttttcatgggtgacaaaagaagcatgaagacttagataaaagcatacttgttcatcacagcttaacataaaagctcctataaaggatatatgcaacaaacatataaacctcttgtatgcaactagcaatcatcataactagatttctcagtattaaataggtttgaggtccatggtccaagtgcagataaatctttcctcatttctactgtaacttactgacttatgtcccatgctgatacatgtaacaaacatatatttgactttgagggcacaaaagtggggctgcacagtcactggcacgtattatcatcatccatggagcaaatatgacaatgaatagaaagaaatcctacagaaacccatgtcaaacatttaggtaatgtctataagcaatgctaagttgctaacactacttgtcaatggccatatcggatcaaaagcacaagcagattaagctatgatcaaagcagatgatttaggagacacatatacagcaacatagttagctaagaaggtaattagcatatacatagggttccggttccattataccttctccttgtccttcttggagaagagggcggtctggcggaagaactcctgctcctgcgcgaactcacgctgcacctcctcctggcggcgcgcgcggttggcgtggatctgctcggcgatccacttccgccgctggttcgggtaggagagcgggtgccatggcttctggttcaggtacgagtggctccacgccgtccccgccttctccttcagctccacctcccccgccgccatcttcttccctccccccaacccccctcgactccccgtcacctcctcctccatctccggccgcctcccccaatctcgccgctcccgattcgccgccgctcgaactcgattccaccctcctcgctgctcgcaaagcggattctgattctcctcccagccgaggagatgggtttcatgggcttcgtttgatgggccgattcggcggtatgggtcggcccatttaagaggcccgcttcatttccgcgagacctagaaggctagaacactaccagttgagttgactggttcactctctccccatttgtaggctggcggcgcgagacaccgccgcgttggcgcgccgctcacctcgacgccgagatggcgatgtcgtgctcttcctcctcctcctccgtgcgcctccgattgaatctagcgccctcccgccgccgaatcgccgctcccgccaacctccaggtgctccggcgcgtgggagtggcggcggcttcaatccggcttcgtgccgcccgcgccacgggaggtgatgcacggcaaccgttcgaccatgtgcctcgcggcgttgaggaggttggtgagatggaggaggacgaggagcggcggaggcggaggggtctcaagatcgccgtcgtggggtttgggaactatgggcagttcctgaccaggacgctggtgcggcaggggcacaccgtcctggcgcactcgcgctcagactactccgccgtggcggccgagctcggcgcgacgtacttcaccgacgcgcacgatctcgtcgagtgccacccggatgtggtgctcctcgtcacctccatcctctccgccgaggccgtcctccgctcgctccccgtccaccgcctccgccgcgacaccctcttcgccgacgtgctctccgtcaaggagttccccaggaacctcctcctcggcacgctcccggaggagttcgacatcatctgcacccaccctatgttcggcccggagtccgcgggcgacgggtggggcggcctccccttcgtgttcgacaaggtccgcgtcggcgactgcccggcgcgccgcgcccgcgccgaggccttcctcgacatcttcgcgcgcgagggctgccgcatggtggagatgagctgcgccgagcacgacgcgcacgccgccgagacgcagttcctcacccacaccgtcggacgaacactcgccatgctggagctccaaacaactccgatcaacaccaaggggtacgagacgctgctccgcctcgtcgacaacacctgcagcgacagcttcgacctctacaatggcctcttcatgtacaacaacaactccaccgagctcctcaaccgcctcgaatgggccatggattccgtcaagaagaggctcttcgacggcctccacgacgtgctccggcggcagctcttcgagggctcgccgccgttggactccgtctccgccgccgcagccgggtcgccgccggatgacgcaccaatcgatggcgatcttgacagcgacaacgaggaggagcaatcggagtaaatcggtgatcgtggtgtcacgctaactctgacgtcgatctcctgtgaagtcgtggccatggtcccttctcgggtcatttgcaagattcagaagttgctccccactatgaacatcaaatcgcaaatttggcttccttttcacctttcctcgcttcaatttactaccctgttcattcaaactccatgctaaatactccatacaataaaatacttgtattacatcgcgggtcgaatctatacatttttatcttaattttgcgaaatttcgtcgatttgaatacgaatttgtttgattctgaaatgatgaatggagtaataaagaaagtgggttgtatagggggcctaatcgcgttgggcctaattaatcgaagtgatcgcgtaaagtggccgacaggatgaggtagctgggccgtcggtgagattcggcccatgacgtcgtggtctggagcgacacgtatcctccaaccaaccgcaccaatatctctcccattagggtaaggggaggagcggcgatctcgtcggcgacgacgacgtcgaggtcgaggcggtggcggaggagcatggccgacggtcaggaggacgccgcgggtctggacgatgaccttgttctcgaggatgagctgcgaggtcgagaagagggcgaagacggcggcggcggcggcggcgaggaagaggaggaggacgacgtcgacggcctcgccagcttcctcgaatcggagatcctctctggatctagcggcgacgaccctaccggtgtaagttgttctcgatcgatctctcgcgtgattggcttgtgcgaatctggttgtgatttgggggtaattggttgcagcgggaggaaggggatgagaaggagaagcagttaggagatgatgcgaagaacaataagaggaagcaggagtctgaatctgatggggatagcggcagcggggaggagcagaacaagagggtgaggagagcaaaggggaaagagaaggacgtggcgtcggtggcgcctcagatcgatagcggcatgttctgcaatatcccgccggagttgttcttgcagatattcaagttcctctcatcggaggatctcatctcctgcgccctcgtctgccgcttcatgaacgtggttgcgtccgacgagaccctctggcgccgcctgtaagctttacctgaaacttcatttgctccaattttgcatttgttgtaataaaaagaattcactcacatgtttgatccatgtccaataatttcaaggtattgtatgcggtggggcctgtcatgcaataccaaactcagggagtgcgcttggaagaaactctacatccaggtaatccatccgaaacctaccttttcaagctacagttcagatgttgtagtgctgcagttttatggtgaaactaagaatggctacgcaatttcagtaccaattcaagaataaacccaaacagttcaatgtacaaactaaaagttgatatttgttttccttgtgaccttgttgcactcactgaacagaagttcagttacatgttgcaactcaatcattttcgcttgctgctagttgtctgcatcagtttgttgatgttattttcattattcgtaaattccagcaagatagagaggatatggttgagtttgtgagaaatacacctacagaattcaaggagtattatatccagatgcaggcttcaaaaaggagtcaagctccccttccctctgaagtaatcactaattcttatctccattatagtttcccacatagctatggaatcgtattatattgacaagacttaaatgtgactattgtgaattttgaaggtcaacgatgacaaggttattcttgataaaacaatagccgatcaggtgtctagctggaaaagcagcagaggcctcactgatgatgcggtcaaggggcattcttgttctgggaatacatgctcttacacccagattggtgatgcttatatttgtgagaagacaggccgtgttcatggtatgtttgtttttctcagtgtctagtcacatgtgcgcatgtaaatgtagatttgtatacatgtgaaatggttggtttcttctatttttcagtttgcgatgacgcttgtcgtgaatttgtcttggaccagtctagtgggctgctgctttgtacaatatctgggcactgctttgaaaggtggttgtgtcctgatgatgagtgggatgctgatgatgatactgtaagtctattacacatagccttctttttgtatccttcaaataatttggctgtcaacttgttttatcttgactggcatattgttctccatatctgcaaccacttcctccaacattgctaaaattttatgtgtgttattgggggtcaggttatgtacttgttcataaccctttctacttcacaatttgtaggatctacaacaagctggtatgaccgatgaagcagagccatttatgggttctggacgatttggtaatatctttgaacttttctactgtgaaaatttcttcttccaccatatctgaaattatgaagaaattaggcttttggtatcacgatttgaactttaggccatgttgggaaaggtggtggaactactaggcattgttcaataataatataaaaaaatcgtccttgcacaacagcatggccctgtttagatttcaacttttttcttcaaacttccaatttttccgtcacatcgaactttcctacacacacaaacttccaacttttccatcacatcgttccaatttcttcaaacttccaattttggcgtggaactaaacacagcctttgtatcatatttaacctacagagcaaatagccttttgtatgcacatcttccgttttgtttgtacttttatattattggattccaatagtagtgtgtggtgccactgtaccaatcggtgattgtaggctgtgtttagaatgcataagtcgtttgtttcattacattgaattactgacttgtgctctgattctgaacagcacgcgcatatcagttgggttacagctgtgctgatgagaaggaacttgaatatgccttgaggttttgctgataattgggattgcctaatcatactggcaacatgaaaccaagtttttggtttgcaagggaaattatggtcagaaggcttggtgctatgttttttttttttttacctagtttaggtttctggtatgttcctatgtgtacaactcacgcacaaatatgagacggctaaaattctgatctgttttgatcagttgaggaagctgtatattgttgtaatcttcctaaattacaaggtgcatgctagtaataaaagaaaccttctgtaatgctcactgtatttgtttttgcgctgtatttgtatcgttatgttctaattgatgtccagcttgcaaagcatcaagtttttagtgtttcagtaatgaacccatgtgtatgtttctgtgctctgttttgtgcgtgtaatgagcgtgcgcctttgtgttctgttttgtgagatcatcatattacctgattgctggtcgacaccagtattacaagaatcaccaccccgatctgtgtggttcatcaaccatgtaagaaaatgctaatggctgtaattaattcttgcggtgaaactagatagatgtcgaagatgccttggttgaattgaggaatttttttcggttttagatttttttaaaaaaatatttacagaaataatctatcggccaaaaaaattacaaaaatagaccctgccgcccacctctggggcggcaagctgacgtggcaaacgggggaggaacgggcggtgacggagggagggttttttgcaggaaaacccttccgccctctggtggggcggcaaggggcccgaatacaaaaaagccagtcggggccggctattttgcaggcggccccttgccgccctctggccgggcggcaggcctcgctgcctataaaagggctgctgcccagcccccagccctcattcttctctcctcaattccagtgaaaaaaaagaagagaggggaggagaagagaagaaggggcgaagccctgccggattcagacgccaatttcaggtaatattcatagatcctatatgtgattattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttatacaagaagatattacgttgtagatgtttattgcatgaaagagtaatatgatctagttatttcgttgacagatatgtcgaacaaacaaatatttcaagtttaccatggaccaggaaacgtccgttacgggccaactggggtagatctgtcagattttattgtatcagaaaggggaattgatagatcggctgagaggagtgtaccttctataaaaggatggttaatgaagggcttgagagttgatccacagacaagtgacataacaatcaatgttatagtaagttgggcaactgagggtttttattgggaactaatgccagttcaaaactctcgagtgtggagatggtatttggaaaatgcattgcaacgcgggtggcctctagctttggttccgtttgttcacccgaaggatccaggtgtgcaaatgaacatggatgatggcgagggaccaagtgctgaagtaaacgagacttctgtggaggaggtcaacgcacgagaggacgggggcgtagtagctccagttggcattcaaccaggtggagtggccgacgagggggagactgtcggtgccattgtggatgaaatggagagggaggattctgacaatgagcgtgtagaggaaggtgattcgtcagatgatgagacggatattaatccagcagaatgggctagtgaggattttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctagagagtgcacgcgtataaggggaaatggaaggattattggacagtgtcagttgttaccaagcatacatgttttctacctggtgttcagaaataccacagaaacattacttgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaatttccctcaattgaacatcctagcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaagagctcatgaacaagttcaagaggctgtgcaatcagaaccaggagaaaaaaattcaatgagctttggaagagattagatgaattgacagccaaatgcagtgatcagcgtgcagcggctccatcgaccgccgttgctgaccctcctcaagctcttggacctctcccaacggatagtccaacattggttagaaaaactggattggagattcggaaattttctcagtggattctgcatgaaccaaaagagaaatgggccaaggcgtatgacacaggtggtgctagatatggaattatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctgtagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcagaatcagcagcagatggagctcgccttacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccagagatgcacacttttcacttgccgtgcggtgaggtagcccctaccctacaggacgtatcgtacttgttggggctaccgctcgcttgagacgctgttgggccagtgaccacggctgtggactggcaggacgatctgacggcacgtttcgcactagtacagcgtgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggaggaggccgacgagtactcctacagccgatgtttggaggcgtacttgctctggctttttggctgggtgatgttctgtggcggtcacgggcacgccgtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgcagcggctacccaggctcgtgcgccgttgggtctgtccacactctgcaccagggaccaggcgtactggatgactacggttccgatggtcttcgacatctgcgttaagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcactcagctagcgactggcccgccaagttggcgacttttgttgaggactggttgctcgcaaccgaggaggtcgtggaccacgagggagagccacacactgaggagtcgtaccaggcctacctatgctggtaccagccacgcacccgtactagggtcaccttcgctcccttggagcagcagccccatgttgcgagcactagagacctctatgccaggcaccgcgaccaggacttcgctcgtgctgtgagtaccctgcattgcaccattcctttatgttttcatgtctttctcttcgtcaaattttacgaatatttacgaacaaattaaccatgcaggtcgacgacatcaaccgggtcgtcattgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgctgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgtgtcgatgtgtaggtttcgcccagttcgctatgacgcaggccgcccacttttcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccgcttgctgccttccaccttgctcttcgacatcactgacttcgacttcgcttcaggctcgacagaggacgtcattggcccctcacagctgggaggcgcaccgccggtgcagacgcaggaccaggcgcaggccactcctccgcaggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgataccttttggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcatacccaccataccccaccacgttcacatgtcaggggtatcactcgattttttgcgcctatataagtcgccttaatgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccatgaggtattttattatttgcatatgcttattcattccgtatgggcaatcgctttattctttgtaatactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttctttccataaatcctacaacattgggtcgaaggttctttgtttgtccaaatattcttgacgacgatttcatggtaagaatattttgattacatgaatccttattttctcacaacatttactaactttgcttgctttacatctattctttcctccccggaaccaccaaggagatgtcaatacagagaatggatagacaccagaagggttctaactccacctagccgtgttgtgcagcttgaactaccagagcaatacagggttactaaagcgcggtttgagagaggaaagggatcctcacataggggttagctattatcggacaacttggcatattgaaatttctattgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttaccaataacataacatagaaaatcttttggccgtacttttttcatctgg

SEQ ID NO: 60816 - DNA, 27688 bp, Oryza sativa
  unsure (1)..(27688): unsure at all n locations
ccccccccccccccccgatttttttcttttatttgtttgatttttttttcacgcttagggacaaacaagaactaaccataaaaaaaattgaattcaaatggatgtaatatgtgacctgtagaatttttcctctcctctcctctctctctccaaactagtgcagaggagagagatgtgcaacttttttatttttattttatttttttgatatttttttcacacttaggaactcacaagaaccaatcatataaaaaataaactcaaacggacgaaatatgtggcatgtggaattttccaaagctctaccgaaaaacttctctcctcgaaaacacaatcttgcaagcagaatttggaggttttagaatcgccgtacccgacaaagcggggagaatcggatgtaactttttctgtagatgtctgtggatatattatttgcctgattctgagtccgtatgagaaagttacgtctattttaataaatgatacccgaatgacttttcagtagagctttggaaaattctacgagtcacatattttgtccatttgagtttattttttctatggttggttcctgtattctcctaagtgtgaaaaaaatatcaaaaaaataaaataaaaataaaaaaaatacatctctctgtactatttaacttatggctatcatttcatgtggttatatttgaattagagattaagtaatttcatatagtggtagagtgcattatgtttaacatgctgatcaaatggttttattaaaggagttatggtctaattttgatgaaggtgtaaagtaggctaagtggtatgctattttcgcatatctagctaagtggtatattccgttcgagttttaaattttttttttgtggctggttgtatcgtgatcctaagtgcgaaaaaacatccgaaaaactaaaataaaaataaaaaggttgcaactctatatagagaaacaggaatagaggcgaggggtggtggggggggagaggggcggcgccagcatgcctcatccctagggcggtgccagccattgtggcgccctcctcctgccacgtcggttcgcgtgtgccacggtggcaggaggatggcgccagagaagctggcgtcgtcccgttggacgatggcgccagccactctggcgccaaaaaggaccatttctgggaaaagtttttttaggggtctatttgcgaaataagttttttaaaagaatcaaaatgtgaaaaatccagttactttggaggtgttatttttccctatggaccggctgcttgtgagagatctaagcattaataggcagtgggcattgcgaattgttccggtctcttgggtgcatgaatatatagccaggaataagcatgaggattgattcagattcaactggagtagagattggtgtcgattggtccatgacaatataaaatcttgcaatgtctcttatatacaggattcgttttatataattaaaaaaaaactccatgacaccttaaataatgtaaaacttagttcatttaattgaaggagtagtttgcgctcacgtacccctaaattggtgtgttacacgagcttcactcgatttatttttgttattgcaattgtgccagatagtgtttaatcatgtgcaaacactaattaattaggcctgataaagctcatactcccattggaccatattggcacttgcaaaagtccgctagtccactctgcacatattgcagaacaagtattcttgtgcgtcataaaaaaatggacaatatgtcctttttaaattcacacctagctaagtaagtctcacccggccaatgctagcctcatttcttttacccagcgagaataaaatcactggattattttaccatcatgtgctatatttagaacacacgttattaaaatgtcataattaagtttcacaattagtaatattatactccactttgtccataaatataagcatttcaaacgtttaaaatttatttacgaatatacgattctaaagtactacttgtatcattaatcatatctcattcattttttttacataatggataatcgagccttttacttcaaaagaacctacaaccatacattttttttctttcactttgccccccttccaacaaagttttctgtgctcaaccttaatctataataaacctataaatggctatatttatggatggagagagtaatagataatactatacatttatgccagtagaaaggaaaaaaatccaagtacaaaaagaatataactatagcacttaaagtttgtaaaaggatacgattctaaagtagtactcccatcgttcctaaaagattatatttttagctagttaaagatagattaaatatataggaggttaaaatactactgtgaccttcttcattaatgcaggaagagcaaggacgtgggaatgcttctggttctaattaaaactaagagaaaatgatcgatgaaatgatactactattaaataattatagtggacccactctaaaattacaatctttacgggacaactttttacgcttaaactacatcaatttagacttggagtagtactatttttcactccaatcaccactcatttaaattccttccaatcttagggtgtgtttagttccacgctaaaattagaagtttaattgaaattaaaacgatgtaacggaaatgttggaagtttgtgtgtagaaaagttcgatgtgacgtttttgggttcaaaatttagaactaaaccgtgccttaccccaactatctccattctgaagcacccccgtttaatgagagttatctagattattttcattttatattaacttgttttttaaacattacaattttttaggacgaatagagtatatttatatttgaagccatccttctctgtcttcttttttaaaaaagaaaactcgcgagaagagtttgaggacaacatagatttaatttgtctttcattctctcctgcctcgagaaaaataaaaggaattggctgttgcgaatggagattaaataggctaaactgtgactggagggagacgataatggatatgcttctctgttttgtaaaacgtggactgatccttcctagaaaaattacaaatgtgtcgttctccgtgcacttgcttcatatgaacaacaccagtcagcagaccgtcaatgaaatgttttgttacaacttagtacaaaatgtgttcttcgtgcaaaaaaactcatggtagcaacttaattaggcttgttaatataaagctaaagaagagttctcggcacttgcacaaatccactaggcacccacttcacattacattgcagctagaaatgaacaaaaatattcttgtgcctcactaaagaaatggaaattgtcatttttaaattaattcataccaatctaagtgcattgtatctgaccgctctaaaaaaagcagagcaatttactatcatatagtactacatttaggcatttagcacgggcgttattaacacaaattgccaattaaaatgtcgtcggtttcacaacacactcctgatactgtaacagatagcatctgatgctggtgtccaagaaaccgccctaccattagctagtagctagtcctcttaattggctaccttccgatccctttcatcgccttcctcttcagtcaaatgacacattaaattatgtcggtaattcacctccgtacacaagcaaacgcctgctagcttaattgatccccataattaaccgcatgcggtataattttcttcttcaatttacacaagaaaccgaccttgttgatcgagttgttgttgtcacctataaagctagcataaacacactactcctcttcttgaccccttcttctcttctccatagctatcaaacacaccttgtaagcttctagcttcttcttcttcttctacatacacttcatcttctccatagcaaacaccttaaacttatagctgcttcttcttcttcttcttcttcttcttcttctacatagaatagaagcttctacataagatatagtccatgtatagctctagtagcatggaaggagaggatctaggttcatggcttggtctcgggatcggcggcggcggttacgcatacggcggcgacgattgccggaggtcaccgtcgtctccgtcgccggtgcagatgttgttctcccagcatgtcaaggaagagatcacgaggggatatgatcatggccgtgatgaagaacaagcttcagggagcaagatcatgaagggagagagaggtgcaaggctaagggtgatgaggtccatcaggaacagcggcggcgacggtagccgctcgcgtgtactgagcctcggcgacgacggcggcgatggcggcagcggcggcggcggcggtggcggcacgaggaagaagctccagctcaccaaggagcagtcgaccttgctcgaggacagcttccgcgtccacaacattctttctcatgtacgtttacgtgcacatcatatcgagtaatctgttactaattctttgggattttaacacaactgttcgatcgattcatgcatatgatccatgtagttagtaagaaattaactgatgatttcttggtcaactgagatcaagagatcgagccgtatgagtttctgcttcttctagggctacctgatgaacgtatctcatggttgtttcatatatgacaggctcagaagcacgagctcgctcgtcagctgaaactgaagccgagacaggtcgaagtgtggttccaaaatagaagagccaggttcgtagaattaaattaattacattcagtttggagattacaaaattctgcaattagtgttatgattaacatctgtgaaaaattaaatcaaaacgcaggacgaagctgaagcagactgaggtggactgcgagttcttgaagcgatgctgcgagagcctgaccgaggagaacaagcagctcaagcatgagctcatggagctgcgtcggctggcttcgccggcggcggcggcggccggctcgcagctctacgtccagttcccgagggcggcggcggcggcgatggtgaacgtctgcccgtcctgcgagaaggtcaccgtgatgggcggcggcggcggcgagacgggaaagagctcctccagctatagctcttaataatataaattaatttaactattagtttgtactcggagtttgaacaaacacctgatgaatatggaggtgtgatgatcgatcgacttcgtgtagatgatcaactagctaggtgtgccaatatatatataactcttagtaattgatttgacgcccttatgtaaggttttgcatgcggtgttgcagcatgcaacctagctaggcttttttatggacttgttgctgtgaaactcaacaagaaagcctcttgagaacaaactgcctgatcaccagcaccctcttgtgggccggactggacatgcaactgcctactggtactgattgggctgcacacattaaccatgcacacttattattttcatattcctgaatcctgagctgatttaagcttttactcatactcatcagtgattgacgtgtgacgatttttttttgaacaaatctggttttcttcataccaatcaatatatgttatagtacggaatatatatgatctcagatattgagagagagtataaggccatgcaagttatcttggagagaagagagaggggggggggggggttgttgaaattatcatgcagtatatgtttgatcctgtgtcatttgtaaggttgatgtttgaaatgttaccattttttttttggcaagattgactagttttaacatcggtgccgttttttggttccaaccaaataggtgacaaaattttggcattgccagatcttaccattgccaaaaaaaattggatataaccaaacaagcccttacatcctattaattgggaaaataatcctatgagaactacttggtgcagaggtcagatgttttcattgtttagtgaaccttctattatcgtaaacaatagcagagaactggtctcatgctcatgagtgatcaaaagttcaaaacacagagcaaagtttaagtgttaaccaactttgttatgattgaaacagagtaaaatgctaggatctcatttatcttcatttctcttcaatatatatgaacaaacaaatagtgctccttgccgctgccgaggaaactatgaaacaaaagacaaaatacaagtatcttcccagatttttagtatatctgtaactataactataacaaaagacaaaatacaagtatcttcccacaacatttcctatcatcaattcttttcagagtttttttttacaactgtcataagcatttcagaagggaggacacgtagcaagactatccgagcagtgattggatccatatagaagtgcatgggttagctgacccagtggcggagccagaaaatttccacgtctaaggctgagctaacgagatctcaaatattttcataagttacataacatttttcatgattataatgggaattatggagctaggcatggggctcaagccctaactgccccatgcctgattccgcccctgagctgaccccatagctttttcaaaccatttatatcaactttaatttatatgggtttaaagttatcatcactcaagtatcaaatgaaactgatcggtaaaattcttgcctccgccacaataggtggaatacaaatccgtgcaccaattgtacccgggagtaataatgaactaccctcctatatttttatatgaaattttcttttgaagataactaaagttataggaaaaataaaaacttagactccttatcaagcctattgtacaagacagccagtgtaaacaagatatcagcaggagagaatcttcaacccgatcaactagtaatacgacaatatgtatgacaacatcacgtacgtgcaaagcagcaaaggggagagcgacagatggtgcttttcaccacagccaaattagctacaggacttagcttttctcgtcgaccgttcgttttcctactcacatttcagccacagtgatgtagactcgcttgttcctttcgaaatcacttttatccctactaatttagtattaagggtgtgtttagttcacgctaaaattagaaacttgtttgaaattgtagcaatgtgataaaaaaagttaaaagtttaaagaaaaattttgcaactaaacacggcctaaaacaataaactaaatgtattgttgctgtaaattttggtaattctatataaattaccactcttaaaaacttaatttagcgaatttggtaacaccgtcaacaaacacacatcctacgctatctagtaatgccgaaatagcaatattaatgaaaacaataaaaatgtgaatctgacatattttgttattgagtactccccttaaaaaaaataaatttaaaattggacatgacacatcccgagggagtaggtaaagaacaaattgagcacgcgtgcagctcgtacatcggtacatgttgattagagcttgaaaaggcacgccgtgatgaacatctgagcagatactaaattgtgtggtagaatcatgacttgggatgcaaagtccagttgctacaggacaagcctaacttaacaacaggataatcaccgagctgatcaacatgagggaccagcctaattaatagtacaatccggtctagtcttcttgtcctaagcatgggtcaaataaaaattagttttcctaatgaccaataggaaatattacgtaggaaattggcgagaaactttcggctgattattggcaggatgagaagtagacatggcggaagcaaatccagaattttggacggctcttgactctttgtcaacacgagatttccgggaactttcacacaaaagcctgtaaacgcttcagagagtcgcactctcaccatctgtttattggcttatcagttttatcttcaaattaaattttagagttttttattatcgtttttgcttttaacattgtatttgaaaccacaaattatacagatatactttcgccgtgtttagtttcaaaatatttcttcaaacttccaactttttcattacatcaaaacttttctacacacataaacttccaacttttctgtcacatcgttccaatttcaaccaaactttcaattttagcgtgaactaaacatagcctttgtattttaacattgtaaaagttttactatgtagaattcttttattcgtccatgtggataagccgaagccaaacgatcagagcctgcctatgcctatccactcgaaaaagcctttttctgttgagcaattctacggtacctgggaaagtaccttgagtaccaaaaatttagtgtaaaatttggtatctcataatacctatctaggttattatgtacagtagaaaaaatggtatatcatggtacctccttaaggacagtaaaattactataatctattgttggtaccaccaactccaaaaattcctgcaggataataccaaatcacactgtactactacggctgaaacaagccgatcgactgcaaacaaaaaagctggagaaaggaagcagctgcgaaacagaatgcaacgcgtgtgtctgttgtgtccttgagtttctgcgcaaatgtgcttgtcgtttgcacgtagcagtacgaaggaaaaagtacgaattacccgtcaaactatcgcggtcgtctgaattacccccctaaccataaaaccggacattcttcacctataactatgcaaaccagacgaattacccccctcgacccaatccacggtggttttggtttacgtggcgtacacatggcagtctagttagcgttttttttaattaaaatattgtggacccggatgtcatacacttcttgctctctctctattctctctctcactcttttctctctcgcacggcgaggacgaacgcagggacgggcggtcggcgtgtgcggtcagcgaggtgaggcgagtgcggcggcgcggacgtcggcgcagacggcggagctgtgtggcggcggaggagcggaggtggcggaggagcgtggcggcggagctgtgtggcagcggaggagatgaggcggcagaggcggcggaggagcgtggcgccgaggaagttggcggcgcccttggcctcgcgattgtgggcgagcaccttggcgcgcccttggacgccgccgcgtagttgtactccgcgccgcttggctcgagccggtgggccgccgcgccgtcggggatgcggccgttcgcggccttgccctgcaggatccggctccggaactcgtcgagctcatcgagcgccgcgtccgtggacgatttgctgccggttgtgttgttgaacggctccaggctccggtggtcggtttcttgctacggctccggcgggtgcaacgatggctggcacgtcggcgcggccgcggaggcgttatactcagtcgggaaaatgtaggcctccagcggcattaccttgcagtagttttcacgcattccgtcctcgacatcgtcgtagaaatctacaaagaagagatcaatcaaacgccagggtgacatgacattgatcgatccatgacactgggagcgaaggaggaggaggcaccagacggagaagaccacggagagggacacctcgcggaggccgctgtccatggatagcgcatcggtcaccggcgggtcgcagccgccgtttcctccgccgcctccttctctcctcttcttgctcatgcatgcacttgcgcgtgccttcctccctgctgctgtgccaaagcgctaaccacgccgctgcacgctctcaccacaaaccttgcctttgcctctgccacaactgactccgccgcctccgctcctccgccgccacacagctccgccgccacgctcctccgccatcagcgccgcctccgcctccgcgccgacgtccgcaccgtccgtgccgccgcgctcgcctcgcctcgccgaccgcacacgccgaccgcccgtccccgcgctcgtccccgccgtgcgagagagaaaagattgagagagaatagagagagagtaagaagtgtatgacatgcgggtcccataattttttaattaaaaaacgctgactggactgccacgtagaccaaaaccaccgtggattgggtcgagggggtaattcatccggtttgcatagttacgggtgaagaatgtccggttttgtatttcagggggataattcagacgaccgcaatagttcgaggggtaattcgtactttttcctagtacgaaatgcacacaaaaaaggtggctttcgcttttgagaagtactacctctgtccaaaaaaaggcaaaccatgggtttccgtgtccaattttgactgtccgtcttatatgaaatttttttataattcgtattttcattgttgctagatgataaaacatgattaatattttatgcgtgacttgtctttttaatttttttcataatttttaaataagacggacggtcaaacgctgttcacggaaactagggtttgtctttttttgggacggatggagtaggtcaagtcatcgagattccgtcgtttgatcccttcaggcttcagcttcagcgagatcaaaatacaagccgccctctgcctctccacttatctctttcagctttagcaggatcggtttgccattgtggaaaattggaaatcatacaaacattctcttgtgcagcctcgggtcatgcatgacgtgcatatgcgagtgaccgtaaaggacttgcattcaactgtaaaggaaaaaagaaaaggatattgcttcgcaacataagaagaaagcaccggtggtgatggtggagtcgtgagtggaaccagagatttgctatcagtctcttctttgagtgtgtgttagggaactcactcatcatgggtttgtgagtgtgccaagtagcagagccaccgcccggttagtccgggctcgccggcgaaaactccattaaattttaatattaactagcataatgcccgtgcaacgcccgtgcgttgcacggataacagatgatagtgggtggttgaagtttgatcaaagtcgagtcgtgttgttcttgacaattaatcttctttatatttgcgggatatatatttctaagcagataagccttaaaaaaatgagagaactataggaatatacccgtgcgttgatatgtgaagaaaatgtgtggagttgaaaaatattgctcccttcataaaacatgagctgaaaattgtgaagatatggagaaattaactcatcctctgtgtaacaaaaccaaataggcaaattttgctacaggacatcgtgacttcacggctttaattagctgtgggacactacacagattaactttttgggatgtaaaagttggatatttgctagtgcaggggtggaaaaaaagctcgggctcgtgagctcaactcgggcttggtcgagcttggttggcttggctcagctcgtaagccaaataagccaagcccaagcctcctttgcagctcattgctgaaatgagccaagccgagctagctcgcgagccgcttgctttgacttgcgagcctaggccatcatgtatttatatcgattattttactttttgtggcgttattatttgtcaaattgaaatttatcattaagattttgaagaattgaatatataaacttatttaaattttacatgttaatgatttatttttgattttttaataattacaaaatatatatgaagaggtgtttcaacaggaaggcttgcaagacagctcgagctggctcgagccagaaaacgagccgagtcgagctcaagttttagcttgtttccctgactgagccgagctaagccaagcctagtttgttgcgagccactgcaagccgagacgagctaggcttggttcggcttgtttccacccttatgctagtgacaccatgctcattaaaataataatttccggctattgagaaaagagaaattgtcaaaaattcccctagacccccatgtttgctctcctttatctcctccttatccggttccagctccttgggcagcctcaccgcgtccaccccggccaccttgccgcctaccccggacaccttgccgaacacgtgaacgaaaacagatccgtcaactccgccggccatgccacgtccaattcccactcctctgtgagcttctccatcacctcgtgcgcaccgacgcaggccaccgtgacgcgcctgttgcgcaggaatgtgaggagccgcgccatccttccgccgtcctcatggaaaggaagcacgctgacggtatactcggactggttgcagtcgggctggtacacaaggcatgggagccgctgatgtagatcgcgacgtagcggatcagggtgccgaggtcccgaggatggccgcgcacgcccttctcgcccctatgggcaccagttgttgcgcggcgcatggccacagagcacgatgaggccgaggacgaagggtgcggagtggcggtggccacggtatagcagtgtgatttcccggaaccactgcatgttgtccacgtcacgcttggggtaggtgatgtcgacgagggcgaggtcatcatcatcgtagccgatgcagaggacaacctcccttctggtcactggcaccagatctgtagtcgcacatcgacacacaatgatttcacatcacaagaacacatctcacatcaacaaatgaactctcacatcacaagaacacatctcacagcagcaaatgaactccaagaacgcatctcacaaataacaaagaatcacaaataacaaagagaggagggggagagatagatccgccggtcgccgacgccgttgcctcacctccacaccggccgctgacgcatgccgccgctccactgggcccccatgcctcccctccgccagatctgcaaggggagggaggggaggggttgcgcgccgccggatccgccgcccccctccgccggatctgcaaggggaaggaggggagggggtgcgcgccgccggatccgccgcccctccgcaggatccgcaaggggagagaggggaggggccgccatggtcgcccgctgccacctgctctcgcagcccttcttcccacccgcagttgagggagggggagggaggggccgcgcgccgccgcatgctgtcgcaccgccggccggccgggagagaggggaaaagaggagagtgggaggagaggaggagatgagtggagtgggaaagagggaggtgggaggagaggagcgggcggaggaggagatgtgtgcgggcgcggttaaaagcggtgggcccgtgctattgaaaattcgtgtgcggttggcttaagtcgcccacgcgggataatgtattttcccgtgcgggcgacagcccggcacctgtccccctctttttccatgcggttctacttacggaccgcatggaaacaaaagtgggtggcgtccaagaaaatatatcatgtagcagtgtcgcagattgaaaatagttttgcatatttactcatagtctctagtagtcatgcatgctttctcgatctgtcaactcaaaattatacgtggactcgcgtggagacaggtcatgtgacatgtggatgatagcgcgaatactctaatttggcttatctcgtggaaactttttactttttttcaatcgatatttttttgtctcaaacaaatattttgtatttactgaaactttaagtgattttgatgtcaacaatataagtaataaagaaaaatcatcattagttgtgaagtactcttacgtgtatctaaaaaaactttttttcagcgaaaatcaatatcacaataaagaaaggaactttgaccggtcatagttttttttaatgaaaaaactgaagctcgtacctcattaccgaggaggttgccagctccaagaggtcttctgctcaaagagctctaggctcttctcaatcccagtctctttgtctctctccctcctcactcgttcggtcgttccccattcacatcgcacgtcgtcatccaggcatccagcgcctccaccagcgtgcgccctcacatcctcccatactcagcccttgcgcctcctccctgtagtagcggcgccttcttccgcctaccggctgcagcagcggccagcggcgcctcctctccttgatgcggcaaaagatggagaagcgcgacagcgagaagatgaagaagcgcagtggctgactgggggtgacgacaaggcctcctcatgcaacggttccaagccattgatgctgctcgtgcggatccaccaccgacgcctggatcccgtcgtctcttcgtctccctctcgcgcggatcagccatcggcggcgacaggaggggcggatccggcgacctcttcccctcccgcacggatcccgtcatctctccgccctcctctcgtgcggatccgccatcggcggcgatgggaggggtggatccagcgacctcttcccttcccgcatggatccgtcgtctcttcgcccccacgctcacacgggtccatggatttggaggtgcgtggtgagggggtggaccgtgcgcactgggctgcgtctcctcctccccattgcctcgccaagccggccaatacttgatttttttttgcaattttttccttttttttttggccccggtgatttaatttttgggatggttttgctttattgttgttggatttctgattcagtttctttcgtttccgtgcattagttctgggcttctacgaacgtacgagacaggagcgatgcggtctctcgatctcgcatgtacgatgcggtctctcgatctcgcatgtactgacgaaccaaaattttgggaggagatcgtacacggacaagtggaaaaaattgcacatacggacgaaaaatactaatactaattttggtgacgattggaaaaatactaatcttttaattagttaagataagtaaattgatgatgaaatttttatagtaaatattagttatattaaattttgttcagcctcaaagatcttattggctccgctactaggtgtgcttggtgtgagatccgcttgtggctgtgtgagtatggtccatatgcgtctgtcttttatgtaacagttacggaaatatgctagagttaaaaagaaattattttctctctctgaactcctcactaacttggattttaggttgtagtccctccaaacaccctcttcgactcgggttaagttgcactagctgcaaacaccaaataaagagcaatgcatccaatgaatgaagaccatgggtggcgcgttttccgagcttttaaatagtgtgaattttttaaatgtcctataagtttctaagcattttccgcaataaattttaaatttacaaggaaaaagtacgaattaccctcgaactatcgcagtcgaccgaattacccccctaaactagaaaaccagacattgctcactctgaacttttaatgccggacatattaccccctcgatccaatccagagcggttttgtcctatgtggcatacccgtggcaatgtagtcaggattttcttttttaaaaatagtgggacccacatgtcataccccatttcctctctctctcgggcacaaaataggcatggcggcgcagggacgggaggtggccggcggcgtgaggggacgggcgggggcagacaggtggaggcagtgccgattgcagtggcgacgagaaggaggaggggcccgcggtggcggtggcggtggcggtggcggcccgcggcgacacaggggctgagcacaacaagggaatgtcacacggcaacatggtggctcgaggaggaggaggaggaggaggtgatggcctctacacgcggtggcacgaggcccttggaggcttagaccacacgacaacagcgccacgtggcagaagctcgaagacgacgacgctctcgggcgagtgatggcgctagccggntcgtgccgacgcccgcccgcgcgcaaccaagccgncgtcggcttgttacccaccggcgccctccgtcctttcgaccccgcgcgccaccgnccaccttccattcccacgccgcgctgtgcgtgctgtcggggtggaagccgcggcggcgatggtggagggggacaacgagggggtggagagcgactagtcgatgatggacttgacggtggcggaggagaaagacgcctcccgctcccccaggcgctccagatgatgaaggcctctagatccacgcgccgacgtcgctcccgaggatcaggggcggcggatcctcgcgccaccgtcgctcctgctgcacctgcgcccacttgagcaccgccccatgcaccgccgcggcaacctcatccatggcagcggcgtcaagaagcgcggcagcaacatgcaacaacgtggtctggcgatggtggcggcgtccatcctcatccatggccctcctcgtcttacgttgccgtcgtccgccgcccgcccctctgcgcagagagaggtgaaggggagaaatgacaggtgggtcccaccaattttttaaaagaaaatgttgactggattgacacgcgtacgctatgtaggaaaaaatcgctctggattgggtctaaggggggataattcgtccgatattaaaagttcagggtgaacaatgtctggtttcagattcaggggggtaattcgatcgaccgcgatagttcagggggtaatttgtactttttccaatttacaataattaatttattgttaactctcgagtattatcacaaaattagataatatatatccgacatccatttatccgaactggtccttaggacaggagcaatagcatcctctatttctcttcagtgaattttggagatatccatacacattactcgcaaagtcacaaggtgagctccattattggacgcattccgtcagcatcaactgcctcatccacggtactctctccagcgcatgaaaagcaaacattgtacacgatgtaacatatgaattttaacaaagttatatctaaattcatataaaataagttacatcttatattgatttatttttcattcggaatgcggaagtatggggtagcatgttgggatcaagatcctctaccgtcgaagtcacgtgacttttatcactgacacgtggatccgacgatgtctggactcacatgttaatgataaaaacaccgtgtatttaaaggtacaggagctcaatctagcatgttgtgtactaatcatgttcacttgactcgatcgatcgctccgatcgactacaccccgccgcgccgcgcgcacgcataaaacccccaccacctgaacctccacctccactccacctccacttccacactcgagtagcgagcgagaggtcgtcgtcgtcgtcgtctcgtcgccgccatggagatggtgctggactggcgctcggtgggctcgctcctcgccaccatcatggtgttccggaccgccatgcgcgacttcctcccgcccgaggccgagatcttcctccgccgcctcctcacccgcctcgccgccgccttccgtccccacgtcggcaccatcctcatcgacgaggccgacggcgccagcggcggcgccaacgacctctacgacgcctcccagctctacctcggcgcccgctgcctcgccaccgcccccaccgtccgcctccacaagccccaccaagctccccgccccgtcgcctccctccccgacgcccacaccacccacgacgtcttccgcggcgtcctcgtcaagtggaccgctcgccccgtcgagcgcggcgcctccgccggcggcggcggcggcggagtgttcaacccttacaacccttatggccgaggtggcggcggcggcgagccgcgcagactcgagctgcagttcccgcgccagcatcgggagctcatccacggccactacatccagcacgtcatcgacgaggccaccaagatgcggctcaggtcgagggagcggcggctctacaccaaccgcgccgccgcccccggcgacgaccaccaccgcctctggacgtcgcacgccttctcccacccttccacgttcgacacgctcgccgtcgacccggcgctgcgcgacgacatccgcgccgacctgctgcgcttcgcggcgcggcgcgagcactacgcgcgcgtcggccgcgcgtggaagcgcgggtacctgctccacggcccgcccggcaccggcaagaccagcctcgtcgccgccatcgccaacctcctcgagttcgacgtctacgacctggagctcaccaccgtgcccaccaactcccacctccgccgcctgctcgtctccaccacgcccaagtcggtcgtcgtcgtcgaggacatcgactgctccctcgacctctccgaccgcaagaacaaggcgagcgacgacgagaacgcggcgcagctctcgatcatctccccggccgctgcggcggccatggcggcgatggggcgggaatccatcagcctctccggcgtgctcaacttcgtcgacggcctctggtcatcctgcgtcggcgagcgcctcatggtgttcaccaccaaccacccggagcggctcgacccggcgctgctccgccccggccgcatggaccgcaagatcgagctcggctactgctcgccgcccgcgctccgcgtgctcgccaagaactacctcggcgtcggcgtcggcgacgaaggatgcgaggacgccgccgacgatccggacacggtgagcggcctcatggccgacgccgagggcctcctcgcagccggggtgctcatcacgcccgccgacatcgccgaggtgttcatgggctgcgacggcgcgggcgccaccgccgcgctgaggaagctcgccgacgagctgcggcggaggagggacgcgccggcggtgcctgtcacagaggaggcggccatgacgacagagtaaaaagcagacgagccgccattgcggattgcttgaacttgaacagcatcatgatcaatatataattaataattttcatggtgatttggtttcgagttaggtattaattaggtcggttgtgatcgtgtcatggttgcgccatggatggaggatttgaggatttgctgcattttgcaatggtgtgtggctttctgaatttttcagcaattttctttgcgttttatgagaagttgcaccatgtcgtctcctctgcttttgttttgatctccggatatacgtcgacgtggacgtttgatggcaacgaacattggccgtccgtactggctggctgctgttgataacgcaaattcacagtagtcattagcacaaggttaaatttctgcaattacttgcgcgcatctcaatttgattttatatgtggctattcatttatatttgattgtttttcatattaaaagttcaaaaggtatttttgtaaaactacaatagaattaggtagagtttttaattctactctgcgtgccgtccgccgcttccctcttcgcacgcgacacgtgtccaatcatccggggaagacgcgcacaactggttgcggattagcattctcgacataaaagaagtaacagcaatgggcaaaataagagtaggttaacaagtcatgtatggagcttttgactaacggtagggttaaactaagctagaggagccgaaaaatcagagcacaggcttaccttatccaatatttcgagatgagtcaggccactaatacactttacgacttccataggtcataggtgactcgaattcttgaaactggctcggcatttggtgatatgatctatctttctacgtgtacataactttaaccttacttcttgtttacaaggacaaagctgtcgttttcggaacaatgcgaaaacaattgacaagaacaacactggctcagatataaccatgtttatgttacacttcaacaagctaaagatgcatagattctatataggtttacttattatacgtttgaacaaatattactgcaccataagttttatatcttctcgtttgaagaaatattagcatgggtgaaggaaatgagagcgggctcacgaagtgcttggatgatcaaataaattggtcggggaccaaactaagattttcctaaagactgctcatacatcaccatatcacttttagtctatagaagagaggaaattatgcacattttggattcggattcaagtctcctaatagcattaatttcaaacggacctagccaatgatctagaaggaatctcggagcccatgattatttattggaaagcttatggaatctactttcatatagttctgatcacacatcaaaattccttctaatctattggtaatctacaaaacaagccatgtacctcatccagtccaagtccgatttgaactttgggctttgtaattgtgtcgtgactcgtgggctaagcccaagggggtgtgcgccctagctataacaaccctaggtcgaccctagaatctatttaatcagttaccgtcatcaaattagggttggattttgcagttttgctgctagtttggtctgtggaacaccaacttatgagctccatcttaaattcgcaatatattcaaattgcatcttctactctcttacttgtgttctcgattcgcttacggaatatagtctttttggcgagatcaaccatgtttcggctcgggtgataactaacagaggggtggtgtagtgattgcacggggttcggtcattctgatcggagcttttgaatcatcaacatcaagtctccacaattaacctatctagtacctaacggaagattcagaaccttagtcctcatcaacaatactccccacggtaaagaaaatatgatatttaacctattttaaggtcagtgagatgccgtcctgaccataatacacacactctctttctcgggtataaataaataattaacatttagaacaagacttgtggtctagttatccttatacttattcatattacttattagtaaaaacattatttatgggtaaaacgttattcttagcggtaaaagacgagtgccataaaataaaccatgataaaaagaacacaaaaataacttaaaatcaagtttaaaaaatttaaattttggtttataagcataagcaaaacaatgggatcatttgtcaaacttttatagcattgatcatcaactttgcattgtaaaaaagaaattataaaattgaatgacttcacgatattacgatagtactgaaaagtgaaaacctacctacatatatgccatttgtttaacaactaagaacttaataaactattgatggtcaaaatttcaaaaaattgataatattttgtgttaaagtaaaatatttatgacctgagagatattttttttaaaaaaagttaaacatgtattggtggatcctacatgaattgcatattattactcagggtgcatatacgaagaaccaccacatgcatcttttctgctttagccaatggcaaagaacttgtagcaatctttgatgtcatgtcatcatcaactggtagaaaatttggaaaaagattaatccacccatccgaccagtaaaagacttgaccgaagcgtgccaaactcaacttttggatttcttgctaaatagtaccttcatattttaatgtatgacgccgttgacttttaagtagtattcaataatacgaaaacaataggaaaatgcatactgaaacagaacgagttgggcttaaagcttatgaagcccataaagtcatttaggcccattcatttttcctttcctagcgttgagctcgtccacgagcttctgcagcgcgacgtgggctccgtcgtcgccgtcgcatcccatgaacacctcggcgacgtccgccggcgtcacctgcacctcatcgagcagcctccccgcctcacccatgatctcgtcgtggtcgtcggcgtcgtcgtcgtcgccgaggtagttcttggccagcacacgcagcgccggggccttgcagtagccgagctcgaccttgcggtccatgcggccgggccggagcagcgccgggtcgagcctgtccgtgtggttggtggtgaacaccaccagcctctcgccgacgcacgacgaccagaggccgtcgacgaagttgagcacgccggagaggctgatcgtctcccgccgcatggccgcctcgaccgccggcggcagaagggttagcgcgtgttgcagcatcgcacggttgcgctgctcgtcggcgtcggcgtcggcgtcgtcttgggacgacggcggcgccggcgcgcgcgtccggtcgaacagtccgagggagcagtcgacgtcctcgacgacgatgaccgacttgggccgcgtcgaggccagcagcctccggaggtcgtagttggaggtcactgtggtgagctccaggtcgtagatgtcgaactcgaggaggttggcgatggcggcgacgaggctggtcttgccggtgccgggcgggccatggagcaggtacccgcgcttccacgcgcggccggcgcgcgcgtagtgctcgcggctgcgcacgaaccggagcaggtccgctcggatgtcgtcgcgcagcgccgggtcgatggcgagcgagtcgaacgtggacgggtgcgagaacttgtgcgccttccagagcatctggtgatcgtccatggcgccgccgtcgccgtagtaacagccgccaccaccgccgttgttggtgtagagcttcctctcccgcaactttgcccgcagcgccgccgcctcctcgagaacgaaggggatgtacgcgtcgcgcacgacgtcgcggtcgcgtcgccggaactcgagccgcaggcaccgttgccagccgtcgatcgggggcggcgcccaccggcgggaggaggaggaggagaagcttcccccgaacgacgagctcgcgttcccgtcgagctgcgacgtccacagcacgcggacgccgcggaaggcgtcgcgcgtggcgtgggagcccggcagcgacgccacggcggccgccgcgccgtgcgccttgtggaggtgcatcgcgggcgccgtggcgaggcagcgcgcgccgaggtagagctgcgccgcctcgtacagctcgttgggcacgccgttggcgtcggtctcgtggacgatgatggcgtcgcacggcgtcacgagggcggcggcggcgcgcgacagcagcgcgcggagcaggccgtgcgcctccggcgggaggaagtcgcgcgccgccgtgcgcaccagaacggcggtggcgaacagcgagccgagcgaggcccaggtcagcttcagaggcgcccccatgtgtgtttgcaagctagatagatggcttcgtgttcgaatggaactcgaattgccatggccatgtcgaggctatgtatatataaggagctcgggacacttgctacggaaccgacctagccccgttcttacttgattaagatacagaatttaccttgaatttcattagcatgtttatcagggaaagtgatttcatcccttgaggggatatcctcttgtttcgtgcatatataaactttttttttaaaaaaaatagtaagatagattagtacgaaatatatcaatccacaaaaatacaagttaaaattcaatttctacaagttataacaaatatagctatgaatgtacgataactattttcagtttagtttgttctttttgttgcaacttgtagaagttgaatttggtcttacatattgttcgagtgaaatattttatattaatctatgttgtcaaggagggacatcccctcgagggatgaaaatccatatcttatttatcaaacattatattagttattacgtggagttatggagggtattatgatttgtttaggtttgtattgatttggctgaaatatgaaaagaaaaagggtctttttaagacagaggtgataatgaaaagatcgggttgattactccatacgatgcttagtatacctccataatgattaatgagtttggttgagtgggataggtttagatgggtgatggccgtcggttttattttcaagtatttggatggccatatgcatctaacctcgtctttgaaccatagcattagcaggtagtacacttttcacgctaccatttgtagttatttttgttgatttcttcatatgccaaatcactgaatatcgtatgatcttttcttatggttagtaaaaaaaagaacaattttgctatatctcactcgaaagattttttttcttatctctcactcgattttctcactcaaatttacagtgcattttcttataagttacagtgtaatttataaaacttacactgtaacttttgtaagttgcactgtaatttttgaatctacgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgaccatagaaatctttcgaaagatgtataggtactcccaaaaaagaattccaaatacagatgctggggttaggccaagcatcatgggcttagcccacagtagccaaaccgacatagaggtacgaatagagatgattagttgacttgactcttgactcttgagagttaatcattgcagatcgacgctgtttccctcgatcatcttttagtaattaagtagtacggcaataacgttaattcgtagccttggcgaccaaggaagctttgactaaagagcacttaacaattaagctagagaaataaactactccaccgtgcatgatacccacgcgaacagatcagcagcatataggaccataggagtatactcaagtggaggaccataggagtatactcaagtgggaaactcaggactttcagcatagaatggacaagagcataattcgtccccttccattcccaacaaaacacaccctagagcataatcgaaggtcatcataagagattcccaacaatgtaaatcattcaagcatttctcacattcatattgatgttcattcaagcatctctctaatatgaatgtgggaaatgctagaatgaattacattgtgaaacggaggaagtacatagtttagttgtgctcatctttcagtacagtataataatttgataatgacttgcatactgttttaggacaacaattttacactataacataaattcttgtgctttacattgttattgaaaagattgaccttttctattcgtgcttgactttacagacttattttgttgtgctgaccagtaattccctgataacaagtccattaaccaacttgaatgaaggatacaagaatggctatataggacaagatatagtttaaaattatattttatgatcaatttgaaccacgaattacagttcgttaattaacttgcatgaaggatacaagagcgatcatacacagcacaagatggtttaaaaagatattttatgatcagtttgaacaatcaactaatagttcattaaccaatgtgcttggaaagttggaagaaacaacaatgatcatacaggacaagattttagaaaaggatgccattaaaatgaaaatatcataaatccatttaaacttttttttgttcatttcaaatgagcataatgtcaagagataaaacaggggcaatttatacagaactaaattatcagaagaacgacatatcaaattagaaaggaaatggcagacagagaaatacctaaacacaacacaacaaagggaagcctgaagtagcaatagttaacacacctattttggatgagccaagccttgggtttctcataaaagtaatcagtaataagaatatgggtttctgaggtctgaatattagcaaatgctattatttcatagttaccatgaaactatcacagatgttaggcagtgactatgatatcatgtcattcggatatggacctataaagtactgatttactgattcagtgacatatgcctataacataactgcaacttaatataaaccttcaaagaacaaatgcacattgatatcaactttcaccccaagaattccaagcccgagtgttgtactattgttcagcaaagaatcagccactgaagaaatttcaaaacagataggaaatggcgtttttattaatccacatatcatggcagcaaaccaaattgttcattttaaaaaagccgcaaaaaacaatggttttagtatcaaaactttcttgataaaagaaacccaaaccataatctcaatatgctaccaatttggttctaacttaagtaaagagaacagataaacttgagcaaagatagcaaactaaaaactactccacatgtactcacacaaaaacaggaacggaggcagcaaaaacatctcctaaaaaaatatggcatgttaatgaactaaactagtaataacaaggatggaagggtggggcaaatgacgatattgtgtaaacaaaaagtcaaaaagaagatctgagctaccacgttaaagatggatatgaaaataatgaacagcagcagcataactgcagagcgccataacatgttccctctttggtgtacaaactatgcattgatatacaagaacagattatagctagagcaattaaagacagttagcagcaaactaaatcctcttacagatgggccacccatatgcagtaatatttttccctatacttgccttcttactcatctgcaaatttatgaagaaaccaggttatttctacttgttactaagctcagtcacagtaaaaagattaaatgagtacggaattttgtttaagataaaagactacctatggaccaagtacaagtatctcagaattttaaagctgcctcacctccattatcaaagtcattaacctacgccttgggtagccggaacacatcgttgtatatttgttattagcaaatgcagattgaataggcagaggcaccagtacaagcctcttctaccaccacaacatagagcaacgcttttctccttccatacataacggaatcaatggaacacaacactatgcataggatgcaaaacacaaacacaaccaaaacaggaacacataaattatctagccagcaaaatttgttacattctggaatcagagcttcagcaaataggaaaaaaaaatctgatggttcccagttgaaattccaacagacaatggttgtcacgactcatgacaaatagggcatcggacgactcagaactaatctacatggatcacagcgatcaaaatcgcgacaggcatgaaccggttatggcaagagaacctacaaattaagcctggaattgcaaatgctgcactgggtaatgtacacaggatacaaatctcaaaaacttgcgtgggatgagaattgccgttaccttctagcaggttcctccgatccgagacctacccggcgatttcccagcgcaccaagctccattacgatggctcaacgtgggagctgtggagtgagaccccgcgttcacccacaccaacgcatctccatctccgacgcccaaacgcgacacgacacaaccaccgcctcgagacggaacctaaggtttctccggtgtgctacgcggggtcgccgctctcgtttgcggccgcttccgcggggggaaatccggctggagagaaacgaaaccctaacctaacgaatcctgccctatctccccctcctcctccaccgcacaaacaccaaggcgaactggcgccgccaccgccgggacgggaatgcaaggcttaccgcggattgctcgtcggcttctctcgcgaaggcatcacggcggcggcggagcggaggcgaaaccctagcgccgacgacgccccatgcgattcggagatggggatcggcgcggcggcggcggcggttcgagaatggggccc

SEQ ID NO: 60817 - DNA, 547 bp, Oryza sativa
ccgactgtttaatgtcgtgggcaggcaatacatagtaaaatgtgtggaactaaaagtaagtgatgaactagaataaccacatttaaacgaaatcgaattatatcgtcttcatatccccccggccccgccgcagacacacactgcaaacagagtactccatccgtcacacaatataagtgatttagaaaggatgtgacatatcctagcactacgaatctagacaggaagcctctctagattcgtagtcctaggatatatcacatctctctagaatcccttatatttttggacggagggagtagaacataaggtagataaaaatactacatataataataatcaagcggtaccattcatccctagatacaatatttctagagctttgcttaacactaacacacagctatataacctagctagcttcatgatgacttcaatatttctcgaccttacttaatactaacacacagctataacctagctatagcttcatgacttgatctaccaagctaggcatgcatatgcaagaacaagaaacagattagtc

SEQ ID NO: 60818 - DNA, 2855 bp, Oryza sativa
taggtgaagttaccttttcttttgccaaatgagcaaacacaaattaaatcacttagttcattaagcacaaaacgttaattgattatatgaatcctgaaggattaatggatcgatgcatagtaaacataacaagtaataagcataccattgaatccacgcagcatgcaattgataaatggtccattctttctcttcaggatctgcgtgcgagatgcaaaaccgccatagtgcaaatagctgcaatttgctgattgatcttaataaactacggttcaaaaagattatatatgcattctttcccatattttgtacagtaagttcagatattaacaggctacaacctacatgcttcaatagttcagtttattcagtattcaccagtattttgtgtgcaacgaatgaattaatgttgcactttctaagtagtatattattcactagcttgtagtggactgagatgtaaaacattatcaaattatacttaacaagagggtgaacttattaattgacatgtgcacataaatgttgtaatcttttccattgagatactccttcacaacatagggatcttttccttcgggcacctttggagcattagcagtggtgtttgatgagatggcgtatgccatttatacggatccacctccaatatcaaccacccctacagttttagagtagtctcctcccaatttatccagcagataatttagagcaacccacatgtatgatccttgctgggatccctcaagaacataagaacattgatctagttcgggttatgctgatactttctcttggtgtggactacatccctaacctgtattaagacccagagtactaaagggattattaagaataaagatttattagaatcaaagcaagaaatggttttgagttaaaattttgtatgatatgatgtatatcattctggaattatacgtacagcttctagaatctggtttgccttttcatctccaataagtctgggtccagtagttgcctacgtatttgattgaattaacaaagaacaaaatttatagagtgcaagaagtcaggccattttgttcgagaggaaacattatcatcattaagtattttaagaaactatttcgtcagataaaacatcatacagaaacattagtacgtatcaaaaatttttggattaagttcctgatgtaggttttgtttgataattagatgaagagtaaatcaatttagtggtgtacgtaccccaagtttaaggggagttttgttcataagcctggcagggacaacggtgttggccttgtcaagcagaggcagtatggagtttgctgcagcctagggacgtctagcctttttgcacaaaatgatattcatactactacctccattttaaaatgtagcaatctaataagtagtagacaagatacaaactagaataatttatagtactaaaatatgtcttatcctgtatgtactagattattatattttgagataaaggtaattgatactagtctagaaccgtagattcaaatcagcaaaatgcagaggcatacatatgcatatatctctcgaacgtcgaacattcacggaggggatcaaattggggccatagcttcgagccatcaatttaataaggattgctagctgcagcggcggaggacgaggttgaacaacaaggttctttctcagcatactacgcctacttggcccacttagattcgtatctgaccaatttattgggccatttttctgtggggaacaatttttctttggggccttgaccttggacctacttttgtcattgcacaatataatattattgggttgccggcctctgctctccatcacccgtcgtcttgttcgatcgatcaatcatccgttcaaggaatgtaaattaagctaagctccattattacttagcaacaaatatacatgcaagttacaataaactggaaacacacgcaacacacaacaatagtacattaattcatatcctagctactccggccaggctcttgatgcttctttttgggcgagataacctcaatggcagtgcccaatggccacgctgcttctatgtaggactctccatgcttcaccttctctaccagagtaatctccttcgttgcttccaaacctgaatatatcatgcagtgcatatattcatgtcatttctcaagaatatatacatccatatatacacatggcacatagtacaagttcttcattgatagtttaatttgtccatatgtacataccgaagccatcgacaagcaaggtgtattgatagatgagatccatgcataagtaggcgtgatcacgagctattgggtatgctgctttcgcttcttcgatgctcagtatacaaaccttctctgatgcagccttgtacgctgctggtgtagactttgcactgggcgcctcactgtcgatgaacccaatctatttttcccattattggagagaacaatatatcattatgttgatcacaatattcataatttacacagaattaaatctgaataggagttattatatatatgctcatgtaaatagccaactttatacgctgcctgataaattgattactccagtataaaccggttagttaatgagacgtacaccggaggctatgtagtagaagctggatgtgacgtagatctcgtcttgcccaacgccgccgccgccgttccacacgccgttgaagctgcaatttttggtttcgcagggcgagtctaggttcagtgccttcaccacatcttgtctgcatttgtggtagtctgcaccttgtggtgctgccattgcttcgtactgctccccgttgtaggtgaatttgccttttatttgtcccatgataaaataaacat

SEQ ID NO: 60819 - DNA, 1201 bp, Oryza sativa
ggaagtgacttccgtataacaatatgatgctcctagaacaagtatactataatattctcttcacaagtgatgtgtgtctactgtttcttcctctctgcatttggaggtttgtatgacaaacatgcataggaagataatgtaaatccttatagatgtaggtgttgtaataaatccttgtagatgtccatccacataattacttgcttcattcatgcttgctccataatttcttttcatgtatatattatactaataagtcaacaagttaaagatccgataacgtaagagtcatgaagaggccatcatagatgtcagtctaacatataagtaggtgttattactcaagtacctgcgatagcctttactaaatactaccaatattattatcagtggtagaagtgatttaagtcttgagttatgaattctactgccagtaggttaggtggaagtataaatagatgtgatttttttatggtggtctttattggtggtattctactagcaatattgtcaccaatagaagtaaccttgaccattgatttatgagttccactaccagcaaaagaaatattctactgcaaatagttgaggtagtaatagaaatagatctgatccttagattagaaaatatgagggctctagattaattctactaacaaaaaccattgtaaagcacctttagcttacatgatacatgcgtgcatgctagttttatcttcagagtttcatcaggtgtattgtcagtatctctaaaagtttcattgatcattcgtggcatatcataagtataaccatgtcaaatgaatgtttcaccaagttgtcatgaatgctttatcaggcctctgcaaagttcagcaagttttataaattttctgcaacaaatcaatgaaattcgaatcatgatgatttcccctaagctatatattgaaaacacctcgatgcataaaaaaactacagcccattcaacaaaacaaaaccccaaacaaccagactttattgtatcaatgatgcacttgttggcattggcatgcagcagctctcatggctgcctactgctccgccaccataccagcgacatcttcagcctgctactattaccaatcgttggtgcatgatgtttctgattatctcattctgtacaatgatcttttcttcaaattttttttacaatgatcacattctccttgcctagcacgctcgc

SEQ ID NO: 60820 - DNA, 48333 bp, Oryza sativa
aatggctgtttgattggaccacaggaaaaacgcaggaatcagatgagagagatagactcagaggaaatgttccaagaagttagacctcttgctaactttcctccaaaatgtgcataggattactcattccatatgaattttaaaggattggatagaattcaatcctttgtttcaaatgccttcctagaattttttttccataggattgaaatcctctaaaatttctacatttttcctacaagtcagaggggcctaatcattttcaatgcagtactgtccgacatgtacaaatgttgaaaagtttggagtctgtagagatggtttaattcctgcagctcctacgtaggggccggacccccattggacaattcgtacttgacagtaacttttcttcaccagtacagacaaacccatagatgaaatcttccttacaaactttcaagcaaccgtctggttaaaaactaacataatggtgtacccagctggtgtttcacaagcttctcaacttgttgtttcgatcttcctgggaataaagattcaagaagttgtttcgagcttctcaacttgttgtttcgaccttccttctcaaggtgaatccatgacaataagtgtagcagtagagaaaaagagtacggcgatatcagcttgctggtcttctgtgctgaaatcaccctggcatttaacaatgtcagtagtaggcaaacagcctaacactgtcaatgaccgcataattccaactcgagtgaaaacattgcagtatggccgtacagtggagatctggttaaaaaaacagtaaactagtgaggagacttcaaccctcaaaagtattactattagtcagtaactcctcaacatttctgcaaaacactgtcctattgtacaagcaggcatggtgaacagaaaataattattgacataaatccaacacctgaaatacagtgtatgtacatcattcaaacacaggtcagaagatgggcgatgtaaagctgccggttagaaatacagtcagaagctagtaattttgtacagacaatttattagagcaggtacaacttcacatatgtacagtaaactgaaccattggtccattgtagatggctgtactacatacatggcagagcaaatctagtgatacttgatgatcaaatctccccccggtagccaccaccaccgaagtaatcacttcttgctcgagcaagcgtgacactgttctggagctgctgcttggggcaggcctcgatacgatggccaaggccaccacaaaacgcacagcccttcacaccactctgctgagcaatggccaccttatcgtcctcctgtggatcatcaagatcagccagaattggtggtaacctttgctttgattcgatgagcaattgcttcaggtcaagaagcgtagtctctgtctggttcttgttgatgaatgtcgttgcgacgccggttttcccacgcctgccggttcttccaatccgatgcacatagttctctatctcagcaggcatgtcgtagttgatcacatgctggatatcagggatatcaaggcctttggatgcaacatctgtagctaccaatacatccttttctgaggctttgaatgatttgaacgcgtcttttctttcctcatcatcttttccaccatggattgcaacagcttcgacacctttcagaagaagaaattcttggatgtaatcgacatcggctttgtgctcgcagaaaaccagcacagggggtggggttttctggagacactcaaggaggtatatgattcttgcttcctccttgacatactcaacctcttggatgacatcaaggtttgctgctccagctcttcccacattgacaatgattggtttcactagcgcactctttgcaaaattctggatcttctctggcatggtggcagagaagaggagtgtctgtctctgtgccttgaaatggtcgaacacctccctgatgtcgtcctcaaatccaagatcgactagtctgtccgcctcatctagtgttaaatacctggacatatgaagaaaattattgagaacattcaaataatcaaggaatgagagctccatcagttggcctaataagccaaagcaaaagccaaaatttgaatttttgaacttgattttggagttgattttaagatattctcagtgtaatttctttttaccgttggtttttaagtcgctacgaacaaaaatataaaagttttacctataaattaattttcatttcataataagccgttttggcttattaggaaatatgggaaatcgatgaggctcgaacaaatggtttaattactggaagcatacaatcagtatatttggctatgctgtgaggctcaaaactgaaaggaatcaaagtagattcaagacacatctgcagccttctttccatcttgtttgattttttcagctttgagcatcgacatttctattactttcatatgattagcagatagaatcttgttttacacaagcagatagaatcgaatattagcatctctccacatccccttcgaaatgactactcttacttgaaagttgtacttatgtatcatcttcacccaaaaggccaaaacttaagctgatcactaattttggctgaatttcaatttccagttgacaagctacaaggaagaccatctctgcagtttgcatatattctgttctataaacgtagtgttctgacttttgacaaagtcataagcagtagtaaaaaccattttctacaattatatcactaaactgaatactgtttagctgttcatacttcaaaaaaaaaacccaccatttccatgatactgaacatatgaacatagcgctatgaatgccaatttgatgacagtgaacaattagccatggaagcagagcattcctgaagaaatcagtgcaccacatacctgcagttatcaagattcatcttcttcttggagagcaaatccttgagcctcccaggagtcgccactacaatatgcacgcccttcttcaccacctccatctgcgtcctcatgtccacgcctccaatgcagagcagcggccgtatctccgggtacccggcctccatgagcggcgcgaggaacatctcgatcacctcgtgcgtctgcctcgcgagctcccgcgacgggcagacgatgagcccgaacgggccctcgccgggcacgatcggcatcaggatctcctcctgcagcgccgccatgatgagcggcagcacgaacaccagcgtcttcccggaccccgtgaacgcgatcccgatcatgtcccgcccggagagcgcgacggggagaccctgcacctggattggggtcggcttctcgattcccttgccgcggagcgcgcggaggatgggctccgggagacggaggtcgccgaagcttcgggacggcgggggcacgtcgtcgccgtcgacaaggatgtgccagctccgtcgcagcgcgtccgcgcgggaccgcggcatgcggcggaggcgaagcggcggcctccaccccgtggtgatcggctcggagtagctgatccccttcgcgatctcgccgacgggcatgagggccttgcggtcggagaggtgctcgatcatctccctctcctgctggagcagccgctcggccggggtcacctcaggggcctcgcgcttcagcttcgtggccttcacgagcaggctcgtcttgaccgcaacctcacccaccgccggcgacgaggtggagcgcggcggcggcggcggggctgcaactgcaactgcgttcgtggtcggcggtttagtggcgcggcggaggcgttcggcctccatggcccggcgcttggcgacggggacgtactcctcgtagtcctcctcatcgctgtccggtgttccgcggcggggcgagtcgccggcggcggcggcggcggcggcggcggccatggcgggatacgagttggagggaggcgattcgcccagggagaggaagtggtggcaaaagtcggtttcgcctagaagtcgctagatttgatacgcgtggaggcccagtagaaaggctttgggatgcagctgggccaagttcgcgagtcccagtagagatttgggctttgtgaaatctggagattttatgtggccgaccagtcttggatacggcctggcccattttgttggttatggtcagcccatgaatgaatggccagggattctccagtccggtctgattgttacgtgggccgtcagatggcacatggccggagaggtgacaggcgggggtgctggaattttttcacctctgaggttgaaactcttgtcagtaggaaatggaggtaaatcaaatatggagtccagtctcataaaaaatctctttacacctctcatactgagaatcatactcctacatcaacattgaaaagtgttacacggtcactgtccatgtgttgccgtaaaaatcttaattcttaacagtactgcagccactctatcaccgtacagaccgtcactccatgagtgcactgcgcagcagggtgcagatgagaagcaaatgatagtccatgtttttatcgtcattgccatgcatgcatacagctggttgccatttgcgagaacagcattcacagcagtgcaccgtacgtcctttcgcgtcgccttctgccaccccggcccaccagcctatcagaagactatcccctgtgtgtaccagtgtatcatatcgatcgccaaaacggaagtttcaataatccacgctatatttttgcctgttcaaaacacagaatggaaatttcacttcacgcaatagcactagccctgtactgtaacacttatttaggcacgtgatgcttggagcgaggtggagattaaaaaaaaaattggcgatgtcagtctaatcggcgagttacggcgcccgtgctatgaatgcccatgcatgaatgtcgcccatctgccaaattaaacgagcgcgtaaatgatgcaacaaaacaatgctttgaatcatcacggcggtggtagctagccatccaattttgaagagccccagatcgatccatcgaacttggctcgtctgaatgatgagatatcgagagatcccttccctccctgcaagctgccgccaggatgcgacgaatcctctcgtctcgtcggtgggccggacggacggacggacgaacggcgaatgcgtcagcgcacgcagcagcgcagcggataaggcaaaaacgcgcagcagccagccagcctcgcgaggacaacacgtgccagccgcgcgcaggcgctgcagctgcagcagcagcggcagcggggtcgcgcacgggggacacacggcggatgccgggctcgcgcacgcacgcgcgcacgggcgcacgggcgcacggccaccccagcgctgcgcgaaccgtacgcgtacgagccgtggcacagctggagcgcagcggtggctatggcgtcacgagatcaaccccacgtaacgtacggtggtgcagtgccgacccgaccggggaatgatggcctgacgccgggatgccgccgcgcggaggacgcggccggggaaggcggattgatctcgatctgcccatgtaaaaaggcgaagaaatcatgcatgccgctcacacgccgtcacgtacgcgtggcgacgcgacgaggcagagtaggcaaccgaccagctgctacccgggagcaaaaccggcgtgccgcggttgcgcgtacgctggtttcgtgctttctggaaacatcgtactgtatatactttcagtatgcgactattagtatagtataatcttctcgcggagacaagtattttgtatattatgtaacgacctcagcagcagcagcaacagcaatggagtactcctttaattagatgtgatgtactatttgtagtaggatatatcacatccaaccaaattttcttatacgtagtattttctctgttttataaagtaaatattttagcattacccaagtttatagatatgttaatgaatctagatatatatgtgtgtctatattcattaacatttatataaatataaacaagttttatattataaaaatggagggaatactatttaggaacagaaggagtacagtacagtgcttctgctagctagtgctcgcaatgtagagatgatacgtgtggcgactgatgttgctaggactgcgagtattgaacacactcacagggcgctgtgttcagcgacaattttggagttggcagccataaacgcagccgagagcgagtcagctaacgctagctaggacccacggagggacgcacgaatcagtcgcaatgataaggctaaaggctagttgatgcttgctggtgagtggtgatcgatcgatcgatccatcggccggtcacggctggaattaatcggacgcgtttaaggcgtgcggcggagcgcatcccatgcatccggcagggggtccgaatcccttcaggcttcttcagatcgatcagctcagctcagcatcaggcttgtgttaatggcggggagcaggcaggcaggcaggcaggcaggcgtgtgagcgttcaactccccttcaaatttggagctgtagatttgctgatccactcgtacggcgtacgtgcagcacacgattgatgagtgaggtagtagctgctccagatgctagctggcacacgatcaacaacgaagaggaagggaccccatccttgattgattcaattcatcgcagtagtagtagtatgcatgatgcatctgcatgcagatgtacggagtactcgctacaggttagctagcgtccgtgcgtaggccacgcgtgcatcgcgaaacaattggtaacctgcaattggggctgatgagaaactactccacgcgtacattattgttgttcagctgcgcgtatcctagtacgtcgtgtgtgaaacaactcgatcgagtcgtcgtattgcaaaaaaacgagtcatggctttgcacgaccgggtacaattctttttttatactcttctccattgatcggtgggaacgaggagggctcttggagtttttgtctgtgtacgtgtgagccaggccagagtgtcggacagaggtttagaatttgtaacgtgggtttggctgtgtttagatataaagtttggatctaaactttagttcttttccatcgtatcaacatgtcatacacacaacttttcagtcacatcatcttcaatttcaactaaaatctaaactttgtgctgaactaaacacaacctttgcgtctggattgaggccaggcatgtacatagagctagagattcagttgaagaacacataatttaatttctccatgttctcatcaattcctactagtatgatagtatcattcggtttgtaggaatgagatatatacgaaaacaaaagaaaatccagaaaacatagaaaaaaaaattatccaatcgaatctcttgaaaaaaattctatgaattaatgtgcgcatacatttctattactccacattttctatttctatgaattgaaattcctccaaacctaacaagcctaaaaaactcatgtaaatcgggcttaaagttacttatatttgagacccgggagtacctacaaaaccattattttcagagaaactatagtaaacttttaaaattattgcaaactagccttgagattaggaaaagatagttgtacatcaagatttctcccctgcatcaaagccctgtaaattcatgatagcttaagcattgatcttttgattgatgcaggatatcactaaaaagtacttcctcttattactctttgtctaaattcgttgtcttaggaggagtcacatatcttattaggttgtttttttttaagatgggagtacagcacgtagctcatggtggttggttgattacattggcatcctttattttcaactcccatgcgtggtacctatccttatcaaatgtcttaatcagtttcataatcgcaaaattgaggtggcatgagtatgtttccaagaaaatgatgacacgtttcaaaacctctgcggagcattggcggtatttgtaatcacacgggaccgtattctaccaatacgtcgaaatgtgtcaattttaatttatcccttaaaattgtgcaggagctgaacaatctactacttagtagtacatcaaggattctcatggtgcaaaatccgcagttaaagtcatgtttgcactagctaaaaatttcatactaattgcctaaaaagatacggtggagtaaacaaacagattcataactttttgacaaccagtattcgtacagtcgtacgtatcgtaggacactctgattaatatagttctgacagatatgcaattgcttgccatgcaattatagctagctgtatctgcgtagtactgtagcacagactgatgattgcacttgatgtgctctaaaaaaatcggtccttgaaaaaaaaagcgtgattgagaccctgtttagatgggactaaaacttttaagtccctatcacatcgaatatttagacactaattataaatattaaacgtagaatattaataaaacacatctataatcttggactaatttgcgagacgaatctattgagcctaattaatccatgattagcctatgtaatgctacagtaaatattctctaattatagattaattaggcttaaaaaatttgtctcgcgaattagcttccatttatataattagttttataattagtctatatttaatactctaaattagtgtctaaatatagagactaaagttaagtccatggatccaaacaacacctgaattcatgaacgcaaaagaaatgaaacgaatggtgtgagtggtcagaggtagtaccagcacaagtttgacatgttctcaggacaccactaatgtatatagtaaaagttaaataaactttaactatagcacttctcacaaatgtatatggatacaatatgacattaagagaagagagagaaatagagatagataatattatttatatcatatgggtagttcatatgcatatggatacattttgctattttctttatatgaactagttgcacaatgttaataggtggctgaatggaatagtttatattgtggatgccctcatagcaatgcaacttcttttcttaaaaaaatctgtggaaataaattccatcaaaatgacgagttaggcaaatcactaacctgtcatttgagatgcaaactctattaaatcttcaagccattaatttgcaagaaattaagaatccaaagccaggctgatattagcaatgcattttcctgcattgtcatcgtttcgcacatgactgatacgcttattgcgaaaaaataattaataaatatctttttaaaatgtgcatttaacgacttaaaaactaatgctaaaaagtaaacaacgattaaatagttatttttaaaatttaaattttggttggaactaatagtccaccaaatttatgtacagttaaacctggtgcattggggtcctattcagattcgtagtttctagaaaatatcacgtacctttaaaatttcttatattatactactccgtaggacggagtaccaaagaaccacaagaaaatttatacggccatctgaattctgaggagaacacaaccaaagatggcaaatccagcgatgagcaaacgagccgttgcgtccagaattcgctgaacgtctcggtcgattttaatatctgtactatactactacgtgaccctctatggcgtcgtcgagccgaaccgagccgagccccctctgctgctcgctacagaggccgctgtctctcgcccctctggtgccaactcacacccattacacggctggcaatggcacggcatggcatggcagagaaaagatcactcacttcgcggcaccatccatccaaccatcttccaaaacccctatataaaccccagcttcgccccctgaatctcccacacacactgatcaccgacacaaacccaaagctaagcttcgagctcccccattgatcagtgagctagctagtagctggttggttaaaaggcctttttgttttgtttgagttggagcagaggagaagaatggcggctctgcttgtggtcgtgttggttgccatgtcggccatggtggcgacggccaactttaaccaggagttcgacatcacctggggcgatggccgtggcaagatcctcgaggatggccagctgctgacgctcacgctggacaggacgtccggctcagggttccagtccaagcacgagtacctctacggcaagatcgacatgcagctcaagctcgtccccggcaactccgccggcaccgtcaccgcctactacgtgagtgtcaccttccgccgccgccgttgttgtcgccgatgtgatcatgtgagctgatggtgtttgtgtgtgcagttgtcgtcgcaggggccgacgcatgatgagatcgacttcgagttcctggggaatgtgaccggggagccgtacacgctgcacaccaacgtgttcacgcaggggcagggccagcgcgagatgcagttccgcctctggtacgaccccaccaaggacttccacacctactccatcctctggaaccccaagcacatcatgtaagtcaagtccacacaagaattcagaaattttacaggtgacaagagaatgaatcgtgaatggattgttcgttttgtttgttgctgcagattcatggtggacgacatgccgatcagggacttcaggaacctggaggggaaggggatcgcgttcccgaagaaccagccgatgaggctctactccagcctgtggaacgccgacgactgggcgacgcagggtggacgcgtcaagacggactggacgcacgcgcccttctcggcctcctaccgcggcttccgcgccgacgcctgcgtcgtcgccgccggtggccgcacgcgctgcggcgccaccgtcggcaccgacgccgcacccggcaccggcgccgccgccgccgccggtggatggtacaaccaggagctcgacctcacgcggcagcagcggatgcggtgggtgcagagcaagtacatgatctacaactactgcaccgatcccaagcgcttcccccagggcgtccccgccgagtgctccatgtgatagtaagaatatcccatcgtcgtcgtcgtcgtcgtcgtcgatcgccggcggagcaagatggccggagatgaggaaggtgactggctggcgtctgtaaaaataaataaagattggcactgggggtggtaaaaaaaaagtgtaatgtagctgtggtgggtaaaattcttttttgttctctgtttcgtagtaagccactgcacgccctgttcgtgtgtaactgatcgtgtccatgcaacaattcatgtgtaatatattcctcaacaacatacatgtgtctcgtcctcgatgtgcatacgtgatcgtgatctgctctacgttgcaactgtataaattttgttgcttactactccctcaatcccatcccgaaacaaattcatttttcacatatttcgcacgtattaatctctatctctactattataaatattgaaaatgtttttgtcgatattttgatacgttattcgtgtatgaatcggtttttaatttcgtttgcttttaaaaatacatatatgtatttgagtcggttttttaagactgttcacttttgataatacagaaggatttatataagaaatctatttaaaaaactcgcatgctaacttgagatgatcagatttctaactgcagctcataattttctaaaagtatatatatccaagcgaactcgcgactaaaccatataataataataagattaaaataaacatttctagaaaataaaaaagtaagaatttctcaatttctcaaatcctaatacaattacttatttctttattgttctctatttaaaaatcaaattattttggaataaatgagggaaacttaagaaatgaacttactgtaagcggaggtgtacaagtatagagttttggtctgattaattactcgtggtacagtcatgcactgtgcgttgaaataagttgatcttggtctatcgggtttcaaaaaaaaaagagttgatattggtcttattggtcagcagtgtgtgtcaacaccaggtcaattacttacgtacgtactcctactcagcactgggtctatcggagtagatgttgcggtctccaggtgttgaacagctgtgtgtagtacgtacgtagcctattccattattcgatgccaaacagtctctttaattgatcattaaaaaattaagcgtcttagtaattctttacgattcacgatatggatgtttggttcgacaagagagctttcgtgattagtgcgaaaattaagatacgattaactaaagatgctaccactagtctacgtcacacacgagtatatcagcatggaacaaccaaacaaacagatcaattaacttgattcagaatcaaatccaagcaaatcagttactaactcgattcagaatcaaattcagatgcccctctctcagttaatccacaaggctaattaagcagcagcatgagtgagtactgtgcgagtcacaggacagaagacgacgagaaggggcacgagtacgaatacacgagaaggacaagggctcgtaatgatccgtcaggtctgcagactctcagttgtctcgctgggcactgggcgatcgatgtgaaatgcgtgttcaatttctgattcggacaagtggccgcaccgacagattcacagggtgtagatagccttcgcccatggctggcctggccatcgtcggtcggatttttggatcagcacgaagctgatcgatcgagccaaaattcaccaacagaaacagatcgctgctgctacacagtacagagtaccggaacaaagctacaagccgtgatcttctctttctctgaagaaagatggtggctgtgggctgtggctgcttgccttatcctttcgagctggtcaggtcacggtctcacggaccagccgtttcaggctttcagctactaggagtgtctgaattttctgaataaacaattttacgttacttgagaatatatcataaggcattattttttctattgtaaatttggtatctcatgttacttagataatgtgagataccatgaggtaccaaaatcaccttaaaaaccgtagaattgctttctaaatatttagtaggtgctacttgcggtttcagtcgcccacaccgcttggttgtggtgttaaactggtagggacgttagcccgtttgtagacgatcagtactccgtggtgttaaactgttaaatttggagtagtagtagaaatcttcggtacaatgctttaatgaatcatgatgaaaagtcaaaggatgagcttgcagttttgcaaaatattgtgacaacctattaggatcaggctgtgttctagagagtttttttttatatgagcacggtttctgaaatattaaatgatattttttatataaaaacttgttacataaaattattttagaaaattaattaataatagtttacttaattaatcatgtgacttcttttcatttttttgtgttattgaatcacctcatccaaagtgttgtcatgaacaaagccttagttctttttaattatttatcaaactgttcaaacagattatttacgcggtggtaaaataaaataaaatttctataaaaagaactttcttctacttatattgcttagaccacctattttcgttatttgttaaatatatttaccacaaatattaatttatccctataatcgagtagataatctgcggcaacaattcactcaacaacttatttcaaacgaacatgagtccgttggtgagttttgagctaagtacaacaatctctttggcaatctacactaatggatgatttaccagaaaaaatggagaggagaatgactaaagatgtccctatttcttgttttttttttctttatgcaccattgtttcttgttgggatataagttcgctaagtgtcattatagttagctgtacctacagtgtgcgagtagtatgcaaccgacgtccggctgttttgtcacctcatcatgtctcttcgggtgtcgtctgatagggatttgggagtgggcatgcatggtatctgcagtaaccagtgacttacgattgattgctacacaaaagctctatcacaacttgtgactcttgcatgagcatcaacacacatgatcaaactagtacatctgctcttccttttgtaaactactactagtagtactagtaaaaattatgtactcctacattccttgagcccctttgttttagataatgacattccttagaacttttggaagcttggtttgaacagcaattaaatcatggacggttcagggagttaacaacttcaacaccaacatgtcgtgtatacattttttgtcgtgtatacattttttttctttttgccctgtttccgctgattggagttgcgtttagtcgtcgtactctcttcatttttggtttttctgttttgttttttctccctccccttagcataaaccggtttagctgattgcgttgtgtaaacaaactctctttttttctaatatattgatgtgcaatccttttacgcgttcgtggaaaaagtgtacaaatttttcaatgagagtttgaaatccaattccaggaggaaaaaataactctgaaccagtactgatctatgcatgattgagctggttgtacgcagtgcaatgatagactcaagaacaggatatacccacattgtcaaatttatgaagtttaaacagggagccaaataattggttgtccacgacgctttatttatgggtgggggtatatccgtatatgctagctagtgtcattctgccgccttcgttgcactctgcattgcgggtgtgtttagttccacttttcctaaaattaaaagtttatatatgtaagaaaattttgatgtaatgaaaaaattgaaagtttgaagaaaaagtttggaactaaacaagggctgcaagggctgcatctcttgttctcttgcaagaccctagcactagctgcagtgctatactgccgttgacaagtcacgtagagacaagagcaagtataatagggggttgtaattccgctaaatgctaaagtagaggagaaaagagaggagaagcgggctgtaaacttacagtcagcttggacgcaataaccaaaaaattacgtgagagagacaggtgtgccatatatgaattgtaaatagctaactattatatgcgtaggctaagaaaaggctataaagaaccaacaagttagttgtattattaatcttgctctaacttagttttcttttttcttttttcttttttttaaaaaagaactcgaccaaaaggagacacatcccgaagacattgcatttaaggtcgggaacttagttaagcattaatttggatcataattcaatagaaattttataggtaaacgtgggaaaaaatatggggtcttttggatcgtaggattaacctcgaatggatttactccctccgtcttaatataaacaataaatatagattcatggtattaggatatatcatatgttattttattttacgtgaaaattgttatagaatttggctccttgctagtccacgctatttcttgccgcacatgtaacatgtttatttgtactgtgcaagctataagagaaaaaaacatcataattgctattactaaatgatccaaggtcttacatagtagctgtataccacactctctttaattaattaatcatttgatgattgcaagatggtcctgaacctagtggaagatgagattacatgcaatccattccagatatgctgctacatttccagatttcacttgcctaacagagtcacaggttaaaattcgcactacaaataaaacagagatacagtagctgagttggactcattgcaaattccagcttcagtacattcatccaaattaattgcacaatttcagcaccaacataattggcacacctgagttcagacaactaccctggcctaacctgcatatgattagatattagaggatcatcatctagcctaattagcatttgggaattgggattactacttttgatgcatcaatggcattctaaagcgactttctgataactgagggaccagtccctctcctgcggacagctgctatacgtgcaagactagtcctcctcttggattggatcacgccttagatagtcctggacatcattaagtttggtcaagtatgagaaaactcggttgcttcttttctgaaagaagataattcagttgcttgtcactacttgggtttcagttactatctagatctatcatgtatgcacttcatcctagttggaaggtgatggagatgcaagctataaatcacactatctgtttaactataagcttggagaacacatgtgatggcacatggcctgaaacaacccaaattatgtcaatcatctcgcagagatgaaaggcatggccttgaaagttgaaacccatccgaatttaaaggaggctttaatagccactgacgagcaacaagaatgcatttgctgaactttcaactcggcctatgaacatcgagctggatccaactcgatcgtagcttgctgagagcttaaatgtgtactctgttctgaactctggacactgtctgtgtccagctaaaccgtggtgcggcgctcaagaggctacgaactcggcaaaaggctttgctttcgggtagtagggtttaatgtttgggtgttagtgcctttgtgcttttttgtgcaactgatccagctttgatgttgcctgaaatcctgcattgttttctgctctgccgctagtaaccccaatcaccactcgaaatatcaaggaacccaatcattatccattgtgcttgtgcatgaacaatcctgtccgatcgctcaactcaaaagttcacagctggaaaattttatcattgtcctacccttttcatgctttcgtccgtgctcatatgtaccgcgagtgcaacaaacaaaatagtttagcgcagctgaattcctggaaatttccatacgaaagtttctagaaaaaaaaaaacgtaagtcaggagcacagctgcgctaaatagcaaatctgcaattgtaacaaccatccctccaaaaccgcgtagcgtagcccaaccgataagcaggcccacttacacacatcactccccttacactttcgttatcgcttcgtgtaaaagggttaacccgggagtgatgtggttggaaggaagaggccttataagtcggttccactcggctaaactagtaaggtggtactaaacatgcgcacacaacttatatgggccacacaggcctaatccttattgggtcgggatgtcacagcaatcccctgacataggcttgtctagctgagtggtgctgtgtaacaaaaactcgttttcttataatatattgacgtgtaatcattttatctgttcgcgaaaaaaaaaatccccgatcaatattggtaataggagttatagacttatagtacttaccggatgcatccacatcttgctactgcgattcgatagccggtgagaccacaaatcgtccgcattgacaacgggaaggcctgtgaccgcgcaacgcgatcaccgatcaacacgcgggctcgtcggcgccggtgctgatgctgatcgatcttacgtcgcgtcgcgatttaactttggcatcagagtatcagacattgtcaatttttctcttgtcatcgcctcagctcgactgatgaccggacgaggcaacgtcgtcgtcgcgaccgtgccactggtggtgtagctagctagcgcttctattacgacgtcgtcgtgtggtgcaacgagaaatcctgccgctattccgcacgatgctgcatcgtgttgctgccgagtgccgacagattcgcctgggatatctatccctttcgtttgcccataatcgtttgaggaaaacgtggatttccttgtagatttgtagtttctactagtgacaggctacgtgcaaaagcgggttcccaaattcccaatcccgtagccttcttgggcttagcttaggtgcaaagtggggtacaggagaagcccaatcttgtgcacaattctaccagggaaaaagtacaccgaaggtccctcaacttgttatcgagttacaaaatcgtcgcctaaccgtaaaaccggatacaacgcatcccaacttacaaaaccagtgtagattagatccctcggtggttttgcacccggttttgtccgacgaggcggctgagccagcgtgggacccacgtggaccccacatgtcaggatgccacgtcagcaggctggcctctcccttcctcctctctctctctcactcctctctggactgggcagggcggccgacggtggggaggaggtcgccgggtgaggagttccgacggtcggccggcgatgcggcggcggagacacgggagaatgggagggcggcggcagggcgaggcggcgtcggcgggcgagcgcggtggcggagaggcggcggcggcgacgacgccgtcgcggctcccactccctctcccactcctccccaagcagcggcggcggcggccaccgagcagcggcgcgacgagggcatcgttcgccatggcggcggcacttgggctcagcggcggcgaggcgttccggctgtcggcggatgcgggcgcgggcgcgctcaagctgcacaaggacgacatcaccctctggtccgtcgacggcgccaccgtcgccatcgtacgtccttccttccttgttaattcattcccttcctcgatccttgccgatgcttgtgttcgtggctatggtgcgtttcgaatctgatgctgctcgtgtggatttggtaggattagtgcgcgtggccacacatttggtgggattagtcttgtgtttgactttcactaatcctcaatctttctagaaatatttgcaaaattgttaaagcaataatctctaactcttaactatctgggtatgacgacgaagaagatgacagttattcatatttctcaggttaatgctgctaatgaacgaatgctaggaggtggaggtgttgatggaggtgattgaatgcagctactagtgagctatcatttatctcatcacggattgactatctcatactccagtacaattctcattgtagctatacatcgagctgctggacctgaactcgtagaggcctgcccagtccagagacgcggggctggcagattctcctacgccgacgagcttctcaaggcgttctgcgctgcctttccttcttcttcatcgtcgtcgtctctgccgacgcctgcgccgccgccgacgcagccgcagccagagcagcagaaaccagtggtggtggtgtgtaggagaatctgccagccccgacgacggcctctccggcgaaggcgaagctggcggccgcgaggcaggtgccaggcggcgtggctagatccaagaggaggtgagctttcttcactttgcctccacgctcacccacgccgtcgccttcggcttcccgcgtcgcagccgccgccgccgcctcctctccgccaccgcgctcgcccgccgacgccgcctcgccctgccgccgccgtcccattctcccgtgtctccgccaccgcatcgccggcgacctcctccccaccgtcgaccggcctgccaagtccagagaggagtgagagagagaaagagagagaagagaggaaaggagaggaagggagaggccagcctgctgaagtggcatcctgacatgtgggtcctacgtgggtctcacgctgactcagccgccacgtcggacaaaaccgggtgcaaaaccaccgagggacctaatcctacactggttttataagttgggggatgagttgtatccggtttcgtggttagggacgattttgtaactcgatgacaagttgagggaccttcggtgtactttttccttctaccaggccttactgtccatcacagagcgatgtagcccacagccaaatataaggctttggagttcggaaggcggaactggacacacggcccatcctcttttccgcggtggactggtttgcgggccagaccaacaaaacaaatgtaggaataagtctattttgcttccctcaactcatgagcgtggttgaatcgcacccctcaactgcaaaaccgggtataacccgtcccttaactttcaaaactgttgcaaatcaactctctggcggtttcggaggcggtttcatcctacatggtgggttgacttggtattcattccacatggcatcgatgtggtgcttacgtggcactaaaataaaaacaaacttaaataaaaataaaaataaaataattcttggacccacatgtcagttacccaactcctcctgctttatcatcggcggcgagcaagatggagagagcggcggagcggcggagcggcgggagcagaacgacaacgggagcggagagagagcagaggtgaggaagcctcgccatcgccgcctcccctcctgcacccctcctcctccgcacaggtgaattgctcctatagttgcacactcatattggatgcaaggacgtcgaggacacaaggggatcggggagtcaaagtggccagggtttaaactagactcaagcttagtttagcagcaagggttcccaacccatctttttcatgttccgtgcgcacgcttttaaaactactaaatgttgtttttttgcaaaaagtttatatacgaaaattgcttaaaaaatatattgatctatttttgaaaacaaaaattagcaaatacttaattaatcacacgctaatagaccactctgttttccgtgcgctggagatacgttcccaaccgcctgcagcgaacacatcctcactcactttacaagcatatggttctcggggtatattcgtacttttcacatgttctatagcggatacatgttcttgttatgttctacagtaaagatcacaacgtttaaatatcatttagcaaattttatatttcgaaatcatggctaattgtctctgataggatcataggaggctggcgtcatggcgtgcatgcgcgtctgtggaattctgaggtcctgagctttggtgcgcaaagttggacccctgatgaaagattgtcttcgtacggaagtccagccgccgccgggtgcccagggcggttggttccattccatcaatcatttttccaatcgttctaattgcacttcaatcctaatctttgggtcgaatttggcgtaatggcgcgtgaaccggtccccgtcgcatatgtaccatgtcattgtaacaacagatcgaaatgcccaaagaatatttctcacaatctttaaagccacttttgacaaacaaacttattatacatccatcgtcgtcgacttattatcttcctcgtatccttttcccatctctctactactttttacacgacaataacacatacagcaatagatacagaataattctacaataaaatagtttcaagtgcccctttttttttcctacttggcagtgcactccggcggtaacccctgggggaaccggtacgtgtcggcgcagtaattgtagatcatgtagtccctctgcacctgccggagccggtcctgcgacgcgctgtccagctgctgctggtacatccacgggctccccgggttggcgcacgccgtggcgtcctgcgacgtgcacccgctcgcggcgagcccgcggtacgacgccgtgaacggcgcccgcgaccagtccgtcctcacgcgccccccctgcgtcgcccactcctccgcgtcccacaggctcgcgtacacccgcatcgcctgcgcccgcgggaacgccacccccgtcgtcgcctccgtgttcctgtactcccgtatcggcgtcccgtccacgtagaaactgaacaaacaaaacagattaacagaagttgatccttttgtcattttagcgattaccacgataaacgcgcgcacgcgcacaccactatacactctaacacaaaccaatgatatattttcgatatcactaaaatcttattaaaagcccatctacacatgcataatattcatgaggaattttataattcttgataaagtgtctagaggtaataagattttatactagaaattttggtaactcaagataattagtagttagatgtactaaattttaaattaaaaaatatggcacctcccagtacttttcaagtatgataaaattacttaatattcgtaagcaacagaatttatattctaatgagttgagtcatataaccacgactctactaatgtataagtgcattggtgtaaaaaaagttgaaaagaacataaccgtgatacgtacaggatgtgggaggggttccagaggacggagtaagtgtggaagtccttggtagggtcgaaccacatgcggaactgctgctcgcggccgcctttcccctggctgtacacgttggtgtgcaccgtgtacggctcgccgctcgcgttccccaggaactcgaagtcgatctcgtcgtgctgcgacccctgcgacgacagctgcttccacgcaacacccaatcaccattagctcttacaggcaggcatacgcatatgtactcgattggcgatgatcgatgcgatgcgtacgtagaaggtggcgacggtgccggcggagttgccggggacgagcttgatctgcatgtcgaagcggccgtacaggtactggttcttggactggaagccggagccggacgacctgtccagcgacagcgtcaggagctggccgttgccgaggatcttgccgcggccgtcgccccaagtgatgtccacgtcctggtagaagttgccggcggcgccgccggcgagcagcagcacggagcacacaatcgccgccaccaacggcggcgttctcccgggattggaagaagaaaccatcgtgtgtgtgtgtaacactgttggattggattcggtttttgatcgatcgatcagatggttttcgtgcagtggtggtgaaagatcgttgtgcgagctgcggtttttataggccactggagtggaagggtagcctttcggtcggatggttggaccagagacgagaagagggtgtaatgtaacgtacatgagctggatccattgagcggcttgacgatgtggacgtacacacgggtcagaatcgcacggcttggttttagccagtttgcttcttttttgggccttagttttgctcggtttagtgttgtgatatgattggtgtgcgtcacgcgcatgcaggaaaaggggttcctggctcggaacggaattctgtgtagtagcggtggagccaaaaattttctaagcctagcgctcgagtagggctcaattaataggatattggttttctagaaaaatatgtaatggtttaaaaggatttaagcatatttatggaggtaagccgggctcaagtctaagctgccttagtcttgcctctgccctgctatgctgttgtgcagtaatatatatgtattaggtgcaagcgtttacaatcccaacaaaaatcagtctagtttacgcgaaaattggattttctggactaccacgatagcacaaagcactcgttttttctttagtcaagttaaaaaaaatcaaactaaaatttgattttttgacaaaaaaaaaacttcttcgatttccattggtttttattgatttaccaatatatttttttataacctaagataccgctcgggactatgaaccctgtgtgcaattgacatgtgggcagaggttgtatgtccggctggctcactgcaccgaaataccgaatgatcggcaacctctcgtcacctattctgatcccaagctgaggagtcgtggagtgacactcaaatgcatgcattgatcactgataagtacgcacagattgcagctgtactaacgaaacatgaatgaagagatatgatgcacgcaaaaacaaacgggtgcggatttaaaaacgatgtgaccgaaccgaactaataagagcatgatggtgattaggattagtttgtttagatgtcctattcattagctagcttgttatggaaatttatgctactgcttgcttgtcaattacacgctgattaaatgaacatatatggattaagcttttttttttttaacaatccttagaaaggtactactcagcaagagattctgatctgcagttgtaggagcaattcttttaactgatagcctcatcggatggctatatgcacaaaatacgccaaatagcgtattagcgaaaaactataatgtgtgattaaaacatttacatttattttctttgcgacttaaacgattatgttgtaaaagaaattatgataaaaaaaactcaaaaactactttaaaattaaattaaaaatttaaattttagtattagcatatgctggttgagccaaaagatgaaagcctgacacaaccaacacacgcacaaagggaatcaggtaaagccaagtcgacaccttaacgaacgatctgttggccgttttccctcgcatagctaggttttgaccagttttgattccccgtggataaaaagatcaccataggcgactacgcatcatacaccgtctgcagcttgacaaaaatgggagcacgggagatgcgctctgaatttctcatttctcaaatcaaagcgacagcttaaccgactctgtctaaacccctaggattgaagtattagatcaggctgtcaataattatcgtagcatcaatcgaactcggaaatacatgcatcgacgaactgatcatttatgcatacgtactgcaaaattaaatggcactccgtgaacaaggcgaattcagactttcagagaaatgtaacgctgaccgtgctaatataagcttcagaatcccaaatgcataccgctcgtccaataatcaatccaacaagcatataccctataatgctctcttctagagctagcctagacaagtgctccattccatgaccatgtagatgtagctagccttatctgctcaacaacacccatcccattcaattgtccaccgtctttagctcttgttaaacctatctttttcagatagatcaaaaggggagctacgcatgcaagaatcatgttgcgacagtaatggtcgccatggccttcgattcctatatcataaaatcatttctatggatcaagtggtgtcgccaatttctaggatgataatgggtcggctggtaaagttgggaatcatgcatatacatcagactatcagagtgttcagctatccgcactgatgagctgtaggctgttctttttcttccagcctccaactgatatattgtactacgtatattaatttgtagctagtcagccacaatgcatgagcattcagtggactaaccacattgggttctctatgattagtgctaatgcattggtgatcactttgtgttgcttgcctggtggtcctctgagggacacgtgtgtcaccttttcgtttttctttgaaacgtaggtttccaagtgatagaacattatagactagctttgataatggtggcaacaaaattaatcgatcactatcgctcaagagctcagttggtgagagattcggtgcgcattggcacgaaccaactaggtttaatttggctctatggaactcatattaaaatgcacttcattttcttaacgaaaagtaacatatccctccattttctctgtagaaaagtcatagtcactgatgaagactgcatatatgtattgtagtggatcagcgcaacagggtaaatatatgcatggtgcatataatttcaaacattaatattggaagaatggacgtatatagtatgaaaatcatcaaagatttgtttcagagtacgtacttataattcaaatatcatacttcaatgggtacaacaaagaaaccactgaaaaaatatttttctaaaatataagtcactacaaaagtaaatggtatttcttccgctttcaaatatttgttcacgttaactattactattccaactttggccatttaataactcttaaaagactagtccatgataaatgaaagtttcatggttatgtttaatgtgtgtaatacatagtatgttattttcttatatatctataatttttccacataaaaggcaaatcagagtttgcaaatgaacaatgtcttacgccagtcttttttttgaaggagtgatgtcaggtaattaaaaaatggagagaatagtaacatacttttttttataagaacaaataattaacgtcaaaagcgtcatacgtttaaaaccgtagtagtaaacatcactctcaagctgtcgccattttttttgtcatcttttacagccttggtgctggcacgcgcttcctatgaattgagatccaatgcagttgtaataacgactgcaactttagcagtgatagcatattatgaccgttggatcgatgcagccaacagcttggatttgctctgccaccccctgcacagtatacgctacagtagaaaattgctacagtgattcgtgaacaatattttctaatgatctgagccgctgatttttgatccatcagctaccttgcaactgctaaagttgcagtgatagtaacaattgtactggatctcaatccgcttcctatatatcttcccagttgaaacaaacacgacttctcatcaagctctagcaaagatatcaacctccactgcgggcactaagcttatgcagcagtggagtcataaacctacccacacttattgaagccacaaactgcaaactttacactactagtatatactagtagtaatataagtatacaaacaatgtatatattttttttttcagacacgtagctcctttacatattcgcataaaaaaaacgcctttcgaattcgagcaatctaagcgtgactattatatacttcaaccaccggtatatacatgtttcaagccatacgaaaaggaagctgaaaaaggagtagccgacggcgtctggtccagtgtatgtcggggaaatcgacctgcaatctgcacttctgcagaacaaataaacggctaccacgacatggagtcatggatgacctgccggtcatgctcgctgcaattctaaagcatatctgatgcacgtagagtagataactatagctatataaagattgtatttagtagcaattaatcagaccgtgcaccaactgagcttggctagctagcttgccagccggacgtcgagttcgtcagacttggagccacatccaacgtccatacattattccatcctcctcctcctactactaccacaacacaaatcattaaaatctcttactcctagcttcattgtttggtttatttgtagaataagggaaacggccatatttgcaaacgaaaaaaataaattttaagggaatttgtaaacgaaaactaatttatgaataaaatttttatatacgtgttcttagcgatttaaaagtttatattaaaaataaacttcgataaaaaaaaactctaaaatcagctttaaatttaaagttaaaaatttaaattttgacttataagtataagtataagcgaaaagataaaacccgaatactgctgcatgacaaatcgtctaggcctgtcaagagaaggacgtacaccttgtagcaatctggagccgagttggaagcagctgtctgactagactctctgctcttctgctgatctcaaacagcagtagcacatctcatgcagtagctcgtggtctccatgaagggatatttgcggggatttcgggtcctctgctggatgttgatgcctgaaagggaggtggaagaagaaccgtgaggacttcaattttcggaagggtgatgaactagctagctgatcgaagataaggtccagtttttcggagggtcgcatccattgattattgctggtgaaatgtcgttgcggcggctaagttagaggggagcactgggaggacaggcgagcacggtgcactgtggacacacaaagcagaacaattccttcctttaatttgagattttggacgtgaacaactaaagtagtaggaatagtgttctctctgcgtaacagtaagaaatgtttggtgcatattaaaaaacttaaaattgcacatcgcactggaaatccctcgttttgttcatggatgaattcacctgaggttttcttcacaggagctagacatctcgaatatatatgtaaaaaaaagtctgtgagttatacagatattaatagcaggtccagtccccatgtacgcttcagcccattccacaaattattgggcttaatactttggcagataggcccatacccaccaagcataaaggcccagcactaatacttcgccattacggcccaaacatccaatttgcagagttctatagctcgtcgtctcacaataataaaagccggggacgatcacgagacgaatagatctttagaaaaaaaaatcaaacaagaagtccatttacatcgtcgtagccaacaaagaaagaaaaaaacagattctggaacgagttgagactttccacattaccctgcacaactcaacccaaacctaaaagatcaagaagagacgattattcattcagttcccctcactgcaaaacacaagtatgagcctacagatcgctggacgacggatggaatcatcatggagtcgacgtcgcgtacgacgcctcacgttctaccgatggggatgatgcactcggcggggaaacggtgcgggaatcgcttcctgtcggcgcagtagtcgtaggccatgtagttcatccgcacccagttgagcgtcatccagctccaccagtccatcctccgcctcatccacccgccgccgccgccggcgcaccgggaggcgccggcgccggcggcgtcccagacgcaggcgttggagacgttgtagcggcggtacgtggcgacgaacggcgcgcgcgaccagtccgtcttgacgcggccgccctgcgtcgcccactcctccgcgttccagatgctggcgaacacgtgcactggctgccgcgtcgggaatggcaccccgtacgcctcgttgttcttgaacaccctgatcggcgtcccgtcaatgtacagtctgcaccaccaacatttttttttacagatttgttacacacaggtttgtctctctgaatttgacgaggagaccgagccaaacgacatatttacaaacgaaaaataatttataaataaaacttttatgtaaatgttcttagcgatttaaaaacaagttctgaaaaataaactatgattaaaaaaatctaaaaatcaaatccaaatttaatgttaaaaatttaaattttgattgataagtataaatataagcacagaaaaaagaaaagatactcctaaaagataaaatttaaatttttcagagcttacatgatgttgtgtgggttccagaggatggagtaggtgtggaagtcggcggtggggtcgaaccagagcacgaactgctgctcacgctcgcccttgccgtcgctgaagatgttggtgtgcagcaggtacggctcgccgctcacgttgcccaggaactcgaagtccacctcgtcgtgccgcgcgccgccgctgcagatctgcgcccgttggtttggttgattaatttaattaattagttgccaatgcgagcagaaaaaaccatcagatatgtcgacgtgtgcaccatgactagctatccaggtatttcgatcagccaagtatatgccttcaggcgaattagtctgaatctttttggataaacttagaaatgttaatcgtggacaccatgacaccatgactaaaactgcctactactgaaaattgaagatgttcagcctggttaccggccggtagtaatacgtgtaatatgcagaaattgatttattttacggctaaaagtgattatacaaatattctgttccaggaaaggtagcaaatgtaataccaacattgcttggtgaaagtgatgcaattttcaccgaaacaaaaataaaaatgttatcatttttctatctctagggcatgaaccgaccaagggtgtacctgatctacatactgctacttaaatgcagaggccaattgaattcacttactgccaacatttatgctgctgcaagtacaaaattcaccccaatcaccgctcaaccatcccatctgctaatcgaggaccaaacttgttaatctgggatgacaatcttcttcttattattttctgccccataaagtaaagctcatcccaagaatgacaagtgtcaactcgtggaattcccctggtgttcctctgtcgtctactactaacaatccgagctactttaacgggatgaacaattcttaggatttcacacaaactagggggaaaaatcgaacaaatcaagccaagatcgatcagaagactgccccaacttacatagaaggaagtgatggtccctgcagactctcccctgacgagcttgatctcgagatcgaacctcccaaacaagaaccgctccttggactgcagccgcgcccccgtctgctcgtccagcgtcagctccaccatccgcccgccgtcccggaacctcgcattgcccttcccccacacggcgtcaaagtcccggtggaaattgtggtcgccatgccccgccgccgccgccgccgtcactgccgcagctacgacggcgacgagagccgccggccacctcaaccggagagaggcgccaccacgcatgtccgcgcacaatgtaaacgcatgcacaaggcacagtgacagagctccaccgatccgcgaaatgcggcgtatcgaactgacgagctgcaagaggagatcagatggtagagactagaaatgaaactggaggaaatggaccagtgtcctgcgaagaagacagagaaagagaggagagaggtgaagtgaaagaggatgtccaatttaagggcacgtaggggtggcactttcgccagatgccagaacgaggcggcatgcacgtcggttgctgcggcaggtagccctgagccccccagccatgcggcgtccactgaaatcgcatcgtacgagacacaaaccacccatgaaaaaactcaaaaaggaatccgacgagcaacaggacgtggcacagagtcgacggcgccaggggagatcgagcggtgaaacgtagtagagagtagtgtgggcgtatgggtcgcgtgtcgggttggcaatacgacgtgtgagcaggataaattagctcgaccacggtgttgctgcaataaaaaccggcgggacgggacggcaaacggcatgcatggcatgagtgcgcggcacgaacggagcggaggctggtctggtggtctgctttgatttcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatgggatggatgacgtcaccgtgaagggtgggcgtgttacggcccacgggacttgtgtattgcctgttgggcctcactggggcctggtaggtatttctcctacaaggtaaaaaaaaaatcataactatcgatcaagtcgaaattaggcaggtgaagtgggccgtattccaaaattttcaatgtggttactggtgagccggataaaggctgatgaagttacaaatgagctgggttggcaagctgaaggaaaaagtatgccgaaggtccttaaacttgtcatcgagttacaaaatcgtcccccaaacataaaaccggatacaatacatccccaacattcaaatccaatgaaaactaagtctctcggcagttttgacttcggttttgttcgacatgaccgctaacttagcgtgggacccacgtgggccgacacgtcagggtgaccacgtcattatcatctctttcctctctcccccctctctctctctctcccccagttgtcggcgacgagaggtgcccatttcctccaccagctagcgcatcgccgaccgccacgtaggacaaaaccgggggcaaaatcaccggaggacctatagtaaacggtttttgtaagttgatagatgttatatatctaattttgtggttgggggatgattttgtaactcgatgacaagttgagagaccttcggtttaccttttccgcaagctgaatacaagttctcatttcccgggcttcattcggcctgacaattggaccttagcccttaagttgggcttatttacgaccaactaagttaaaatcgaaggaaaatgatacatgtacagaaatgtgtttagaaacattttacaaaaactgatgtggcatttgttatatattgtatcttgttttttcgtaactatccactgattaaatccaagtttgtaagagtttagtaaagttctttttaagtacgtatagcattactcagaatcgaatcacaacctgtgattaaaaaaataatttctaattccaaattggttctaatgcatcatgtggtgacagtttgacagaagatgatcagaactacgctgcaaacagtggcacgagaagcagtttgtgcaaacaagcgattgggtgcgaatcaaaaattttaagcaaaacatggctggttgatcaaaccgagtgcgagcattagttttgtttaatccaagcagatcttatcgtttccaatataaaatggttcgacgttttcgttagcagtgttgctgcagctgcagatgcgaatgttggtccctcggttaaattaatcaaaaccggataagctcgatctccccccacgcaaggctccagttttacagggtgtccattgtcgaaggtggccagtctggctggcacgcccagtactagtacaggtttatttcagcggctgagcacacggaaaacatggccaaaacccacaaagggatccatcttctggctaaaagcagctcactaaaatttatcaaacttggtacgtacatcgaccccgtgttacaaaaagatatcaaagaatgcgatatgcatactacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaacttcctctgcacccacctcatgcggcggtagctcatgtcgctgagctcctggttccaccacccgccggcgccgcccctcctgccgccggccggcgctgcgacggtctccattgtgccgacggggcagcgctgcgcgccgttcgaccagacgcaggcgtcggcgttgaagtcgcggaaggaggcgacgaagggggccttgctccagtccgccttgacgcggccgccctgcgtcgcccagtcgtccgcgttccacaggctcgcgtacacccgcatcggctggctcttggggaacgccacgccacgggcctcgtggttcttgaagtccctgatcggtgtcccgtccaccgcgaatctgcacgcaccaccaacacgttgttttagccaaaacccatcgagtatcaaccatgcgtctctgtctcgcgtaacaacaagaggggttcacgtgccaatgtggaagtaaagtaggggactcacatgacgtgctgtgggttccagatgatggagtaggtgtggaaggactgggtggggtcgaaccagaggcggaactgctgctcgcgctgcccctgcccctgcgtgaacacgttggtgtgcagcgtgtacggctcgccggtcacgttccccaggaactcgaagtcgatctcatcgtgggtcgaaccctgcgacgacaactgcagccacaagcacagaagatcacacaaaccatcagcttcattactccactttagttccgtttttttgccgaatttggtagatgaataaatgatgaagtgatgagaccgtttggggaggaagataagcttacgtagaaggtggtgacggtgccggcggagttgccggggacgagcttgatctgcatgtcgatcttgccgaagaggtactcgctcttggactggaacccagagccggagctcctgtcaagcgtgaggtcgagcccacggccaccatcgacgatcttgccgcggccctgcccccacgacacctccgcgtcctggaagaagttgcctccatgcgcaatggccaccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgtacacggttaaagaagtaaatgcggcacggagcgcgtcgctgcagagcgccggatagatttggggcgggggcgatgcatggctggacgcacgctggatccagccgccgcgtgcctacgccggggtgtgggggccagagacgcgggggactttacttgaccacaccacacccatccccgcggcggcatccgcgaaagcggtaacccgtaaaccgggcaggtgatgcctgccgatggacggatggatgcgagtacgtggtaaagtgtgcagcttttgtggcgcttttgctcggctttgctcgcggatcgtacgtcacacggggccgcggccagcctcggctttacagttcatggcctgcagtgcagttcggttcgcgcggaagcagcagatcgtgatccggacggacgagccaacacgacggcattgccgccatgtgcgcgaaggcctgcgattcggggaaggttcgcctggtttgccccatgggcgaaggaagtggcccggccattccatccagggcatcgacggtcgatgcacatcgttcgtacgtactgtacgatgagcgagtgatttaattgcggtcacaaatcggtctcgaggacgactgttgctgctggtgagagtgtaattgcgcccttgatgtgtctgttgggagtttgtgttttgtgacagcggattacacgctgtgatttactggagtagtggtaagttttcaatacctgaaaggttacgttttgattgatcgagttcgggattagtaaggacgacgtccgtagatgaatcgtagctgggctctttagtactccgacatgatgccgttaggtacgggcatgttgattacgacacctctggccaaatgatgaacagagtcgccattggacttgtctaggagggagacaattgattctctggccaaattcttgcgtcactcaaccctaaagatggataactattttttttaacacctaaaatgattacacgtcaatatattagctaaagctggatatagacctaacccgctatatgtaacttgcactgtggagcatgcagcttatactgttcttgatctacgtggcatgtgaagaacgataaaacttggtggcgcgctgtgagtggccctagattgatgtgaagtggctaaggctcgcgagctagactagtgggctacaactttcttgcctcatgattgcttgttatgtctaacgtctagtcgactcaatcctaatggaggtaaaacattgtaacccttaggaaacagcatcatgatctaagtagttaaggcctaagagtatccccagcagcttatccaaatttgattctcggtacactcatatggatggccatcaaaaaaagattccttcttcatatccttctcactccaatagatcatttatatttcatactccataccacatcctcctatcttttactaatatctttcaactaagcatatatttgtattattttctaagggctatattttgaacaactaaattttaatagttttattttatcacggtaatctaaatggttagattttaacggacatatttctaatagataatttagtgcattaaattgctactttctctaaaattactcagactatgtttctcttttttctctacccatagtctgccttttgcccattccaatatattccaaccttttctattcctccttttctctctgctctgttctacactcttcattctacccaggaagcatgcgtggaggcaaggtggcctgcgagcgcagaggtacggcggcctgtcggtgtagaggcacggcggcctacggacgtggaggccggtgggcgcggaggcaactggagctagcaggatcgatggtggcggccgacgggcgtggaagggcggacgaagatagcagcaaggggcggaggcagtcggcggggcgcgcgcagggccgacggccacaaccggccggcatgaagggttggagggatgcatgctgccgctggcggggttctccttctagatctggtatgtctctctctcaccctccctccatggctacacactccctctacaccatccaccgtacagaaaaatacacatccgaccggcgacgatgacaacataggggaggtcgatccaaaactcctgataggggtgggagctgcggccactgtgatatagcgtgaggagagagaaacgctatatttgggcttcctctctccgttttggcgcatcatctatttttgaagggctagatggcgtatccactggggccccgtttttcactcccgtgcactgtatctcggacagggtatccgatagaggatctcctgatgctctaaggctattcccaacccaataattagaatgatgtccatagcattaaataaggtgccacctaggatgaaaaatgatgtggcaagtgaataaatgaggaaagagaaggaaatcatgtctacacaatatccaagacatcatgtgtgataaggagcattaaatttaagtatggaatagtaatgcttgtattaaaagagtagtgtctagtactaatttcttgatgatgtggagtttatagaaactatctagtgttttgggttgggaatggtctaatggggtgtaagagtcgaagacccccgttgtccgtacgaccatccgaaaatgcaagactcccaagtcaagtcctttaccacgcatagcatgcaagacttgtctgtcacacgacgtgccacgatggaacccacatggcatatactgcttcttttgctggagatctcgtactatacaatacacctggttccagaaacttcacaagaaatctagctggccatggcataagcaaacattcagcaactgcatccaataaaatccaaataaatacttccacagtggcagcactgaagaacacctcggcatccactactcagagacaagcaagcaagcataagcattattctatgtactgccatagtgccaccacaccacaacattcaaattcgcccatgcctctccagtagaaatacggagaagcagaaatgatcatcatgccacatatcctcgcaaacaacagctgtccgctttgtccatttcagcagcatgcatactggtgccagccaacgagccagcagcagaccgacgcaaacgggtactgtacgtgctgtggcgaggaagcagggtgggccctcgacgcaaacggcatgggccgtgcatggtttatggtttatcatgccctcattgaacgattcaaatcattgctgttccaaggggcacgtacgacgcagacgcgcacaataattcccgtgtccccgaccgacgcgcccatgcacgcatcggggactcggggtcgacgactccggcggtgcgcatttgtggcttctactgcaatattgccgatccatcgatcggtagtcggtagagcagctctgccataaacttggacttaattggttacttagccaaaagcccaaaggagaatttgcagctagctaggtagatctgatacagtgaacacaacgcattgcaactgaggggtgtttaaatctaggattataaagttttggcgtgtcacatcgggtattatatagggtatcgtatggggtgttcgagtactaataaaaaaaactaattacagtatccgttaataaaccgcgagacgaatttattaagcctagttaatccgtcattagcacatgtttactgtaccaccatattgttaaatcatggaccaattaggcttacaagattcgtctcgcaaattagtcgcaatctgtgcaattagttattttttagcctatatttaatactttatatagatgttgaaacgttcgatgggataggattagaggttaacatctattgttattggtaaaaaaagaaccatagattaaattgttggagtactaagaagaggttaacatatattattattggtaaaaaaagaaccacagattaaattgttggagtactaagaagaggttaacatattattattggtaaaaaagaaagggttaattggatccatgccactgtaaatatgacaaatcagaaaaatatcattactattcatgaaatcgggtagatgctactccaatcttctaaaattaaaaccataccactccatcacgatttccgtcctctccgtcacatttttcgccgtctccgtcttatcttcgtctcggtgcctgaggaggagggcatggcggcacgccgccctcaccggcgccgagctccatgagggagatgatagccgggcttcctctcttcgttgaggtggttgcgctgagagcagacaattagggcgatggcgcaaagcggctgaaacgcgcggtggcagcggagagagaaggaaatcgttgggagaagcggccagggcatggcgagctcgggctaaagttgggaaaggaagaggagacccatgaatttcgtttttgcaatcaatttaagaagaagagcaactgggaggtcgtattcgaacgggaggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctctcctcctccggcgccggtttgtccgtcgagacgaagacgaagacgacaagaagataacacggagacggctgaatgtgacgaagaggacggaaattgtgatggagtggcatggttctaattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaacttactgtaataaaaaagaaaagaaaactactaaaactccagctgcagcctgcagaaacatgccgtgcccagagaggtgttctctccgtctcagacaacaagcaagcaactaatcaaagccgccggatcttccgattctatttcaacttgaaagagcaaaaacaatcaagttctccgggggattgcattcggtgtttgggctctaaccctttggtctgtgaaattgtgagtccatgggctatggcaatcttactcttggacttgaacaagacagacagctatgggctttgcggtaaggaaataaaagcccaacccaatagtctaacacggatacgatcttttggtttggaataagttcatcagaggtcccttaattttacgccgaatccgattttcgtcctcaaacccaaaaactacatacaactggtccctgaactattaaaaccggtgtaaatgaggtccctcgacgtttttgaaggttgttttagctgacgtggcgcctacatagctggtttgactaggtctacgtcctacgtggcattgacgtagcgcttacgtgacaattatatcatgaaaaaataataaaaaccatagccccacatgtcagctgcacacaaaaaaaattaaaaatagtggggcccacgtggccccacatgtcagcctcactcctcccttctctcttcttcatcctcactctctcttcttccctcttccccctatctctctctttctcttcttcccgagcagcggatgagcgggtgggcagcagagcaggcgagcgcggcgagcagtccaagctccggcggcggcggctcgacgtgcgccgcgtcggggctaagggagtcggcgacgggggaaggaggcaagcctcgaccggagagaggaggcctgcggtggggtggtgggcgcctgttgacagaaaacacgaggcctgggagatctgcttaactccagtgcaggtccaaagctcgccttcggatgtatgagcgtgccagttgatttgatcctgcaatcaacaagagatagaacaaagaaaccgcaattaatcctataaatgatagccgatcggctagatgccgatgacatatcatttatttcaagccgatgtcatgcgtacatcgatcggcaaatatcaataagcaattcagaactaaatctactcgatcaactgtagacattaatgatatataatccttatatcggtatatacttaaatcaagtgattgggatatatcggtcatcttgccgagacagtataaatcacttagatcgaaatatatattaatagtaggattatatacattaataacatagctgatcaggtagacctagcatgtatcggctaatactccgataccactctatactaagatattaaagcaagtagaatataccaaacataaccttaatatacttagatgcaataaaatcttaacataaagggcagatttaacgtgtcaatcaagcatatagaataaaagtagttaaatcaggtaagatcggctgaaactccgatactacccttatcggcaaccagaaagcaggctaaagattgcaattctaagcacgacttaatagatcaaactcaactgatgcagcattaagtatgaaaagaagaacaatatctagacaatcaagccgctggaagtttcatagagtggtagatatatcacataatctaagttaacgtcattgtctaacctaatcggctgccttccattagcagatgttagccgattataggttagataaagatattatcgaagactatgtgagatatatgataactcgacgaattatatatacaagattagagtgtcataaagatggaagcactaatcctgagaacataagtcgtcacgacaagttttacctcttgttgaagatcgaaaccgatgcagctcaacccgagagcacaaactcgttgaaataaaagtaaagcaaaaaagggtggcgatgcgccgagattgtattggatgtgttgtctcgtttttacatagggctcgggtctatttatacccgagaattacaagatacgtccataacggacacgactattatctctaacaaactctaagataccataagtctttacggcagacttttgtccaaacatatctctaaggaaattacatagaatatcctaattaataaatataattgccttcccaggactctatccaagcatggcaatcaccttgaagcacatcaacttgaacccgatgacgttcaccgggtcatattatcggaatcagctgtatcggctagccccgtgcaactcgaactctgccgatcctgaccttagccgatttagactgtagccgatttttactctgtctccgcaacgatcttcatcttggattccacttcgatctgatcttcatctccgatgccaatagtgatagaatttaccaaatttggtcgttaacacatgccccccatgtccgaaatattggataatgtttcagatttgccatataccgactctgagagaaactcgcacttgccgttttcccgaccattatcgctctgctttaaatactaaccgtcgccccagagaatctccacgccgtgatctccgttttcaccactcaagcagatcccgtcttctctctctccggcgacctcctcgacgcgcagggcgatttccaaacgattccactcccggccagatctccacccgcgacgatgacgacctccaccagtccgaccgccacatcatctgccgaatatgctgaggtaagtcctcatcggctagatcccttttccgttcatcagatcggttttcgctcgccttatcccgttttctccttctctattcttgtagcatctttccaatcttgttgcagttcccagtctgttgcatgaccaacaatactttctcggtccaatcggcaatctagaccctactgaatttatcatagccgaaaccaatagaactccttttaggtcggccaatccaaacacaagccattggaaaaacaccttcaaatcctggccttctctggagaaaagctggcctgtatggtataagcggatatcggctagcaagcaggcccattgggatgagatcggaatcagccaagccctagccctcacagtagcaaattcggccaaagatgaacccctgttggcggctgcaacttatttctggtccgacactctcaatgcctttcttttcaatcaagggccgatgaccccaacgctgctggatattatcatgctcactggcctagatgtaacctcatcggctaaccccatgagcctaaacaccaagaacacttttgagttcaaaactaagagcattgggggttggtcaggatatatcacagcatatatgggcaaagggccagtcactcctaaagaacacgtagcttttttgctgatgtggttggaaaaattccttttctgcggatcaagctgcggtcctacaaccaactggcggttcttagccgaggccctagtaacgaagaaacaatttcccttaggcaaaatccttctcggctatctataccagatgttaaacagcgcatcggccaaaataattatcggctcagtggttggaacaggtggatcatggtggctctttcaatcctggctgaacctggtagtcatgaaggttttcaatcggccatctgtgacagaagctgaatttccaaggttggagccgattgtagaagatgatggagaagaacgcacccatcgcagatgtatgtcatacggagagtatgcatctacaccagctgatgcaggagcaaaattatcggctgaacttctgaaggactggttcttcagcttttatgacggattccaaaaaaatgcccgagtttggttcttctatgccgactcaatggatttcgaactgccagccgatttcaggttcgaggatattaatcatgaaaagtttcagcaatccagagaaatctttactactgctatcagcccatgtatcctcccagtcggcatccatcaagggagaaatatccaagtctactacgagttttatcatccgatgtcattagccagacaacttggaatgggacaattgccaatcggcctgtactttgctgacaagatccaatgcagaagcgacatctcctcaactttaatgatggatcggctgttgaacatccccggacctccgttgggcagcatcgagaacataaagctggcaaggttcaggagtagggcttttgacagatggtggggtgaatggaaactgcacgtgttccaccaatcgacctccatgtatatgacggacctattccctgataccattcctcaggtaagtcttcactttatcactcttacttaaataaccaacagccgatttaaaccttaattaaccttttcttctgatctgcagacaacagaatcttctccacctcgccggagtaatagtggtaaagacattgaatatgccccaagcttgattcccaatggaggtgggccatctccttctgccatcggctacaatgcccgaaagacctcagcacttctccgaggactcatcagagaaccagccgatgccggcgagaagcggagaaccagatcatcggctgcagatccttcagccccggctccgaagaagaaggctaagacaaagaaagctaagccagctgacgatctacccaccctagatccatccatcgaacaagctctggatgaagaagaaattgaggaagacatcgaccaagctgcagccgaaataagcgatactgaaaaaacaccatcggcttcacctaagcaggctcctccattcccttctgctccagctcaattggcaagggtaagcaactttctctgtccacttttgcagtcatctactttatagccgattcctcacaattttaataaatatagagaaagaaaattgtcgtgaggaagaaatcggttactccaacccctaaaccagctccaccagtaagatacttctatcatctcattaactgacttgggctgattatatctaacatttatccctttggcagcctcctcctcctccttcttcccctcttatgcaggcagaatcaggcggccgcactccatcggctgcaggcagtcatcatgttgaagaggaggaacaattagctgcacctactattttagtaagttttattaacataaacttgagatcggccaatcatatcttgatccttaatcatccatgatattgtctcttgcaggtcttagccgatctgttctcctttgacatcaaagattacctcgatgaaacagaagaagacaccaccagtaaagcaacagctctcctgtctgatgatgtgaagaaaacactcgaagacatctcccatcggctaggagaatcactagataacctggtgaccaactgtggctcgatccgggcaaggtttgcagatatccaagcctctcttccggacgaattagtcgatgctcttactccagctgcctacctcgagcagcatcaattcaaactggagaaagccaggcagaggttagccaatcgccgggaacgcaaggacatcgaggctaaaatccaaaccaatcgacagcttgttcatgaagagaaagccaagcttgatcagttatctgaaggcccaatcaaatccaatattgatcggcttgaagctcgcaagattgaactcttggcacaacttcaagaatgcaatgctgaactggatctagagcataggaagttagccgatctcccgcaagctatcgaagaacagaaggcaaggctaaaatcggctatcaagaacattgctgagatgactaaatccttgaaagtcattcctggaaccgatgctcaagacgcccaagctatcgaagaaataaatcagattaggcaaagggctatatcggctatccagcgatacttgtctcagtgatttccatataatagtctgtaggaaattgttgtaatcggctaagacaccctaattactttgctgtttaacacatccaattttctcaaaattttgcaattttctatgtatgtgcccccctaattttacaatgttgaaaacattgacaaaattatagaaacgactaagggcgatataacaatatcggccattcgtacatgggcaaaccacaaccgattacaatagtgaaaagcaactaagggcgatataacaatatcggccatcccaaggcgatgcaaacacatcggctatcatgcatcgacaacactagccgatcatgcattaacccaaacactgggataaaacttcttcaagtatttgccatttagagctcggccataaacttctccatctagtccttgcaacatgtatgctcccttagacaccaccttatgaatttggaacagtccttcccaattcggcgaccacttgccgaatttgctatcccgagtcccaatcggcagaatcaacttccatacaagttcaccttccgaaaagtccttaggtactactttcttattataatgccgggcaactcgctccttatccctagtaacctttgcaagggctcgtagccgtgattgaaccagatcttccctttcatcggccataaggttatagtactcatcggctgttaaagtattttgcaactctgttctcctcgagctaatccgaacttcccacggtaaaacagcctcatgaccataaacaagttcataaggaggaacctgtatcgatccatgacaagccatctgataagaccacaatgcttcagccagtcgagtatgccattgccgaggataatcagaaatcttccttctaatcaacttgatcaaactcttattagatgcctcggcctgcccattagcttgtgcataatacggtgaagaattcaacattttaattcccatactatcgacaaactgaacaaactcatcggatacgaaaattgaaccttgatcagtcgtaatagtttgagggataccaaatcgatagattatatgctcttgaacgaactgtatagcatccccagaatcaactttctttaaaagaatagcctctacccacttggtaaaataatcggttgctaccaatataaacttatgtcctttactcgagggttgccgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccttttccccccttcctctcttgggccggctcggcccaactccctccctctctctcctctcccccgcggcccatcggcctcctccccgcgcccgcgccgctgacgggcgggcccgcccgccaccctcgctgacgggtggggcccacccgtcatcccctacctcgcgccgcgcccgccgcctcgcccgtgccctagcgccgccgccgccgcggattccgccgcatcccgccgtccccgcgcgcaataaagagggggaaatcactccccgtgattccctccctctttcccccctcttttccctctctcttccctcggattcgtttggaatccctcccgaaatcttcgccggcgcaccaatcggg

SEQ ID NO: 60821 - DNA, 630 bp, Oryza sativa
ctgcagcccacgaaggaagagaaggcaatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccagggcgaagtggggcgccgcgagggaatactctgaggcagatgcttcggggccgcacacttccccttcgccttgaccagcggcgaaatagctggctcgcgcacagggctcccgaaaaccctcgccacagccgacacgatccgttcggcggaggcggaagccccggcggcggcgctacgcctgccccagcaacgctgagcggagcaaggggagcagtcgaaaaggtccaaactgcggccagcaggtgaagtcggagtctcgtcagaagactcgtcgttgctaaaaacgcgagcgatgtcgacgagtcccttcttttttgagatcttcttgaccagacctcctttcgccgccttgcccgacgagaacgcaactaaggccttcgccccttccaaatcctttcgtcgaaggggggagctgttcgactccaccccggtctcgttgtgacctggacttggg

SEQ ID NO: 60822 - DNA, 3115 bp, Oryza sativa
caagatttttgatgataacctttggcctgcggcatatgcatggagcccatacttctatgagaaacatatggcagccatacaagaagttaaaccagaagcagtagcataccttaagaagtatcacaaaaggctatggagtaggagtcagttctctacaattagcaaggttgattatgtgacaaataaccttgcagaaagcttcaacaatttggtgaaagattggaaagcactacatttatatgacttcttggagaggattcggtggtggttgttggtgaaatgggataagaggcaaagaataggtcagaaatttgaaggctgcattctacctcatattgtcaaggaattgaatgaaaaaagtagagatttaaacatggtggtcacaaggaatggagactttgaggcagaaattgaggtcaagggaggtagtgggtttagacatgttgtgaatttggagcacaaaacatgtacatgtagggaattccaaatctcagggaagccttgtatccatgctatagcattcatcacatcaattagaggaaggctttgcagattatgtggatgattgctttagtgtgcatcgattcagggcagcatatgagaaattgatcccttcattacctgacaaggcacaatggccaaaagctgatcatgggtttttcttggcaccacccattctgaagaaatcagctgggagaccaagaactatgaggtacaaaggatgcactgagaaaggaagcaaaaggagtaggaggcacaaatgccccatttgcaagagttatggccatcattggcacaattgcaaagagggtgatccagaggaagtagcagcaatgattgctgaaaggtacatatcattgcaagtcttttattcattgtagttggtggttacaatttaagcaactgtgtaagttgataaatatatgtcatgacattccatccttgtagtactagacattataattaatggataatattagaaagtcatgtggtggttcgatctaattacctaaacacttgtatatatatgtctcacaaatttccattctatttctaacaagccttatgacatatattttctcttgttcatagagggccaccaaagaagagaacgaagaaaactaatgaagcaacctcggagactagtatcatggctgctccaatagttacaccaataatggcataccctcctaggttagcaaatcttctttatttcattctacattggatttagatcaattagctacataatagtttatttttcacagtcaaaactttaatttcaccgaggacaatatagcatggaacaatagctcgggttcaagtatatcaattaggtaagtaattagatcaattatgtcaatttgctggtattatgttgttctatgcaatatatttcacaattctccttttcagatcaacatcacttactggctccaaccaacttgagcaatctaacatgattgtagccttgccatgtctgggggaggaaacacctacagttgcaccaaaaatgaccaagagcaagacaaagggaaagccatcatgttctagtactcctggtagcccagctatgagcacaaggagcaaaaataagagtcctgcaatgggcactaggagcaaaagaaaacttatggattgaatcatatggcttgctaattaggttttattttggtactgtccatttcttttgtggaggctgatggattttgttgttgtgatgccgtacaaagtggtctagtcatagttgacatattttgctattgtaaggattgcttcctcatgatgtattgatgcactgttatggaccttatgccattatgctcatgatatactgcctagctaatttggtttgttggttgcactattttgtttgaaatggaaagttggtttggttcctgcactattgagtatggaaatggaattgtgggtgcacatgatatgaactgttatgtatggatgatggaaagattatgttctgtgcatgatattgtgtgttctgtatggatatctctattgttatgtatgatggtattcatgctcttattttaccataatcaatttcttatgcagaggaaccaatttcttctatagagaaaactgataactgtacagacagtcagcttttcctgatcctattatttttccaaacaaaaagttcattatattgtatttttttcagtgccacaataaatttgttatacgctcattatttagtctcataaaatacacatattgttcagttgacatttttttcaattttttctatctagctgccactcctccatctacaagggtattttagacatttggaaccacacataacgtgaaaatgaaggaaacctaacgggaggggcatggaagggatcaaagtgaaatttcaggggtacacaggggattgggtaaaattcgagggtatagaagggattatgtgagttttcatgggcatacaagggattttctctctaaaatatagcaacatactattggattagacacaatctaaacacctaataccggattagacacaacctagctactaggttatgtctaatgttatattttgtgatgaagaaaatgtttcaatagaattaaatattttcttatttttgatatattaaattgaaaataataatcaaatatatgtttcggagaccatgagtcattgtctaaaacatcgtgaattatgaaaccggcgtgagaaaccactttcactgattgatgatgaagttcacaaagtaacctgcaaaagaacaaaattaaatatagaacagttgtgcacatagatactctagaaagggctatatcatatcatattttctttcacgtgatgtatgctttatggatcgatagccaattgattctttggtgcaagttttgatgccaagcgtgaaacgtgatgattcgttttatgtcaacatgtttagcttgtagtaattaataggggtgtatgtcaacgagtcttttacttttacatacaagagatgcatgctcatgagtcatgacacaggatcaaaactgatgacatctgagatagtgagagcgattatatatataccaagctgctatatattcaaacgtacacaacttggaatatatcttggacaaagagcat

SEQ ID NO: 60823 - DNA, 663 bp, Oryza sativa
aacgagaaccatgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaaccggaacagtggaatctaaagctcggttcaaccttgggctttgtatcagatgctactagaataaaagcacttgcactagtatcgttcaacgcactttcctagcaatcgatccatcgagaaagaacacatcaaggctgaaggtgtaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaagccatttgggaagacgtcaaagtatgtcaagtgggataagttggttctcttgggaagcataattcaaaggcaaagttatcgacccttgcatcaaatagcagaagtagct

SEQ ID NO: 60824 - DNA, 815 bp, Oryza sativa
actccttctttggcaaccccatctcaagtggatttcagccaacctagcagcagcactcttccttctcatgtcattgtgccatcagacacatacttagtaaacccattttctatggctgaacatgttggtgttgatgaggaaggcatatacttagatgaggaggaggctgttgttggtcatgctgatgaaactagaggtgaaggggctgtcaatgaagtatccgaggatgaatcttgggctacatctgaggatgaatctgaggatgcatctgaggatgatggtgtcaatgaatccgaggatgagtcaatggcatcagatgggatgcctgaacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatatactgcaagttgtgctgctaaaggctgcaaatggaggattcatgcatccgtggttgctgatggtgtcactatgatggtatgtttttaatttaaatcagcatgcattctttaagtatattgccatatatatatatatatatatatatatatatatatatattattgtggtattgactgtatttacatttcaggtgaaaactaatgttgtgccacatgaatgctcaagtactagaagaagtgagactatcaaggctgcaagcaagttttggatttgtgagaaggtaaaagattggttgttggaggatgctagtgtgggagcaaaggaattgcaaa

SEQ ID NO: 60825 - DNA, 2921 bp, Oryza sativa
tatacggcgaattcgagctcggtacccggtaatttgcagtgtacagtagggagttactactgtgctgtgctctctgcctgcaatgcccattgttgcacaagcactgcagcgcacgtctctctcgtgccagtgccaatgccatgcttacaacagtctgctctgtcttgggttcagttgatgactcgatcaacaagcagaagctggaaagagaagagaaaattggaaaaataaaaaaagaaacaagaacagctactgcagactttacagtttcgccattgctgagctgacgatcccttcctgggctgggttcacatacacaagagcaagaagctgacacgcacacatcgcatctcatggccatcgggcgtcgcctgttgagccatcgccaattcgccatcgcatccggatgcgatgggcggcagtggcacagtgtgggctcgcgacagccatggacgacgaccaccacagcggcggcgaggtctctctcgagggtttggatcgctattaatgatgattgtgatcctgatttttcggatcgctgttaatatgctagccatggtaaagatcgtctcccaagctacagcgtcagataaaatcatttcagcatttctgactgaagtgaacgatggccccgccggacgacctgtttgttgctaccactccgcgatgacaagaccaaatgcctcagaaattggtctgcatactttgatctgaagctgtctatttgacggacgggcttaacaaatgagctctacaatcagttgcagggacagcaccaactgcagactgaaactcgcctcattttttacagttttcagtcaacaatgctcgtggtctgatttttaatgacattggtcctcagaagtttatagtatagccagctgctggctccaaatcatatatagtcaacttagtagactattcatacaataattacctataaatatatactacactattaaattctgtggtcccaccaatcatacacacatgtatcttggagtccgtactgcagctggctacaaatctgtagcccgctgctcttctcactctccttttatcttctcactgctggcctgaatgctggaagggtacattgcctgatcaagcttaatcctatttgcagacggggatgattggaggatggaattcggctttcttgtttctgctgtctgtctgtatgttagttggtagcaatattaaatgggggaaatgatgagcagaattcagaggagttgggtgaaggtattcattttggtagtaaaccttgcctactcctgcctcactcgccggagaccagtacggagtactgcttactgtacactgcagtctctcctgccatgccttcccgtactctgttatccgctgatctggcaacctgacatacattcatgctagtatttcacagtaactatgcaagcgtaaaaatggaagttacattggatacaactgttagctgatcagcactcagcagtagcaggaaaagtacgtacagtgcctgtggaattcgctaacaatactgcgtaaggtgaaggtttgcagtcacacatgcatttttgacgattctgaccaaattcacacttcatcagaagtggagcactcaagctaacccatgcgtgtacatgcacccatggttcactgatgacagccatgaggataaatgtggcatgcgttaaaactgaaaactggaatataagtgaaggaaacaggagagtacaaactcacttttgctagtaattgggcttgaccttttgtgccatatccaggcccgctatggccttcacatacttgcgcaatcttacacttggagtatgtctatttcacctcccttgtgctcttgccctcggtcaaatcgcatccctcaaccgtaaaaccgggtatcgtttttgagggtggtttttttgacgtggtagcctagtcattgaaaaaaaataaaaaaaaatatatacattgggtctacatgttggtgactaattttattcttccttctctaccactcccttctctcctctccaccctctctccacgggcgaggttgatgatctacacgatgaattcatatggtcctcctaaacaactccattgtgtggtacccaaaagccgtcaagctttgcttccacggtcacaccgtctttctcaagtgcttccaccactggtcacgtggcaggtccttccacgacatgaagcctaatctcaccgagtgtcgcatgtggagttcggagatggcggtggccacaataatggaggtgggcttaatagatgcctcgtgtgtggaggaggcagcgtatcaaagttatataggccttataatccaatcaagtttaagaagagtaatgtaatgtaagatacaaatggatcaacgaataatgtttgataagaacaaggatctatttgattgggcttaaccttgggcttcactttttccgaagacacgaattaagtttgataaggataaggttgtgtttgattggactccaacttcacttttttttctaaggctaaagtctaaaataaaaatgggttagagtgatcctaaaaaagaactagagagacggtgtggatgctccataattctgctccaaactccactttcagtagttatatttagaagtaaaagcccttctaaacatgtactaaatacactgagtaagagcacaaggtatgaagatgcacaaggatgagcaacttagttggtagcacaaggtgcattctttcaccaaagaaaagtcttgttcatccccataaatttcagttggtgatgtatttgcaaattggaattctctatgcaacctcgcaagaatggacaacatcacgggcctgttcattttgatgccattttcaaccttaccaaattttggtaaagttgccaaaaaaaaagtggctatatttagtttgctgccaaattttggtaactatataag

SEQ ID NO: 60826 - DNA, 3636 bp, Oryza sativa
atctggattccaattggaatgggcccttttgctttgcccccaaatgattgactgcctcaagagaattttactcctgtagtgaccactactgcaattgtttttagcccattggagattcaaatgctcctatataagcacccattttctctgacctgcaatgttagtagtgttcctgaaatggataatcgaaatggacatgcacaattcaagttgatcgaattggataccaacaaaataacaacaaatgaagttttgttcaaagttagttgctattcatgcggcggatgaagcattggatcaaggtgtagagacaggattttatcagaaacagtagaaatgagattgggctatgaccattcacaatgtggtaaaaccaagatgtttccagtttccaacgatatcttcttcacctaccctggtcataagaaagaccatacaacactccaagcaagcaaggaaaagtaaaatactggaatttgttttgtagttgtcttttatgccacttataccatatcaggatccagccttgacacaatttgtaactttattccttgagttatggacactacatccaccaaagcttaaagcttatcttaatgcaatttacgtcatcatttcgtgtatcatttctctcgatgattcctttttctcttttgttcatttctgacagggggacatggggagtttttccttttcactgtatagaagtgataattctgcctaattgcctgatcaatttttagaactcggtgacacttgtgctattaaactgaagcctttttttttgacaatttttaggtggttgagcttgttagaagagctgttccgcttgcactctcaccggagaacgattcaagaaaagaagagctgaagaagctccaggagaagaaggaagagatcgacaagctggcgcacaagcaagtccggcgcatcctgtggtctggactaggtttcttcatgtgccaagttgggctcttcttccgccttactttctgggaattttcatgggatgtgatggagccaattgccttcttcacaactgcatctggcctgctcgttggttacgcatatttcctcattacctcaagggatccaacatatgaggacttcatggaaaggttgtatttgtcaagacacagaaagctttgtgccaagaatagttttaatatggcaaagtccctcgagttgcagaagcattgcaagtgtcctctggaaggtcattattcccatagttctaagtttcatgacttgtaacaccaggattggattgtctctactgttgttacttgataatgtactctttacttgtagaattgatagaaaaaaacacatgatcaagtcattgaaggggcatttataaaaaaaaacaacatcaacctaacaaaagcttgcatacttactgtagataaatggaaacgatttatattcacagaaatcagaaaccacttacagatttagcttgatccttactggagataaatgtgagctttcagatttaggcgttcttatctaccgtatgaaatttttacacaagatgtgttattagagcaatccaaaagccacaatgccctgcttatagtgaaaggggacaaggcacaagcagtgttgccatctgagtgcttaaattccttgcaaacaaaaacatattggaatatgcaggacataaagatgccattttgatgccaaagagcaaaacaaacatcgtttttctgcctataaagatgtcaacgcaccgaaaaatagccaggcttgccattggtaaagaattggatgaataaaatgacaacttgcaaggaactgcacctttgcaaacccaaacgtgcagttgaacaggtgaagtattcaacataacaccctggtaactggtaaactgcagcctacttcaaaggtgtcgtatggtgaccagctcacatgttctatacaaaaaattaacgcaaatgcttacagtttggtataataattaagaccataccccaacaatttctttcacttcatccggtggcttgcatttataatcgtagtttcttttgatacattccttacacattatatttgtgattttttatatgattcatacacatttatacaatgcaaattaggtcgattgatattggggcaatgatattttatttgaatctagaggtaatcaagtacctcaaaaaggtcgccaatttaaacatagttaaagggcacatctaaataacaaccatatcatataaataagagtagcattacatgcatatagacagcacacttcggtttactgtgtgggtaacctagataggtaagaccgatgtacactgattgcatgaagcattcactaaccatatagctaacagtagacgatgagatcgtaaaggcttgaacattcatggatatccttctagaactttaagaagggatggatacatgcatattacaaataagggtatcagtttctctaaatatggcttggaattaaattgcattattctgtcttcgttattaaatatgatgatcaccccttgcacaagttcaagaattaattatatcctgtatgcgagcataggcgtccatttgtacttgccgacattccgggctgcagaaagcgctctctcccctgttacaacatcttataattaaaaaagagaggcataaaaggatgtgaagttttcaatccacctcatcattgtacaatagtatattacaattgttcaacaataatttaattctttttctaaaaaaagaattcgcacgtgcatgtcaaacaaataaaaatcttccctatctataaaaacaaaatacactagtaccaaccacggatgaaaagttatataaattgatttcacctaaataagtaaaagtgatcataattagtagcatgtgtacaagttaattatgtatggagattagaaaattaattaactaaaccgtgcatgtatacaaagctattatcatttatcaaagaaaaagaagggttatcaattgtcatcaacaaattaattaatcagctaggttaggtacctgaagatgtagacgttcatctgtggactaagtgtgcggttgcaggtagcgcaaaacctcataaaattttgaggacgcagcgtagggggctgtgaactgatgggaacgccaacattatcatcaacacctcgtcgtgtttgatattcatctgccacgcccacgccccggtttctgctgcttggctggcctctcctcgtcctcacctgctcactactcatgtactccggctgctgctggccgccgacgggcaccagcggcggcggcggagcggcgtcgtcgtcggtgttcctctgacaagacaagctgtcgcccatatctcggccggctgacactgtagctatagctgaaggagaaatgtatgtactagctagctaggaataatggagctaatgatcgagccaatcagcgcgcgtttgaatatataatgatacagagtgatgcacatgcatgcaatcaaggaattaacttaggaaatatagcatgtatccatgcatgtatgcgtaaacgagggatttgatatatgtcgctccaaataattaaaaggctttcttaatttacaccagtgagattaggatcccgtatatattgtagtaatccggaaattaagagcgaatttctcgtgtttcatgtacg

SEQ ID NO: 60827 - DNA, 12075 bp, Oryza sativa
cccaaagtctttccctcatccctcctttttccccttctctctcgggcctcctctcccctcggcccagctccctccccctcccttcctttctcaggccgcccctccctcctctccttcccggcccactcccttcctctcccctcccacctgggccgtgtcccggcccagccgagcctccccaggccgcgccgcacgcgcccgtaacgcgcgcgcccacgcgcgctgaccacgcgccccgcgtgggtcccaccgcccggtcgtcgtcctcctcccgcccagcttctctctctctctcccgtgaaccctagtttcttcctccctcaaatccacgcgaatcaatgccattctttccaaattgattggggggaattaatccccattccttcctttttgatttcccccgttttcccccttgaatggcgcccccaatcgtcgggaacggccgcgcctttcccggccaccttccatggccgccggccgccttttccgccgccgttcccaccactcccgtgcccggctccctctcctcccctataaaatggaaccccctccatgcgttctctcgttttggccccttcccgagctcccccgtggccgcatcacctctccccgccttctccttctctctctccggcgccggccagcatccagccgcctttcctcctcgcccgagcaccatccggtcgcgccgtcgccgcctcggcctcgcagccgcctcctctcccccggtcagccctccgtttcgcggggaaatcaccggagacgtgtcctcgccggcaaaacagtggcgttgccgccactgtactgcctccagccacctctgccgcgtcccctgtgcgccggccgacgtcgccaccacctctcccggcaccggaacgccatcctcttccccggccaagccacggcgtcgcccgtatttcgccggaacgccgtcgcccgcgccgtctctccctcggcctcgtcggcacccactccggccgccccttccgccgtgccagtgcgccggccgacgtcgccatctccacctccggcctcgcagcggcaaggttgccctcggcctcgcctccccttcgaccgaaccccgccggtgttcgtcgtcgtcgtcatcgttcctcctcgccggctcgtcgtctcgcggcgccgcctccgtcgtcggcatcgcagcggcgtgttccacgccgtcctcgtctccgtgcagccattgccggctgccctcgttgcctcctcgccggccccggtcgtcatcgttgtcgtcctctcgtcgttcccggtcgtcgtggcattcgtccctccgtcaagccgttctcgtccgtcgtccgcgtctgtcaagtgtgccgctgcagccccgtcgtcgtcttcgtcctcgcctccgcgtcgtcaagccctgcgccggccgtgtctcgccttcgtccaaggatcgccgccgaagtcgtcccctcgccgttcgtctccgtcgttcccgaccgcctccgccgcgcccgttcgtcgttgtcgttcccacgcctcgtcgcgtggtggtaaggatccctctccctcgctgccccgtcctcgtcctttcggtgtcgcctgtgcctgttgtgcggttgtcggccccggtacccgtgtatcggtgtcggtagtcgttcgcttgtgcgtgtggtgaccgtgttagtgtgcccgctcggtagccgcgtggtttccacgtgagcagcccgggtggtgtctagtggagtccgtttgtcggccactcgcctcggttgacacacgggatccgcttccgtcgacccgtggaccgtctctgtgtactcggtccaccgtggtcccttaggttgacatgtggggtccgcatgtcaacagtgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggatctcgaagcgtggtttgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgtttattattaccttgttcaccctaggaaaataaaaccccaactagtgggtactctattcatggttccactagtatgaatttaggtagatgcttcgctgaataattaggcaacattaggtggttttataactttagactttggggatgctcatatcatttggacactgtggaatggttggcttgtgatggaattgaacacacacctccccccccctctattcaaaactcccaaaatggttttaggctgggctcgaggtacagggttttgctagtagcacctcggccactgtaaggaccggtcttcgggcctctgttgcaaagcactaccgtactaaccacatgtctaatgggtaaggcttaactcggtgctcagtttagtcctgaacaaaaggacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacacgggtggtctcacccctttgtgtgtggcgcacccggtctagatcttgttgcttggggctcaatcctggcctgcctgtcccgggataccggccgtaggcagggttgggtcggtacttctgttcacggctaggatgggtgaagggttatgtcatatgtttacgacgggttccaaggccatggaatgcggagtaaggatgtgtcttgtgggtaaagatgtacacctctgatcagagtaaatctattcgaatagccgagccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttacggcaaaacctaacccctattattatccccttgtacccccttgcattaatcatgcatcttccggtgtggcttgctgagtactgtggttgtactcattcttgctctatctttcccccccccagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagagttcgggaaaaggcaattttctcggtcgcgacaccgcctcccgccggccgcgccgccgtggccgccttcgggcgcaccgagcggctgccgcgtggggcccggccgtcagccgcccgcgccctcgggtgcggctgacgcgtggggcccacggcgccggtcggtgtgagccgcgtgcacccggtccaccgtggaccatgaggctgccgcgtgggccccactcccatggacccggtccgcgcgcccctcccctcggctgacgcaataaattcaattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttcctacttgttatatggagtttattagagtaaaagccttttcttttccgttggtcgtgtagacactgcagcttcggaggatccgctcttcgtggaagttgaagccggcgtttaggaaagcgagcaaggcaagtcacatcattctttgaacatattggatcccattttgtgaaattactttgatttaaattattgcattatcgctttatttaaattcccgcgttatcactgttttatttagccgtgcctatttacctttgttatgaccttattattgttattgttattatttctttgttcaccctagaataaacaaaaccccaactagtggacactctacctgtggtatcactagtatgattttaggtagatgcttcgctgattaattaggcaacattaggtggttttataactctagactgtggtaatattcatatcacttggatactatggaattgttggattgttgcggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggacgaagtcgggggttcgatggacatctctaggacaaatgaaggctactcgagctgcggcccggtagtcgagatgtcatggcacagggcgggtgtcctgctgctaggggctcagtcctgcctacctgtcccaagggttccggccgtaggtggggttgggtcggtactcttgtctatggctaggatgggttggaaactatgtcacgtcttccgttcgtataccgtggtggtatatggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggctcgtgtgggttcacggccttgattaataatattgtatagctctaggatcgtgttcacaaaatagctttgagcaactaagtgtcttttaatgctatttactgcaactcctaacccctatactataactccgttgtactcctttacatttatgctgcacttgtgggtgtgtcttgttgagtacggtggttgtactcagtcttgctcaattttttcccaaacccagaagaggagcccctcgaagatgaaggctttggtgtctagctcgtgcctgccgtcaagcgcctgtggtcgtcgccatagtcttccgctgtttttcgttgtcttcgtgtgtgctgggccttcgttgcccatgtaataattaactatttacgcttccgcttgttaaactctgagttgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagtgatattttcgaaataaaaatcctttcttacttgtgaaaatcctctagtctttctctgtcctgctgcttcatttatcgccaaaatctaatcttgaaaatgttgcttttctattttgtttttgtttgtagatggccggcagcatcaaccgtcgtggtctggacttgactggcttcgttttggagctgcggggcatgtgcgttgtcttggggtatccacatggagtggactaccagggcaagccgctcccggagcaggagggtgacgatgcagagccccacgctgcttgggaggtcactgcagtgatcctctctggctcacccgagaggacttcgttggcagtcaccgcgggtggagattccttctccgccgcttgccagaatgccgcactcctcgccatcggcactcttcagcagcgctacccggacgagttgcagcactcgccctaccgctaccaccctcgccgcggaggagcccgcgactacgccaccttcggggatgctagctcggaggatgacgctaccatcatgcacctggcgcgcatggtggaggcgtacgacgcggcccgtatcgacttccaccagatggtgcgccgtgggatggtcgagaacaacatgaagatcctggagctgcgtcaggagaatctgcagctgaaaaaggatctggacgcgctggaggcgcagctctgtcagctcaggatcgcccagggagaggtctgccgtcccaagcgccgccgcgtctgccgtagccagaagatcaccgcccgcaagagtacctccaggcccgagcttattcgtcagtccctagcgtggacctgcttcgtggagacccctcgtgccgagcccgtgctcgtggttcctcaggagggggaagcctccggcgttggcagcacggaggatgcgctgctgctcaccttccgccctggcccgtcgcagaagtagacgagcagttagtaggcttgcgcgtgtgttctttctcgtttgtcttcctgttggagtcgttcggggcatggttatgccggtgtgtggtataactatgtcggagcctgtctttattttatttgtttaagcaacttgaaccttaatgaaccaatttaatagcagtattaaattcaagaattatggtagtcgtgggtggttagttttaattgtcagctctctctgtttgctggttccgtgtggggttttcagatggtgacaaccaggagaaccgctgctaccggtgaaggcagccaacccgaaggcagcaacctcaacgaccatggcagcccacctccacctcctcctccgcctccaccaccaccaccagacaccaacgccatcctcacccaaatcctcgtccagcaagccaacatgatggctgctttcctctaccacatccaaaatccaccacagcataatgctccacctccaccaccacccccacaacactctaagctcgccgagttcctccgcatccgcccacctaccttctctagcaccaacaaccccgtggatgcgttggattggttgcacgccgtggggaagaagttagacactgtgcagtgcaatgatgaggagaaagtcatctttgccacccaccagctgcaggggcccgcatctctatggtgggaccacttccaggctacgcagcccgaggggcagcctatcacctgggcccgcttcaccgccgctttccagagaacccatgtgcccgccggagtcatggctcttaagaagagggaattccgggaattgaagcaaggcaaccgctccgtgatggagtatttgcatgagtttaacaacctggcccggtacgccccggaggatgttcgggaagatgaggagaagcaagagaagttcttggtgggaatggaccctgagctgtccgtacgtctggtctccggggactatccggatttccaacgcctggtggacaagagcatccgcttggaagccaagcacaaggaactggagtcgcacaagcgtcacttggcgaatttccgcaaccaacagagggctaaccaaagggtccgctacaccaacccctatccagggggatcgtcctcgcagcagcaacagcagcagcaacctcgctccgcgccccgacctcaattcgtggtgcgcgtcccacagccgcagcaacagcagagtcagcaagggactcgtgcgccccgtcctcctacgccagccgtgtagcctggtcaaggccgcagggacgttcaaggtcagcagcgtctgtgcttcaactgcttcgagcctgggcactttgcggataaatgcccaaagccgaggcgccagcaaggccaagcgccgccccgctccaacaacggtagtaaggacgtcattcggggtcgtgtgaaccacgtgactgccgaggatgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctatgctcatcaccacccctggaggggttatgacagcgaagttttatagccctgccgttcctatagaaattcagggaattccgtttccctcggatctgattcttctagacaccaagaacttggatgtgatccttgggatgaattggttggctcaattccaaggagtagtggattgtgcaagacgcactgtcactctgtaccgagggccggaacaaccggttgttttctttgcaccctcaatcactgtcggcaattcagaacttcatcagataggactgtcgggaacccctatcgtcagtgagttcggagatgtgtttccggaagaactacccggtatgccgcccaagcgagagattgagttccggatagatcttgctccaggaacaactcctctgtacaaacgacactaccgtatggcagcaaatgaactggtcgaagtcaagaaacagttggaagagttaaaagagaaggggtacatacggccgagcacttccccctggggtgctcccgtaatttttgtggagaataaagacaagacaaagaggatgtgtgttgactaccgagctctcaatgaagttactatcaaaaacaagtaccctcttcctcggatcgatgatctgtttgaccagcttaaaggtgccgcggtattctccaagattgatcttcgttccggttatcactagttgcgcatccgtgaagaagatatcccgaagactgcattcaccacgcgatacggactgtatgaattcacggtgatgtcgttcggtcttacgaatgctcctgctttcttcatgaacttaatgaacaaagtgttcatggaatacttggataagtttgttgtggtcttcatctacgacattctggtgtactcacaatcaaaggaagaccatcagcaccatctccgtccggtgttgggaaagttgcgggaacatcaattgtatgccaagcttagcaagtgtgagttctggttgtccgaagtcaaattcttagggcacgtgatatctgctaaaggagttgctgtggaccccgaaacagtgaccgctgtcactgattggaagcaacccaagacagttactcaggttcgcagctttctgggtttggcaggatactaccggaggttcatcgagaacttctccaaaatcgctcgacccatgacacagttgttgaagaaggaagaaaaatttgtatggagtccgcagtgtgagaaagcgttccagacgctcaaggaaaagctggtttcctcgccagttttaaccttaccggatactcgcaaagacttcatggtgtactgtgacgcttcgcgccaaggattggggtgcgtgctcatgcaggaaggtcatgtggtagcctatgcctcacgccagttacggccccatgaaggcaactaccctacccatgatttggagttagccgctgtagttcatgctctaaagatctggcgacactatctcattgggaatcgctgcgaaatatataccgatcataaaagtttgaaatacatcttcacccagtcggatctgaatctttggcagagaagatggttagaactcatcaaggattatgatgtgggaattcactatcatcctggtaaggccaatgtggttgccgacgctctaagtcgaaaaagccattgcaacactcttggcgtccgtggcattccaccggaacttaatcaacagatggaagccctgaacctaagcatagttggtcgtggattcttggctacgctggaagccaagcctaccttgctcgatcaaatccgcgaggctcagaagaatgatccggatatgcgtggactcctcaagaatatgaaacagggtaaagccgctggtttcacagaagatgaacacggaaccctatggaacggaaatcgggtatgcgttcccaacgatagagaacttaaacagttgatacttcaggaagctcacgaaagtccttattccatccaccctagcagtacgaagatgtacctggacttgaaagagaaatactgataggttagtatgaagcgggagattgcagagttcgtagccctttgtgatgtgtgccagcgtgtcaaggcagagcaccaacgaccggccggacttctccaacctctccaagtaccagaatggaaatgggatgaaattgggatggatttcatcactggacttccaaaaacccaaggcggatatgattctatatgggtagttgtggaccgactaaccaaggtagctcggtttattcctgtgaagaccacctatggagggaacaaactagctgaactctatttcgccaggatcgtaagtctgcatggcgtctccaagaaaattgtatctgatcggggaagccagttcacctctcacttctggaagaagctccaataagagttgggtacccgattaaatttcagcaccgcgtatcacccgcaagcagatggtcaaaccgagcgtctaaatcagatcctagaagatatgcttcgcgcatgtgtcctagatttcgggaagacctgggataagagtctcccctatgccgagttttcctacaataacagctaccaagccagcatacaaatggcaccctatgaagcgttgtatggacgcaaatgtcggacaccgctattgtgggaccaagttggggaaagccaagtgttcgggacagatatcctgagagaagctgaagctaaagtcagaaccattcgggataatcttaaggtggcacagtctcggcagaagagttatgcagataaccgacgccgtaacctggaattcgcagtggacgattttgtgtaccttcgggtcacgccattgcgaggtgtacacaggtttcagacgaaagggaagcttgcacctcggtatgtgggtcctttccgtatcattgctcgacgcggggaagtcgcttaccaattggagctgcccgcctccttgggcaacgtgcatgatgtgttccatgtgtcacaactcaagaaatgtcttcgagtgccatccgagcaggccgattcagagcaaattgaagtccgcgaagacttgacctacgtagaaagaccagtgaaaatcctggacaccatggagcgcaggaccaggaatcgggtaatccgtttttgcaaggtccaatggagcaaccacaccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctctaaattatgcctagaataattaaaatccatgtgaaagccttcaaaaattaaaatgtgcaaagttaaaagtcaaatagggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagttccctttccctccccctctccctcttgggccggcccggcccagctccctccccctctctctcctctccccgcggcccatccggcctctccccgcgcgcgcgccgctgacgggcgggcccgcccgccaccctcgctgacgggtggggcccacccgtcatccccttcctcccgccgttcccgccggcccgcccgcgccaag

SEQ ID NO: 60828 - DNA, 9142 bp, Oryza sativa
aaccatttttaatggattctacacaatttccttgatttactgagacttgaatgggattaaacggagctcggatgaattagttatgaattttagaagattcactgtgtttattactataacaaaaatccttaaataatttattgcgcaataaattccagggctgacgtcagcacgggggtgcggcgccgacatgcggggcccaccggtcagcggcccgggagagagagaaaggggtggcggcgcgcgggcccactgtcagcggcacgggaggtggaaggggcggcggcgccacgtggcggccgaaccgacggccccgatctacccaagggtagatcggacggcggcgggagctcgcggtcggggcgcgcgggcgcggcgcaagccgaaccggcgaccatggcgccggcggcgcggcgctcacgcggcggcagcgcgcatgcggcagcggcgcaaggcgacggccgacggcgaccgaccggcggcggagagcggcggctagaggaggagcggcggctacacagctaggcggcggtgcggcggttaaacggtgcgggagagagagagaaaacgaggaggagggtctcaccgacaacggtcgacgacggcgggcgtcggaggacgatgacgacggcgggacgagctccggagcctcctaacgaacaaaaggagaggggttagagagggagggaagggcgcgagagggcgagggcgccggccgaaggcggcggccatggcgtcactcaccggcgcacgacggggttgggtctccggcggcgaacctcagcggaggaggggtggacgaggtagatctcgaccgcgcgaagctaacggcgacgacggcgcaaggcggcggcgagcctagcggcggctagcggcggccgaagtagcaaaaacggcggcggcgggtggttgcacggcgcgggagcgatggggagctcgggagaggtcggcgcaatggggaaaaagtgagagggagtgccggcgatgcttaaatagggggagagagggccggacgtggccgggagcggcgggaatcgccggccgacgcgggggagtggggaggagagagaggcgggattcggttttcgaatcccggccatctcgggcgcgggcgcgagcgggagagagaggggaatgggcgcggagggcgcggcgcacgcgcgaacgtggccgacgtggcccgggggaggcggaggcgtgggcgcggcggccgttacgggtgcggcggcgcgagcgggagaggcgggaggtgggagacgggtccgacaggtgggtccccctgtcggcgaccccaggagggagggaggcgggcggccggctgccgggctgggcctcggcctgcggccggcccaacagagaggggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaacacggcaaaaccgggtaaccttgtttctggttctcctttcgctggtatcaagtatgcgaaccggcttctcaacataagttaggtcctcctggatatcaatgtgttccgaatccgcctgttcttcaggtacccttaaacacttctttaattgggacacgtggaacacgtcatggatgccgatcatgttggatggaagttctagctgataagcaacttctccccttcgttccaagattttgtatggtcccacgaagcgtggtgccaacttgcctttcgtctgaaaacgatgtactccccggagcggagtgacacgaagatacacgtaatctcctgcctcaaaagtgagctcccttcgacggttatccgcgtagctcttctgtcgagactgggcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttagtgagtcgatccacgactacccagattgaatcatgtcccgatgatgtccggggcagtcccgttataaagtccattccgatctcctcccatttccattccgggatttgaagaggttggagtaaacctgctggtctttggtgctctgctttcactcattggcaaacatcgcagagtgcgacgaattcagctatttcccttctcatgctgacccaccaaaatttttctttaaggtcttggtacattttggtgctgcctgggtgaatggagtactgggtctgatgagcctcggtgagtatcagatccttcagttctttgtcgtcaggtacacacaatctttctcccatccagattgtgccatgctcatcttcgtggaaatcccgagcctttccgactctcatgttctttttcagttctgctatttccggatcatttacttgagcggctctaacttgatccacgagcgtaggccgtgcctccagagcggctacaaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcgcaatagacttggaagtctttcatctggtcgggcaggatcaaaaccggtgcggatactaatttcttcttgagctcctcaaaactcttatcgcactcagctgtccatttaaacttctcatctttcttaagcaactgagtcatgggtcgggcgattctggagaaattttcgatgaatcggcggtaataacctgccagtcctagaaaactccgaatctgcgacacggtcttaggtggggtccatttggtaactgactccacgttcgatgggtcgactgccacaccctgagctgtaatgacatgacccagaaattttacttccgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgactcgcacaatcgatgactcccttaaacttggtcagccaatccatcccaagaatgacatctaggtctttggattcgagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgcagggattgagttaacagggaacgtacccagtacgacctccggtgctgtttgtgcctcctccgcagatgcgtggttgacacgagcctggataaaccttggcccggcacgcctgggcttcgggcatttgtcagcgaagtggccaagctcgccacaattgaagcaggaccctggttttgctcccgtctccttcttggcttgcgcgggctggcctgactgtgccggtgccattggtgggcgtggagctgtaccgcggttgggctgacttccatggtagttttgactgccactggtgccctggtggaagttgctagggttgaacgggcggtgctggcggacgatcatggtggtaggtccaccctgctgcccgggagtgaagcgcggcctctggtgacttccctgatgtgccctgaactgagcggccttcctcttcctgtccatcttgttgcgttggtcctcctgacggattgccttgtcgaccagcctctcaaagtcagcgtagtccccagatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcaaaagcgaccttctcctgatcattgcactgcaggagattcagcttcttctctattgcatggagccagtcattcgcctccatggggttggtggtgctggagaaggtgggtggcctgacgcgtagaaattctggcaacttggactgagggggagggggaccaaactgctggtgctgctgttcggcgtgctgcatcatcctctggtgcatctgctggtgctgctgctgcatctgctgcatcatggctgccatcatctgagtttgatgtgccataacttgggcaagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaagagcagatgggggaaaagaagaaaaacagatgctcaagaactaagctttattacaaaggaattaaaactgcaattgttctgatctgaattaaaaacacttaaaagaacaagcaaacatccttattaagacagccatatcataggcacatgatatcgaccgtcaactgaccccaaacaagcaacctaaacacacaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtaccactggctgaacctctggcggctgatgctggagcgaaggagagagtgaacgcgggagctggaactggagctgcaggaactgcgggcggaactgaaggtgctgcgggagctgctgctggaggtgggttcctgggcgcaagctggatgcgcacaggtgcagtcgtcgtcttgcggggcatggtgcggatccggactcctcctggcgctggaagaccctttagctgagcgttctccttcttcaggcgcgctatctcgtccttcagggcgacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccactgagcggcggaatcgtcgtgtactccggcgcgttgaggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattaccattagaaccaacagtctaaacattaatatgattttccccattgtgaactagttgaactaagcatggctaagcaattcaggcatgcaagcttgaatcatgttataaccccaagctaacaaaggagcatggtatcaaaatag

SEQ ID NO: 60829 - DNA, 2381 bp, Oryza sativa
tgtccctttacgccgtcttgacaaagcctctgaggaacctaagggaacttcggctggggacgcccagagcggataaggctttgtcagatccttcagagacgaaagaccatgtaagatctggtcatgtaagagatctcgccgtgcgtattaaccaagtcgtgtaatcggaaatggattttccaacttcacagctgggggctaggatcagtgcttattcaactaaagcaagtcaaaggtccaagagccttatcctccgagaacgattctccgacgacaaggttgggggatagggagagtgtataactcaacaaactgactgatcgaagtcggtaaaagagtagatgctcatatacaaaacattggtctgtaagtttaattcattttcggttttccatacatattataacatgtcaccctttgagcattcgctcgggggctatttttatctaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaatttcttgacttcaatccaaattcttgattacagcaagacgggagacttagtcgtatgctctgtactttcttggttgacatcggagattgactcagacaaaccctttaggtgtccgcacgaggctgataaaggaagtctaacgttatctctgaattcaccgagaatggtcatatgagcacaataacagttactccaaggtctgtgcgcggttgagaatatgaattcgttcatttgcatcgaagtcgggggctactgtcagggttatggataccacatacctaatagtagtcgactaaatctcggcaggacccaccacataccatgtcctatacggaaacaacctgcggatataggaggagttccgataaggaaagacaaccagagttctacatggaaacgacaaggactactcggattgtatccatattggttttcctagttctacttgtacaaggggacacctatgggtataaatacaagaccccctaggaggaccagagggagaaccaacacaatcaacatacacccaccagaagccacaacatacaagcctacatacgccaagacaagccgccggatatcgacatcagagatatgcctggattggccctatccggtacctacagaagtcggccgtaggaatctagcgctatcgctgatttcgacgggcgcgagctcgaggaggaaggctaccctgttgtcgactacgagtcagaccttcagaccgccatgtcgacaacagttagataggctaccccacatattgtactggtgtgattatggtgaataagagcaataccggctccggccaacaggatgtagggttattacctaacaattcaggggcccgaacctgtataaaaatcctcgtctccatctcttttacctcagtctcgcgtgtattctagcaccgacgatccccatactatacaaataccagaattgcgacatcaaacgtctactgaaagaaaattattgatccatgatcgatcatgatctagttgtcgatgctaaaccatctaaccatagtacaataccatacccttcgtcgtccatatcatcttttcgtattagctagctgaagaacgccgatagatgtgtgtttcaaaagcacaagtcgatcatttgacttcaaaaaaacgaatcaccactaacaagtacaattaatagtctcaccgtacaccatccaacatattcagatatgcttgcagcttgcgaaagtacaaagttattaccaactgacacagtgacacacgtacccccacaagttctgcagcctctggaggtggtttgttgcacgggtgcaccgcacgggtgaagaacactttggcctgtttggacggttaacattctaataagcagctggttggtagccaaattctgaaaatctgaaaaaactgacttctagttaatttttttattctataactacagcttctcagaatttagactaaaagctagactgtttgacggagcttctaattatagaagaagctgcagctgcaggaacctccccagacagcctctatacaccgtccgttgaattaacggcagagacccaccccagtgttgctttcttaagcgtgctctcaaaagagatcgtgttgagacttgagagtcaaaaggaagagcagtaaacttgattttcaccgccaaaacgagaaaatccgtcctcctgatcttttgatctgtacctgacgattttgccttttgta

SEQ ID NO: 60830 - DNA, 9588 bp, Oryza sativa
cccgcgccgtgacggcgggagccccgacgaggcccgggacttgagccgcgccacgaagtccttggtgtagtgtaccttgtgcatcttgatcttgtcgtgcgccggcgccgcgccgagctcgtcgtcgtcgtcgtcctcgccggcgacgccgctcttgatcttggccggaggcggcggcgccttgtactccgtctcgcggtgcgggaactcgacgagcggcgggtcccgcggcacgaaccgggtggcgcggtcgcggacggggacgcccacggcgggcagcagcccgccgcggcgcgtggcgagcccccacgccaccaggaagcccgccgtggcctgcccgtcggcgacgcggtggtgcgccgcgacgccgagcaccatggacccgcacgagaaccgcgtcacctgcacccgcagcagctcctcctccgcgggggcgccgtcgacgctcgggtgcagccgcttcacctccggcgacggccgcctcctgatgatgaacggcgccgccgcggcgagcggcgcgtccacggcggcctcgtcgagccgcgcgccggcgtcgctgagcagcaccgaccgccgcccgtcgggcccgacgccgagccgccccgcccactcccggtacaccgccagcgtccgcgccaggccgagctccatcgccgcgctgggcgggttcggcggccggaacgcgtagatgatggcgatgctctcgtcgtacgtcgccgtgtcgaacacgctcagcggcatccactccggcgccggcgccgccgcgtcgtacaacggcttgacaatcctcgagctctcgaccttaaccttcatgttgctgcatgcacgtagaaagctagtgaagtatcttcttttgcttgtgcgtggttgcaaactttgctactactatggttttttttggttggttttgtctgccaaatgtggctcaaaccaagcatatatatagtgcaaatttgatgacggatttacgtgaaatgaagtgagaagtggtaagtcaagcaggagagatttttgaggttggatctgggcttgaagccttgaacgaccggttttgctgcactgggaattccataggttggtatatgggttaattagtacttaattatgtgatcatgacatggccgatttctggtcaagtcagctaatggccatccggctagagacaaaaggggaaaatccgagatcatccaagtaacacaaactacaaaatgcaagggaatatgttaatgagttaaaaactcagctgattagccatttcagcgaaaccttacctacctgctgtatatcgagagcctcatcagttgcccatatatgtaaaccttttatatatttactcatagtgacttaaaatctactgctaaaaagttatgtttaaaatgtcttaaaatcaacttaaaaaatcaagtttaaatgttcagattctgcctttttactccaacttagaaatcacatttaaaagttcaaattttggcttttgcttttacttgttaggttaaccaatgggatctaagtgatcagagcatgtaccactattaggcattagccattaaggctctgtttggaagattagcccagggctaattttgagagctaatgtttagtcatgaattggtagactaaacattagcctagagtggtatatttggatccatgagctaattcaaagctaaaaggtggagagagagagagttgaaagagaggagagaggagggagagagagctgctttttgatggtccctacacaaaattagccccattagcacccattggagggactaatgttttgaggggggctaattcactttagccaaaaattagcccatctgtttagatccttgagggctaatttagagctaaaaggtggggactaatgtttagcccatggaaccaataatgccctaactcatggagaaacgctattagccgattagatttagcggtgtcggaggctttgtcattgctcctggccggctggatgagcatggattctgtttgttggaatgctttattattgaatctggaaaacttgtaaaattgttgcggaatacgaaagatctttgtcactaggctccacaatagcgccggctccagtagttctaaatccaccatacatcctaatcctttgtgtcgagtgataggagtaggttgcgttgatcaatctcatcctcacttccacaatgccggccgttagatacaaatgcaactgcgaaaatcaaacacaagttcgtcacttcacaaggtcgccatctcaccgagagggtacccaaagaaaaaaaatatttatcttttaagccttcactaaaataaatgaaaaaaaaccatgttaattacttgcaattctgaaaaaaaaacggaggccactaatctacgggtttaactatgtgccactcttaaaatgtgatgataacagatttgtcactcgctatctatgacatgtggaccctcatatgtgtatggcatgtgggtccagtggcaaatctgttatcatcacttgtaagagttgcgaaaagttaattattcctaacttagcagtcttttgcaggcacgggtccttgcctccatgccatgcatgtatcgatgcacgtacatacctagtttgtctggagagcaatcttatagtacttggggaggtaaaaaaatttagcgaaaaatttggtacattataatacctaagtaccaagaggtataaaattataatagaaaaagtggtatctcatgataccttcttaaggactgtaaaattgctcttgtatgtaacttctactcaagcctagagccagaatgaaatggagaggggtgctactcgcttaatttattctattttagaccaagtttaaactgatatgagtgtttgagtttagattgaagggtgcatatatgatgaaaataaatatacttaaaaaaatttcttaaccaaatttttgggcacccctctctccacccaagctccgcccctgcctactctatcaatagcccgccctttcttcaaaaacataataataaaatggcaacactttaaaaagttttttttttgaacatgacactttaaaaagttacacatcgattttcagagtaagcattggagaagttaatgactgtcaaagtttaatcaaactttatcctaaacgcatcctactatattaatactgcgtatcgaggatcaaatgtgtcatatgttctgctaagaatacttggtacatgcgtgcgcgtgggttgcacatgcatatatgtatgcacaccgcacacgctttaaacctgtagtggatccgaacatttaatattatgaacatatattgtttacgccacgtatgactatcacatgattaaacttttcaactcctcgtgaagatcggatatgttctccctttgtccaacttttatttcatttttaacccatcccgcacggaaaaaaaaaccctactttatacaaatcccaatccaattattacacactttagcagctttgaaaataattacttctccggttccacaattcttaacgtcttggacaaaattaaggtcaattttttataattttaattattaacaactttaaaactatctagtttaaagaaactagaacaacatatataaaatattgtatttattataatagaaaataaattcaaaagatatattttagaaaccatgccatttgtccaaaacgtgaagaattatgaaaccggagggagtattttctatttcaaaaatttcgatacaatgattactcaaaaatgaatttattttaggacaaatgagatgagtaaaaaacgaacttattatgagatggaggaaatattatagtatgtttgaagaaagagtaaaatcaataaaacttcacatattacagtctaagttgcacaaaatcaccgaaatttaacacataaccctaagtataatggtactaaaatttcataaaaacaaactgttaactatttttacatactcctatattaaaattttaaaaaacgttacttgcacactgtaacatttatatggtggatgaaaaactcataaatttaaaatgtgattgttgaacttaaaagcttagcagatcaaagtcaaaatgatcaatagtgtgttttctaaaactttatagcgataatactcggggttaagtgacacgtgtcaaaagccccgtggttaattttgtgcaaccagaccacaatgctttgggttaagtgaaatttactcttgaagaaatttattcctacctaattttaggaactgggattgttgttcattcatgatttatgtgtgcatagataggacaatcatttgcttaaactgtgtaaagttttcaccacatcgcttttggtgcaggttaagcaaaaggctcatggtgcacattttttgaaaccaattcgatcactgaagaatcagtttgaagatgacggtacagattttgcatatgaattagactgatggatatgcttaatgagttttcgcactatggaaaagccagcttatatattctggctaatctaaatagagaatagttagaggtttgggataaaagatatatcacctcaattagaagttaattagcgataacctctactggtattttttagattatatggaacaagaatagtcaaacaaaatagatagtttgggttagcttttgatgccaaagtttcacaatgatcaatcttgaaccaatctttacctccgttagagcatctccaacagcctctccaaatcaaactctccaaacacccatatagccaactctccatctgatttggctagtcaaaaaagatactcactccaacagactctctattaatcctctccaaataaaatcggacccacatgtcagctcctctcccctcttcttcctctcttcctccccttctttctcttttcttcttctccccttccttcccgtcgaggcagccgacgcatggcgcggtggtgcgacggcgctgggaggtgggaggcggcgctaggaggcggaaggctgcgtggggaggcggccgggaagcagcgggaggtggcgcggggaggtaggaggcggacgaggtgggatgcggtggtcgacgacctcgacgacgaccccgacgacgacctcgacgacggcgcccccgatgacgacctcaatgacggcgcccccgacgatgacgacggtggcctcggcagtggggcggaggtgcggcgctggcggaggttgggcaccggcgcggcggaggccggaggggcagcgtggggaggcggccgggaagcggcggggaaaggcgggagacggcgggaggcgtggggaggcgggaggcggacaaggtgggaggcggcgctcgacgacctcgacgacgaccccgacgacgacctcgacgacaacgatggcggccctgacgaccccgacgacgacgacctcgacaacggcgacctcgatgacgacgacggcgacggcgacgacgacgatggcgcccccggcgagacgacgacggtggcctcggcactggccactgggggcggagggtgggaaaaacgcgtggggcccacgattagagaggcgcttttggcttgccaaagttggccagcgcggggagaagtttggccagctagatggcttggccagccagttagctaggctgttgaagtgtgtttttgatccaaaattgctaaaatttaacttggagagtggaataaggaggctgttggagatactcttatactttaaactgccaaagtttatgttctttctctcacttctccaacttctaccctcgtcttccttacacacgtctcccaaactactagacggtacgcttttaaaaagttttctataggaaaaatactttaagaatcatattaatttatttttttaagttttttttataaataattaattaaccatattagtactaatagacaacactttttcggtgaagtgagatggagttcctaactccacctcaaagaaaccaggaactcccttctccaacatatcatcgccctgtacaataattaactccccagctgttcattgataagaagttgcacgtggaaggatcagtgaggagtgaggacagattactttcaaattccgtttacttttagtggtgtgaagggacacatcccttcatctacttttaataggtatatttcatcttggcacataaactaaacataagtaatcctacttatcatccatttaaacatgttactccctccggttctataataattgatgttttggacaatgttgaggtcaaattttataactttgaccatcaataactttaaaaatatttagtttaaagaaactggaacaacatatatagatttgtcttttaaagcactataataaaagtagacatgcatttatttattgtatatattataataaaaaataagatcaaagatatattttgtagaccgtgccattgttcaaaacgtcaattaaaataaaactggaggaagtacttgttattccttataaacaagtgattcattaatatttacatttcttgatgcctatgtagccaatcttatgtggaagaatggagagtcacgtattaaatccgagaaagtcattaaaatgataggtcgttggattgaaatatgcctattaaaaataaaatttttatatttaaaaatatgtctatcaaaaatagatggagggactgccattgtatttttttcagatttttcagagtatttctttaggaactcagttgtaattttttttaatgcgctttatgttcatagtcttggtttttcgacaacgtaatcgaagaggcacgtgacctgatcaataattactccctccgtttcacaatgcaagtcattctagcattttccacatttataatgatgttaatgaatctagacatatatatctatatagattcattaacatcaatataaatatagaaaatactaaaatgacttacattatgaaacagaggaagtattatactcccaactcctactcggtaggactgccattatactggcaacccgaccccttccccagttcccctgccccccagcagttgactcgcgcttaattattgcatctatagaataaataagtacttattcttctcttaaactaattaatatctcacgcttttctgctggatatgtgattgatagatgtatatgtttaaataatgtaaaaatgatgtgaaaataatgatttaatattgctggcatcttgagttgtaaaagacaacaaaattataatgatatataatgtttgcatgatttttaaaatactctagataataattgttagtatgtgataatgtgttacatttacatattcaaggtttagaagtcggtgggcatcaactttatatagtaagataaaatatcttgtttttaatccagtctcaaataaattaatatgatgtaaaaatacgaatatatcattacatcattaatactatatatatgcatctcttagctttgatgtttggttagacctttgacataccaagctctaattaacgacgtttatatctgacgattggaggtgagaatggtgatgttataactcagagtaaagtgtacgggtggtccttaagctaggtccttactctatactaacttataacaaactctatactaacttatatcaaagggagagaaagtggaccccgaaatatttgagactacggagaacagatcagtacttcataaagaatactaattatcatatatataataatggtcatcaatattccatttaactcctcgaccagttgacacctcaatgtagtacagtatatgtgatgataccagctgtggagtatacagccgcgatagatcttccctagttgatgccgcgatagatcatccctaattattgatgccgtatacgttcgcagacctagaaacggagtgtctgattctgaatattggtaggattatgtgctcaattaattatattatctgtgcgttttatcaaattaactgatggtccaggcccaactactaccgattaaaacaaatatgaaggacgaaatatctcaaaaagatcatgaaagtaaacttagggaagaattaggttttctgattttccccccacttttaaataaaaagggataacatacttagcacacgaacaaaaaaaattatggacaggcaaaattgattcgtagaggcggttttcccagccgcctctaacaaaacagatagggttggatttttacaagcagaccactttactatgtatgaaaatggatttcacatgcgaacaagtacattaaggctctgtttcgccattcctggttcccaacgggaatagtacgcacaaaaaacatagcgatcaattagcgcatgattaattaagtattagctttttttcaaaaatagattaatttgatttttttaagcatttttcgtatagaaactttttgcaaaaaatgcaccgtttagcagtttgaaaagcgtgcgcgtgaaaaacgggggagaggggttgggaaaagggtgtgccgaacatagcctaagaccgcttacgaaaatgcatgtaattttcagtttcacaactcaggcgcaatatgcgcgcggcatatggattcaaaccccaagacccctctctccatacatagatttcttaccatttcgtgcacctatcatttgttggctagattcaagatattatggctgtgttcattagtgctggctgggaaccttccctttcgacatagaaacggagaagcacattagcacatgttaattaagtattagctaaaattaacttgaaaaatggattaatgtgtttctttaaacaactttcctatagaatttttttttcaaaaaacacaccatttagcggtttaaaaagcgtgcgcccgaaaaacgacagggggagttgggaacccatacaaatgaacgcaacctttttactatgttgtttttttaaccttacttagggtgtgttcggaatccccctttcctaactcacacaccctctttttttgcacgcacgcctttcaaactgctaaacggttcgtttttttcaaaaagtttctatacgaaaattgcttaaaaaatcatattgatccttttttaaaaaaatagataatacttaattgatcatctgttaatggaccgctccgtttttcgtgcgtagaccaaactccccagcagcgaacgcagcctttaaccttcaaaatcacaatatataacacatgaaaggtccaggatggccaaattgtcgttgttgttgtgcgtgtgcatgtgttaattttataattagtatgctcaaacactgttaaatgctccttttaacaaaacaaggacacgttttacatattttgaataacataagaacttcaataagtcatatttatccatagcaagtagcaagtgaaaaaggattattagcacacaagatgctgtgcaggttgtcatggcaaactactgtacatgctcaaaaactgagctactgttttcttacgaaaaactaaagtgcaaaaggattattaatctaaaaatattcttgcttcatatggtataagttgaatgtgaaatgaattgtaattaattttgtcaagacattgatctcccagcctcgacaggattagacatgatttggcaaaaagtgtatagaatcataatacaatgccaattggg

SEQ ID NO: 60831 - DNA, 1841 bp, Oryza sativa
ttcccgcctgcgggcctctgcggccgccggatcctcggtctcagactggccggacttggaatggcgggagggacgcgacgggatctcgctgaaacaaaagaaaagaccagaagacgaacaagatgggtgagtgaaaactcatgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgctggcgcggccccctccgggcgcctgctgttggcacgcgccgccccgtcccctcggggaggagatgggggaggtgttcctccctgcttcctcttcccccgggcgttggcagggcggctgctccccgggccactgtcacgggacccagaagcatgaccccctctcggggtagattgttccccccggcggctcccgcctgcgccgtcgtggccctttggagctcgctcctctgaggccccgaccgccatcataatggtcaggatggaggcgcggtccggatcgctgcagagggggaggattccttggggaatgagggccgcctccacggagttgagattcagcacccgttggaccaatatcttgaagtcctcaggagccccgtcccatctcactccctggtgggtcctcatgaagtcttcggacccggtgtactcccaggcgccccgagcgcgccgctggagcggcgcaatccgacgacggaggtagtcgccatacaccatggcccccgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcaaggggggtgtagaaccagtcgctcttccagtcgtcccacttcttgcggagggtgcaggggatgtagcggttcgccaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtacgccatctggagatcgtagaactccagaacatccatgaagaaagaagaaaatggcggaactagccctgccattgcaaaagggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcaaaggtagggcacaagaaagaaggagttagggcgcaagcggcgaagacaagggaaataatggcgaaaggaaggaaacaaatcccttcctcagtgcctttatactcttgccaacgctgtgcccggctcctcgcttctcgcgcccaatatttcgcccctcgtttctcgcgcccacgcttccactaatcccattcgcccgcttgcggcgcatgaggtggatatgcggttgtggcagtcgagatagatcatattgtgcgcgcggtaattacgctcgccgaccaaagcgacgttaccatatctccagacgaaacgaatcgccatgtccagattcgtgtgctactcgagtaatgtggcag

SEQ ID NO: 60832 - DNA, 4177 bp, Oryza sativa
ggcgaattcgagctcggtaccccgctagctagctaggaaattaatcaatccttttgcttaattacctgcatggttggatacgtgacatagcactttacactacacacagagatcttcatctgcaagcatgcatgctaatatacatgtatatggaagtggatttttttcctctcgaggggatatccccttaaatttaagttacatgtaaaaataaggggatatctttttcaagggagataatttgagttttctaatatatagtagtccatgcagtacatattaattaacttaccgagattatttatatggtaggaaataaataatcgtccccactggcatgtggccctgatattaggcacaaagtaggaggtgtatcacgagagaaataggggcgatgattaattcagtgttcaagtgggggccgtacgtggcgattaatttgatccgaccaaaataaaaaaaaagttaatagagattaaggccctgtttctttcagcttgggattattataatccagattattgggagtaagctggaagaaacagacaacttattgaattaagttattataatctggagcccagcttattataatctgataagctcatttaggtgaggtttttccagattattgagtgaaaaattatccaccatgccaccccactctctttttagacttgcaaacccaataatctaggctctaataatctaggaaagaaacaactaaccgtttattctactgcagattataacaatctagcttatagtaatctgactcaataatctagattataataatccaagctgaaagaaacatggtctaatactactccgtaattgatatgtgctaccaatgttatcttgcccggcccttgtgcggcccaacataattatgaacgtgtgttctaatatgtttctgattcggaagtcggaacgcgtactcacgagataaaatagagagagaagccttagccgccggtgatccctagctagaaccacccctctgcatcgatccccaaatcaaattgagattgagatcgaggcgtcgagcgagcgatatggctggcgaatttagtgatctgatgatacaggagggggcgaggctagggctgaagaggtgctccaacgcggagggcggcggccaagaagatgaaggtgaaggtgaaggagaggctgacgagggaagaggtggagcggctgctgtcgttcgtgccgaggccgtttcctcctcgcgacagaccacggtgcgacgatcccgacgtcaacgagatggaggatctcctcgcccacaccgtgctgctcctcaactccaacaaccaagtcatcctccgggcgcaggccagggcccgcgaggagctccggaccaagggctacgtcgagcgctgggtcaccaaatccgtcgccgacatgccggcctcaacagcctagctagctaggccctccatacctagctacctcaattcaagtatcaccatcgatctctcctaactgtattagtaatataatgtagatgagcatgacattacgatgatttgcttcttcggtggtgtggaagcatattttattactgattagtagcatctgtatatatctgtaaacagattttattacgacgacgacgaccaaaaatacgtactaggtttaatttgcggattatatttacgtcatccgattgactcccgcacgacgccctcctccgatccgtgcatcggcgtcgtctagccaactcgtccgatccgattaagagaccgaacgccgatcgatccggccaattggactcgaatcctacttgttttgcctcccccaggtatagtgatgcatatataaatgcagaccagcatcgctagctcagctcgtgtccaccaattcacaaaatcgattccaatacccaacaaggcgacgccgtcggaggaggaggaattaaagggaagagaagaagatcgatgtgtggcgatgacaaatgagctgaagaggtgctccaaggaggcgacgccatcggaggagaaggccgccaagaagatgaagaaggaggaggctgtgaagaagaagaggatgccgatggaacgggtgcaccacctgctgtcgatggtgccgagggcgccggttcctcttccggtgatccgcgatgattccccggagctgaaggagatcgaccaacgtcgtgcaggctctcaacaccagctctcaactcatccgccggatgcaggccaacgcccgtgagcagctgcggaccaagggctacgttgactccgacgacctctagttgaaactgatcgatgtctgtatgatgctgcaaactgtcattaattaattattagcgatctgaaccatcgagtgtcattagctattgacgatctcctcaaccatcgatgtatctgtattattatactgaaccatcgagtgtcattagctattatcaaagttttcgtgctcaactttgatcgtccgtcttatttataatttttttaaattagtatttttcttgttatgagatgataaaatatgaatagtaatttacttatgacttatgtttttattttttaaaaaaaaaattaaataagacagacgatcaaagttggacgcggaaaactatgactgtacttaaaatgatgggacggagggagtacatatatttcacctcacctactatacagcgggaggctgggatgaatcttgtagtgtgtgccctggtcttctttttttgttcagcgttttggttgctaccatgtcaaaattaatatggaaaatatcaaaacctagaaaaaattttggtagtgccaaagccattttttttggcaacctatgtgttattattggcatttttttagcaaaccaaaactaaccaaagaactattcaaattgccaaaaatttggtagggcacataattttggcatcaaaaccaaaattctttcatgctattgctttggttgtcataccaaaaataaaccgaataaaaccttactaatgttatattttgctacaatcaacgatggcctgaggtctatttggcacagctcagcactagctccacccctcctggagctggagctcagtcaaacagtttcagctccaccaaaactaggagtggagctttctcacaaaatgaactagaattgtggagctaggtttagacagctccacaactccactacagacccaactcctgaagctaaatttaggagttggagctgtaccaaacaggcatatgtgaatgagtgacctttacaggatgtcctgagtgctgaagacaaaatgtaaaggtagatgagcctgcagtatgcaatcacgctattctggttttgcaatgcttggacgttgaagctgttttagctctatgtactatcttttatcaaactgatgatacaagaatccttccgatgtacaaaatgcaaagatctcaaaacttagacattggtgtgacatggtacataggccttgaagaagaaagaaagaatcacccaatacttgcgggttgaggcattctacatctgtacatgccatgctagtgaacactcaagttatacagtatagctcttatacaacgagcaaagatacacatgaaagaatttatacgaaaaaataaccaccagggaactgctcttttgcaatcccaaagtggtaaatgtgaagaagatccatccaaatcgtgtaacaggtgaaggaatcaacatacaccattgttaaccagggatctacttcaaaggtatcatgctggtggcctgctaccatctttagctactatgaagtattgcttaaaatctggcacaaaaacatttcatcctatctccattttggaattaatgtagtgccaccatgccacccttactatactcaattcattataatgctgcatcagatttcatctcactctaaccctctttgttcccgaaagttctgttgctccaaaatcccagaaatgtagaatgtagtgaatctcatgtcactgttagtctgttattaatgtatattgcattctgtcataaacctttccccgttggtcatatatttcctccagtagcccttgtaatcatgtatgcccaaatcaagccaaggtttcatgacaccattgtagtgtagagtaacagacctttttatatcggtttgactaactccataatcatgtccaagacctgattggacccatgaatcttccaaaggatatatcaaatcttgaaa

SEQ ID NO: 60833 - DNA, 8006 bp, Oryza sativa
tagatagttgacatcgtcggactttttctgaatcaaacttttataaatttgatgtcaagaaagacttgataatagggcaccctaagttcgacccatataacgcacttctcaaacaggaattaggagtggcctgctatgtatgcatgctgtagtaagatgtatttaacttctccatgtataagtgcttccttatattttatgatgatgatgccccccacctctctctctctctctctctaagaatattgagattggcaaaatagaatgtgctgtacgactacagaagtaattaagtagtactccctccgtttcgaaatgtttgacaccgttgacttttttaaacatgtttgaccgttcgtcttattaaaaaaatttaagtaattattaatttttttcctatcatttgattcattgttaaatatatttttatataggcatataattttacatatttcacaaaagtttttgaataagacgaacggtcaaacatgtgctaaaaagtcaacagagtcaaacatttcgtaacggagggagtagtatacatatatgattgccaagatacacatgcaccacgtatagctagctagctgcacaacatatatggagtatttctcataacgtacgtacacactacacgtacagtagtgaggaaccatgattgaattaagaaggtacaaattaatagtacaataggatattatatagatgatgaatgcatggtcacacaagcatttttgccgagcgggccacactaaggttgccggccggccaaattgttgttaagatagaaattaaagagtgagattacataacataggggtggtaccccatcaaattcattaatcaaagttaaggtactgcatgcgatgaagaaagatcgaaaataggaaaaagatcgagatacagctgatccaatcatgcaccaacgagacttcactgcaggggctagcatgagatgcaacttatataattaaggagctagctagcaatataagcagtatagcagtaatagatgatgcatatatggatcgatggaggggagctagtagagaccaggcttgtagttgagagcgttgggcagccactgggtgccgtggatgaagcggtcgacggtgtactcctcagctttgctagcgtcgaccacggagaagccctcccagttgacgcggcggctggtgtccgatccgggtcccgtattgttgaacttcatgtacgacacggtcttggtcgtctccaagacgtgcttgctcttgtcccactccacccagcccttcgggtgcacgatgccgtcgaggaacgactgcatgaagatgacgtgcgagtggttcttccacgggcggccgaggaatgtctcgacgcccgtcaggttctcgttgggcttggccatgatgctgcagttctggaagctgaagccggtgtcgtcgccgggcttgtcgcggccctgcgccgtgatgatgttgtgcgcaccttcccttccgcggcgcacgaggagatggcatctctggaacaccgccttggcgttgccgaagacgaagtccaccgtgcctgaaatcacgctgtcgaggtacaactgcagtccgttctcagcgtacaaggtgtcctgaaagctctccagctcgcaccggtacagtacagtgtggttggaactagagcgaagagccaacgactggttcccctccggtcccgccgtgttctgtatcgtcaggtctcgggccatgaaaccgcggcctgaggcagctgcatacagtatatatacgtacatacactgatcaaaataaaatttcatatatatatatatatatatatatatatgtcattccttcctatacaatacaatatataaacatcagcacataacatattataatgtcatactataattcaaaataacatatttcttttagaagtattggaatatagttaatatgagtctttaactgcaaattagttataaataatccaatgtcgtaagcttataaaaattagctatttattttaaaagattatcataaactatggtttataatctaaataatatagcatgaaaacaatgaaaattgtggcaagtggatagacatattgtaagcatcatatgcatgattacataatctcggtgtacttaatttatgctccagtgcagtctagctaaacaaattatttgtagagaggttggcttcgagtacataattcctaatattaattattccaaaaaaaatgatgccttcgtacgtagttatattttaccatccaatcgtgttcttgctaggctatgtgaagctttgcacacttgcaaaaaataatcctatataggttgtctcctatatactgcgcaatagatttggactctacaagcttgtgtatttaacatagtctcgaaccatcctaatccatcaattaataaataatgagaacatactttagtcttagatgtttatacaaaaatcgattcatttttttcgaaaatggttggcatataaggtgtaacacgctgtcactattttgtcatctcacaaaatctgaacttaaagtaagatttcataaagaaaatagaaaatacaatagggagcaaagtgaactaattatagaaaaacatagaaaattcttagaaaaaagctctttgcttccacttaaactagaacacccattaccataaccattacatatttttcgagtgctccgatgcttacatgtaaatatacacgaaccaattagagggcgatgattgtataaaataacacgtctattaaacactaatagtttttaagatttgtttaaaaaataaagcccataaacaatcaattctaaaaacgaaaacacattacttttaatttacactttatttgtgaaacgagactaagccaatcttctttaaactgattaagcaaattaatggaggtaaattaaatattatataatataaagacaacaaatagtttgtaaaaaaatatttaagaaatactggtgaagaatgtttttgggcaatcatacttttccactgcagcacgaataatccagtagatatgtttttcttatagtttctaacacaacttaatatgtatgcccgcgcattccttgctagttaataaaaaatattcaagctagctaaggtacgactaattaactaattaaattaagcaaggcatatgcatgcaaattaattaaacacagttacatattctttaggtagccataagagaataatactaggactacttactaacggtagccgatgaaggcatgtcgccatgcttgagggagccacggttgccggtgatcaccgtcttgcccactccgtcgccgaacaaagtcacatcacgcctcgtgatgttgagctgctcgatgtacgtcccctccccgatacggatagtgtaggacgaccgtaccttcttcgtgctcttgggcgctgccgccaaggcagcagcgatcgtcctgtaatcgccgctgccgttcttcgccacggtcacctcgaccaccggagaacgcctgccgtgcgccgccgctgatctggcgccgccgcgcaggagacgctgcagccgcggctttgcccaaccagggagttctgcgccactagttgggaggcagcaaacaagagcagccacgacgagaagaagaggcagctgcagactagtgttcttcatgcttgctcttggctcactctaactggactgaacgagttgatgtgccagcctctggttaatttccttcatatatatatctatacacacacatgcccggccggctgatagatcatgagctggagctagggcgaagctagcagtacaactccgagcctatatatagctagctagggattgaaggctcagcccaagtatttaacctaacctaattgctagatccctcctacgtactattaccctacttcccctataccttggtcggccacttgtgagttagtatatactccctccatctacttttgatagtcatatttccaaatctgaaaattttatttttgatagtcatatttcaatcaacaacccatcatcttaatgactttctcgaatttaatgcgtgactctccattctaccacacatgattggctacatgggtattgagaaatgtaaatattaatgaatcgcttgtttacgaggaataactagtagcatatttaaatgaatgataagtagaattacttatccttggtctgtgtgtcaaggtgaaatatgactatcaaaagtagatagagggagtactagtgtatcaattatcatagcgtacaatattatattataaaccagctataaacacgtatcgaaaagataaaagaagagagataagcagcgggctacaaatttatagccagctgcagtattgactccaacacacaatgtgtgtataacgagtgggaccatatattaatactgtagtatatatatatttatagataactattatatgaattgactattaaattgactatatatgatttggagctgttagttggctatactattaaacaacttgctctcagttgtgtatccgaccaaaaaatgttaaaattaagataagtggcctgtcataattgttagcctagctactgctgctgtatatcctccactatatattactctactatagctattgtatagtagtacttaattagtactagtatatataggtctcctcccaacgttcatctcgatcgatccgcatcggtcaattaatatatgtttgtgctgtagttgcatgcatgcatgcatgtacgtagggcgggtctctagctgaagtaattcttttcgccattgatccccttgatgcttggtcggtcctgcatcgatcgatcatttccatcaatatcgatcacaagcaagctaggttccattttttagtatcgatcgtctctgtcttaatagtactgaacgatcgcgagagaagaagatcgataattatggggagcaccagtcttggatgcatattatttgtacctgtattatttcgccggtgcaatgttaatttcccgctccatattatcactaccacaaaaatactcattggtgccagttataaaggcctcataggtgccggttttgggcccggctccaattggtcggtgctagatctggaaccggcacctatagctttcaacaaataaaaaaaaagaaaaataatcccggcaacccatcgccggccgtcggccacctcgcctggcgtacgcaccagccatctccaccttcgccgccatcaccagatctggaggaaaagggggtagggcggacgaagaggatgagggagggcccccagggagagagagacctgcatcgatccatcatttccatccatatcgatcacaagcaattaaggtcagattgtccatttttgagtatcgatcgtctctgtgtcttaacagtgatcgatcgagagaagaagatcgataagggagcagcagtcttggatggatattatttgtacctgtatatatatatgctgctagtacgtatacaagctagcaatagagtctgtaatgcaacacagttaatgcttgtgctatatatcagattaattaatggccatactattgtcatatatatctgcaaattaaggagcttctttttaatttcactctcaagttctcaatttgttcagtagtacgtggtctgcctatgaatatatgttcagaccggagaccatgatcacatggtgggcgctggctctgtatctaacaatatatgcaagcatgcatgcatgttctatgttccatcgtatcctcataaaccaactcgatagatctaccagagatgactcaaactcaatgctggagatcgagaccatgatagggagtgtttaatttgtatattcggtttattagtcaaacactaatttaacccaaataaaatattagtctgttggtaattttgctgattatcttataatagtttcagtgaatatttaaaaagatgaagcatatggttgaccaacgttaatcacacttgaatttatcgtttagtcactggtaaaaatatttaaaagatgaagcatggctgcatcctgtcggtcactacttcaaaaattatttttgttgacggccaaaataaaaatttatatataacgtatatagaaatcgcagtgtagttacactgtagttacaatacaactatagtgtaattacattatacttgcgctacaactatactatagcacatccacacaagtaatatacatcacaaattgacacaactttgagtaataaactacaaatccacataagcaaccgtgagtataacctaatctgaaatttggcaatgaaaatttgcagaacctacaagagttggaaatggcggcggcgctagcgggtgaaggagacggtggacgatgccggcggtcgagggtagaggccgccggatccaacggttggcggtgcggtggaggcggctgccgccggatctggcaagcggcagtggggtggcggaggaggaggcgactggcggtcggtggagaggcgccggatccgcgtcccccaaacgtgtcaaggcttgcggtcgttaggcgtgtgaggcagcggcgtccggcggtcggcaggcggaggaggaagtggccggcggtggggcgggggagaggccgtggtggtcggatccgcgctctgtagcccagatccagtggccgatggtcggaaggtggggggaggcgacggtgtctggtgatcgggaggcggaggaggaagcggccggcggtggggagagaggccgtggtggctggatccacaccctgtaggctagatccggcggccggcggtcgaaaggtgggggaggcggtgctggccggcggtcgggagacggaggaggaagcgaccggtggtggggggagaggctgcgatggccggatccgcgccccgttggccagattcggcggccggcggtcgggaggcggaggaggaagcggccggcggtggccgctactcgcgcgtggagtcggaggccgccgccggacttggtgctcggcgcgtggatgctcattgacgggagaaagaaagaaaaatgagagagagagagagggatggataaggtaaaagaaaaaacgagagatgagtggtctcggaccgtcggtgggagatagataaggattgggttgggtggtttctacctgtgaagaacaaaaaaaggacctgttagagatggattgggttggatctgtgtaacacactgaaaattcgaccaacaaaatcaaaaaactctaaaaatacggaccttcaaaaactttttaaataaattacatcatgccggttttattcgcctttttcattggattttgatttcgtagtttattaatcgcgaataaagaataagtaattaggaataaaccctaaaattcatttggctaaataaataattgaaaaacaatttaaaataaagattaggtgaggaaagaaataaataaaatattatcgcgaccatattggtaacaatcaaatttaagtgcgatggaataagaattagccctaattaaaaattcaaataaattatataaaaataaaatatgggtaatattaatctagggtgaatacattggttagaataacagagtaaacttcatttatgcaaaaataaggatttatagaataaaatatatataggaaataggctaaaatagggttaaatgggacctggcactattcattgcacgctaggtgttcgagagcgtccctagccctggcccctcctctgccgcgcgcgcctcgcgccccgagccgccgcgcgcccatcgccatcgccacatcgcgccccgcgcccttgccctgccgcgcgcctgtcacgccgccgtcgctgcgcgccgctcgcccgtcgccgtcccgcgcgccgagccccgtgccgagccgcaccaagccccgcgctgcgccgcccgcccgtcgcgtcaccgcctcgagccccgtgccgccgcgccgtcgcgtcgccactcgtcgccgtcaccctgagccccgtgggccgccgtcgcgtcgccattaagccggccacccccctctccttctatcccctcttccttataaatacct

SEQ ID NO: 60834 - DNA, 19206 bp, Oryza sativa
agctccgccggggacgacaccgcctctgccgccgggaattccgccacgctccgccgccgaccaccaccacccgtgtttcccttgtcggcgaggcaagaacgcgtgcgctgggcgacgagccaagaaatcgcgccgcccaccgccgtcgtcagctcgccgaccggagaggaaccatgggcagaaggaggcggcagcgcgcgagcccggaccagcgccgcgagcgctcgccggagaccacccgagcagcccatggcgaggtcgcaggcaagggcgccagaacgggtcgaacatgcaaccaagcctggatgctccaatctgttcgacgaaagaaggatgccactgcgtcttccacgtcttctgcgtcttctgcgatgcgtacaccaacatccggtgaacataacaccagttcgcctcaacctcgccggcgagcagtggtacatacaacaccctcacctcttcttctttcccttaacggaattgctaaaaaaacttttttttatccttgaattgtctcttggggccgttttggattaaaggcaaaacatgccataccaaaattttggtaacttaaataggaaatgtgctagtttggattgatgtcaaataattggtagtgtacatattcaatttggctatattctagaatcttcttcaccatcctactaaaatttggctttacattggtaccaaaccaaacatagctagctaactttgctctaccaaaaaaaataggtagtgctaaaatttacttagattttggcactaccaattaattggtagggtagagaatcaaataggcccttgattcttttttccattgccaaggagtcgaactcctgatcatacagtagaaagctcaaagcatttaaatttagggacaattgcgttcttaccctcactttcaattctaattatgattttacccctattttttagggtttgtgattttaccccagcttttttgaaacaaatcagccgtttgcctctactttggatggcagttaggtgggcccataattattgagtaaaaatatagaaaagagagcagaaaaaattatttatgaaatatgaaatgtccttcctacccctgagaagtaatcatctggagtctggctagccgtccggcccgtcccaactattccccatccccaaacctacgggaggcgagcaggcggcggcggcggctgcctgtagcgatcggaggcggcgacgcttattgcgagccgaagaggtgcgacgcgagcaggcgacgacgacgcagtgagctgggaggcagcgacaagccgacgactgcagcaggcggaggcgtcggaggctcggagcgtcacggtgatgcaaagcagccggtggcggctgaagcgagcgaaggcggcgtggccgcttcaacgagcagctggtaactgtggtgtcccctgccatgattacttcgttaaaccagtggcaaatttcctcgtataaataagttcagagcagattaatcccccccccccccctcttcctgtacacggggtctttttagtgagtattttatcaattgtgcatgtgagcttgggtccaaatgtctaatgtaatcccgtcagtttcgaggatgtgatagcgttatttctttgctccaatgataaacaaatgtagagtttcagaagcacaattctatatcgtgattcgtaaagatatccagatttcctttgcaatggtgattgtttgtgatgtttgctacaaattattgttgaaattttgtcgaaatcctgtcaattttttttctgaaattctatcggaattctgtaaaagtcattgctgaattcatgtcatatttgtcaaactttctgaaagttcgtaaaaaatttaggacggatttgaaataagcaaaattccattttgaaacatgtccagagtctatgcaagcatggctcctgtcgtaaaagtagtaggcgcatatatgcaagggtatacttgtcttcttaccacatatttaacaccgttaaccgaagctaacagaacaggggcaatcgattggttcatttcaaaaaagtagggataaaatcacaaaccctaaaaaataggggtaaaatcactattagaactgaaagtaggggtaagaatgcaattgccccttaaatttatgaccgttggattgcatcaagattcgtatgagagggaaaaaaactcaaaatttttaaatttgtgatccttggattgcatccagattcgtgtgagaggaaaattttttttcacagagatgcactagtggggaatagaactcccgatcacgtagtcaaaagctaatgatgctagtcaattaaacacaaatatgtttttacacaattgtatatgggtagtagttacaatgtaattacactccttttttttgcggggacaatgtaattacactccaactattattgtagtcacatttgaaagtttctcacccaaaaaacttgtggcaatttttaggtagtcccatttcttaaacagcatgctcacttttcatttgcacaatatatcattgcatgagattctaatctaaattacatgcattttagatggttggaggtgagctggtttctgcattcttagtcgatctgcacgcggactactgcgagaaatcaagtttgagtggccaattagtttgccactactgctactttcaaaattatgtcacaaaaaatctgtctgctagagaggaatggtggtgcttaaattttcctttaacattacattgctgcatttgttttcggaagaactaattatgcttgctgatttgcatttcagatgttgctccactggcataggaagcaccctaaagcagatcggatcccatgtaatcagaggaattgcggggtgatagtaagctctccccgtgagttagagctacacgtccacttctcccacgtccagcctgcgggttggtgggtagagtgatcaactgaaagttcggcatgtttttggattggttccttgctaactattggattagttccttgcttactattcttatgttaacaccgatatctgtaaccccttaatcataatatcataatttgatttgattgcgtactctaaatgtgttgaatgacatgcgcgtgtgactaaagtgattactgattagtatctcagcataaatatgtttgcacattccagtagtagccttaatatctgtatgggaatgggatcctctgacgtgaagtcagagggacgtggtgactaacatgtgggccccactgctcacgggcccacctgttagtgaccatgtcacgtggcagttcacgtttgaggaaccgcctccatctgtatgagaaataaagcaccaactaagcatcatttggcaacaaccaagattgtagcaacatggctgaatggaagtcacagaacagaatatagaatatacacaatgtgtatattacacaccatcagaatttatttgagtttgagtacccccgccacgccctgcttgttctgcttgttcagaattttggagttggagatgatagggcacacccgcccagcttgttctgttctgccctggcacacaagatcttttttcttttggacgaccatcgcatcaaatgcacgcaagtagcactcgtcatgaatcgactgtgttgatcatttttcagcatggtgggtttcaattggcaaggcaattaacctgtattttgtacaaattccatagacttcacggaagaatctcagccctcaaacacccttctagtctttgcagttgaagcaaaactttctcaactgaccagtctaaatgaaaggggcaagcttcccaatgaacagcagacgccagacagcttctctgatattttccttacacaaaacaaatcagccgaagcattggtaaccttaggagcatagtcaaacacctttatttttgcaattatctcatcaagcttcagaaggatgctatcatttcctgaatgttttccagctccagctgcaaaatggtgaacactgccattcagctccatccaactgcatcctttctccttcaacgtcccctggacttacattactctcctcacctccttaagaccttaacataattctagttgccatatttgataagagcacatgcgctctgccacgatgaaacaagagcaaaatcatgcttgatgaaacaagctaagatggtccatccttaactcctttctgcaaaaaaggactttcgctcagagaacaggagaataatctgggatgtgttatttaaactgataaacatggaacaatgggtgcacaataactgaagttataagctgttgctggttcgattttagccaatacagtgtaatgtgcataaaacttgtttagaagtttagaaaattacctatgaaaactgaagcttgagcataaggtttagccaatggataatatcttatgcaggccctaattctcagttaaggaatgggtccatctacagttagcaagggcacacactagcacaagcagatatgatgcgtagcactaaactaatacatcgattgcatatgtgtacatgagatgagttagtgtttgcacctgaacatcattgcaagtaaatcggaagtgtattagtgctaggaatcaaaactagccccattacagatttttgcccgttagcagcatgtaaagttaaaacgtaatttagtcaagatcaaatggtgaaaagaacacaaactggatcttgacgtggaaagactatgagaacctacctccttgaggactagtgaatcttaaagaccacgaaacaacttctgttcaagcttttttgttttctcactgtccgcaagctccaattccttctcataatccttcctagacagaccctgcgattgttatctagaatgaattaagtacgttggaacagaaggcttggtctctcataattcaaaataaaaatagatggcagctagaacacagtccatacctctcaatcttctatccctgtagttgtaaaatatgaagtacatggtgtccttcaagatactaaaaaacatgcttccacaaggcttctccaaattagcccaggcatcctgccgattgcagtcagagtctcagagttaagttattttagactctaagaagcacttacagctttgccattttctaataacattggtcacattagccttgtatattccactaattccctagaaagtggctatcacacaagacctgctgtttgcccttaagacggtagaaatttaaataaacataagaaaggtcggtacaaataaacaaatatggagcaacctaaccttctcattcacctttcagttctccaatcataattttacatataaattgtacagaacaagaagaaatatacacaactattatatccataaacaagaaaacttaaaagtgcttcttctaggcgaagttcaactttgtgaaactaggtgtaatccaaacaggagcgggaaagttggaccaaagctgaggagacacgagttcctctctgctgttatgtttcaaatcaaataatccaatatcacgacgcttattcttgaatccaaataaccaagcttcgtcatcatcagtaaaataggtataattttccttgagatgtggatattgttccgtgctgagacaaagtgattggttatgaccaagaaacaacacatgaccatccaggttattgatctctacatgttttttccccatagtatcaacactatatattttaatttccctagtataccgcacaaatgttgcatggtcagcaggcaagtcagcctcgtaatcctcctcaatgtcctcaactgacctccaaactagcagaagaccaccccatggagcttgcacaatgtacctactgtaagacaaacttccaattatcatcttcatcgtgatcgtggggccactgagatcaagtgtatggatttctccctgtgcagtcagtgcatacagtagaccatcaatgtagatgcagtcagaatagtgagagtgtgatggatgccatgtccacttatcatccccaacccttgcaaatgaaatttgaccagctggctcgtggatcagaaccacaatgcatccccctgtgaaagtatcagtaaacacaaaagccttactatatatgtaatcccgcagctcgccaagggcaaaaattgatggctctgcataactaaccctcgttgcagtgtgcagtgagaactcatacttgtggagagcaccagactcattgaagatgggattcacatgctccattgtggtaacagaagggagagctatctgttcccctgtgatcggattgaccaggtgcatctcggataagtcatcagctgtaatcaaccaaccaagtgaggacccaatcagaaacctactgcgtatgggtggctccgggagagtaatcttgtactccctcttctcgacaagactatagagacacacgacgctatcgccagcagattcagaggtgtatagcaggcacggcgtctgggacagtttatagatacctaggctgcgcaattcgttgtaggccgagagccaggagttacagaccgatcctgcacgcacgaggtcagggatctccaggagggcaaatatctccattaagatgtcctgagacagctctggtaaatttgccacaacactctctgccattgatggctgatcaccatcatctttttgcacttccttcagtaaactactgtgaaggggcgctaggagcttggattgtactactctgaagagtaggttgcacaaattcttgggacatctcgctagatcccctaagttcataatcctggctatagtactacagggcgccattggataattggagcagatcgagcccctcttgcaaggtgaaattcgtcgcctgcttgaatacttgcagagttggaacatgtgatgaagcaagagacgcaaggtatatacctgaagttacccaaggaaaactgaaacggaatttgttgtcctcaaaagagaaatccgactccggatcagacttgttcccgggaatccactctgaatcatactggctcacacggatccatattccgaatcgaggtcagcaaggaaaacatgtggagaactcaccgtcaagcgctgccgccgtgcatggtggggggcgggagtggatttgtgcgcggaggagaagcagccaccgtcaggccgccgtgcggtggagcacaggaaatccggcggtcgattttggccgccgtagcacagccaccgggggccgccacgcgctgccgtatctccgaggacaggacggccggcggttgaagcggcgacgactccgggccagcgtgctcgtcggcggagaggatgcggcttcgcgccgccgttgtcggcgacggcggcgggtgggcagccacgcgagtgtttccttctttctttttttctcaggttttctattttgcaagcgcctgcaaaattttaacaattttgctatatattttgcgataaattttctcaaaaaaattgacatatgtaaattaaagtataatcgtagtgtaattataatataacttgtatgtaacttttaaatatctcttcgtaatctccgtaacatgttatttcggtaaaataaaggtcatgagaacaaatcctctcacatatctctactgtaattttttttctttcttaccagaacaaatcttgtaaaagatctaacgattcaaaattacgtgaaacttatatacaagttacacggtattcacatttaagttataatataattacactacgattatattataattatatctattaaatttttagaagaaaatttgtcgataaaatatacaggtgatcccaaattttaatccatcagtcgattttgtcagccgttggatttgcttggctggtggatgcacattctggtaacttggttgtattttggcaggcccgttaacccgtgggcttgcattgctccacattttgccttctgttaaaatgtgtgtattcagatgcaattcggcataggtttccttgccgaatcgtagttagtctgtcttctcaggtacttgtattacatatggggtgttaggacgctaataaaaaaaaattacagaatccgttagtaaaccgtgagaaaaatttattaagtctaattaatccatcattagcaaatatttactgtagcaccatattgttaaatcaggagcaattatgcttaaaagattcgtctcgtaaattagtcgcaatctgtgcaattagttattttttagcctatatttaatacttcatgcatgtattcaaacattcgatgtgacagggtgaaaaattttgaaatgggatctaaaaagggtctaggttacacttatattagaacagaaagagtgatgtatagttaggggtggccatcgcgattcgcgaaagaggtggacggggagctcgtcgagttggctggagaaggcactcttgaatgtttcctagccaaacaggtcgagtggttgtatgtatggtgtagttgagcgatctaagccgtccaatcagttttgaacggtccagaatcgagaataattcaaagttgtttgatcagtttttttcaagtacaaacacggctcttcggtggcatccaaatgcatttgtttccaaaaatgaatcggaaaaattatagggggcctaagatcttgatatgtatggggtggcttgatctttcggtgagttgagataactacgatttaggagaaatattgacgatccgactacaaccgtacgagacgttgttatgttgtgccttagcgatcaatacacatctccgagagtttgttgatcttgctggtgcagatcaaccctattcctgcaagcaatcgagaacaagtaagaacaagatagaaagcaactgaattgctagatagacaagacgcacaaagatgaattgatatacgataaagtggggttccgaacaagcagacggacggtctagccgacacgcgtgctacaagcgaagtagcaatagctaaacttacaattaatcaaaacccaactaaccctgaaggggttactagctatttaaaggatagaggaggtcataagggcgtcctccctctgtttagggcacagccccccttggaccagggtcccagacgaagttacagacctataggcccattacagacaatgcagccccttgttttttcaattgccgatgactcggatggaatttgacaatgaggttggattcgttggaaagaggattccgagagctttccataaagtactcgtgggcccaaaacgtaggccatatggagatttggcgaccgtttgaattcagcactatcttaggaggccgaattggattccagaacgctgtcacgcccggaatttctatccaaaattctaaacgcttacatgtgtgtgaaccctcgtttaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccatgcagcaaatatgcaagtgcacaggataacaaaggatggcatagtagggtttcatttgcataaacagcatttaataaacatttcagaatttaataaaatagttaagtagtaattaaacaatattaatccaacgctatacaacataccctgttgcataggcccaaccattctgaacaactatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggtcagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagctgttgcccacgctggcttgtggttggcacggttaatatctcacaaccgaaactcatgaaccggtccttaattgtcatgagcacgaccatcaaaaccatgtgctcacaacccaccattatcaggttttagttggcaaattaattaattaaccaatcatgattaaccatcatgagctatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaaggctataacaaacaataggttaattccacccaacgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaagagaaaagagcaaaatcaccaaaacagcacataaacaagcatgaacagtacatgtggatatttttaacatgtagatctcaattttagaaaaaattagagacttgaaccaactaaatccgagctaagatgaattagttatgaatttttatagattaaatcggattaaaacacttatatgggttttaattgaatgatgacgcaataatgaattattttttaaaaggaaaaggaaattattgcgtcagcggttagggttcgcggtggaccgggtgcacggcggcggctcacggaaacgaacggccgagatcgatcctatccacaacgaacggccaagatttaacggtctacgaccggtctacgacggacggcaccgatgacatcggtgatgacgtcatcaccggcggcggctcgggcgcgcaagctcgccggcgaacgacgacgcgacgccgcgaatggaggacaccaacacgtagagggcgacgtggcgaactcaccggtgaccaaaacagcggcagaagatcaacggacggcgacggcgtcgaggaagaagcggcggcgaccttcggcttgacgacgacggcaacctacggcgacgacggaggggtggacgagatcggcgacggcttggtgaccacgacggtgacctccccgagcagcgacgacgaccggagcgacggccgcgcacggctggagctgcggcggcgacggcagcgcacagctgcacggtgctagggcgctacagacggcggcgggcaatggcgagggtggcgacggatagcggagacaccgggggtccttttataggggcaaggaggcggcggcgaaggcccacggcgaccggcgacgcgatggaaggtttagggttcggaggagagagatcgatccgaatcgaactcgaattcacggatttccaaaccgaattggcgatcgattccaaaaggaaaaaaggtagagaagattccggggagcatttcccctcaaacgatttcaccggatcgggaaagatgcggccgaattggaaaggtggcggcggcgcggcgcggctagggtttcggtgcgaggaggacgacgagtccgacaggtgggacccacctgtcagcgaccgagcgcgcgcgcgcgggcggctgcgggctgactaggccaaagaggagagagagggaaggttttgggccgactttcggcccaaagccaaaagaggacttttaaaatattttccaatttaaattattcatgaaatgcaattccatttattaaaaatacttccttggctcaaataaatcccagaaaactctaggaactatagaatcaagcaaagtatttaatgaaattttatctggccccattttatattggaatttattatttaaaattagatcttctcttctaggcttttaaaatcatttctaataattccaattaaacaacaattcatctccatctctgcatgcaccatggccatcgtgtttatcttccatatgtagccccaaataagtggattggtcatgaacatataaacgcatacattatgaggtagtgtcgtattcttgattagattaatttggcacttgttatgaaacgagaccacctgtgggtatatgatatgatcaatggttatatccgtcgtaggcatggtcacattagatcttcaatatgctgagttgatagaagggaatctaatatgataattatggattgcttcttatatgaaatacagataaaacttgatgaatggatcgatcagtttgttagataataaaataaaatcccgacgtttagtttataaggaagaattaaatttttatatattactagcataaatgctcgtgcgttgcaacgggtgaaaacaattttaattgtgcatattaaatggtccgtttttaaagttttgtgcccgtcaaagaattaaacagctagtaaacacatgataaaacaggaccgacaaaagatactttggcaaatacgtactgtcaacacagatgagtagtaagatatattgggttccatgcatgagctatatattatacggagttgctagaaatatggcgccatatgctacagtcgactttttttcagccacttacgcagtagttacacctcatttacacctcacttatatatgtaattagtatgtaattttcaaatttacattacatatgtaattttaagacttacattgtaaatacactaaaattacatatgtaatttagggacttacaatgtaaatacatgccgactatttttttataaaaaatatagcaccataaatatagctacacccaataaaaattgatatatggttggtaaaggtcgataaatacaattgatatatggttgtacactaacgcacgcggccccatgctggacctgcagccggagcttggcgatcgaggcctggtcctaacataacatgcggaagttgagcaggaaacaagcgcgcggacgtagatatatcctactccctccgttttaaaatgtttgacaccgttgactttctagcacatgtttgaccgttcgtcttattaaaaaaattatgaaatatgtaaaactatatatgtacatgagaatcaaatgatatgaaaagaataaataatttcttaaattttttgaataagacgaatagctaaacacatacttaaaaatttaatggtgtcaaatattttaaaacagagggagtatatgcggcctgcgggacagcgggagttgaagcagcgcgcgcggacgtgaaggagagaggtcgatcatcaaaccgctccagcgggtcgtcgaagccgtactgcatggaaagcatctccgtcgtgttcgccggcccccgccaccgtatagtggccgtcgtacgatgtggcctgggtgacatcgatcgaggacggacggcgatgatgacgtatgaggcgtgtcgatcggtcgcgtcgcgtcgcgccggcactggctgtgatgacgcgctcgactatcttaattttgatcgatgccgctagcccacagccattgtctctacccaccagatgctagccttcatatatatatatatatatatatatatatatatatatatatatatatatatatatatatatatatatatatatatatatatatatatataggggcggagctagagtatactagggggtgtccaggaacccggtcaagaaaattttttagctatagatcatctattttcaccatgtatgtatcctctcaatacaaacttaggcacccgcatcagcttaaattcgatctagagtagaataatttaagtaagtggcaccaccatccatttcgttctagctccgccctgttaatatatgcgatcgcaaccgcagagcgtcagcgtacatcctaccacgccttcaccgacatgaacaccatcaccatcaaccagccatcgctgccgttgccttcttaccacacccatcaagaccttaattctctctgcttctcgatctatatagatctattcgtggcagcgggtgcatacgtacgtacatacaaaggagatattgttggtggaggtggagttggaagaaaaaacgatctgtgtcaggctcgtcctagaatcacaatcgatgtgtgagagcgcgtggctcgcgggaaatcgggaaccgctgctcgtatcggctgtaagcctcacctatacaggctgttgaaagaaaggggagaacgcgaccaagtgggcttagggtctgacgtgatttattccgatagatggaaaaaaattaaactatatcggcaagtttgcgattttttgtgtccgacacgatctcgcggtgacgtacgaaaagcctcgacaaaaacatcttaaatttttataatagtagagataaacaagtgctgtaaaaaatactgacatagcaacttttttttagagaaattgtaattatttaaaagtgtggtaggaataatccgcaatctccgcccgataatattagaatacaatatggctttaatgcttaataccacaatgtaaaatattttatttctattgacagcgcatagcacgacagtagcacgagctagtacacgttccgtgttacttagtacttcatttgacaatgtgtatgtccatgcatgttgcagaatatacatatactaatattagcatggatatatcagtatatgccaataatccaatatctacttgtcctttaacaacgtgatatatatgttggtcttgtataccaaagttactccatcttgacttttagatatgttgaaatccctcctttggtaacatttattcttttctcatatatactgcatgaattaaaaagcacttgtcattataaacaaaacagctcccctaaaaaaaatataaacaaaacagctgaattatatgagtagttactgtagaaatttagcatggttataggctcttttgtggaaataattttgtggttgacgacggtttacctcaggcagatggagccgggcaagagtagagaggcggcacaccacctacacacaagtcaatcatgatatgtacattagttaattagcactactcaacgttgcacttttaaaacatataaatctataaataaacaaagtcctagttagaactgagattttaaacttgatcatttggacattcgtttggccccgggctttgtacttccaaaatggacaaaaaaaatcgggtgtatcaaaattcagaaatttcgaacgaaacattttgaaatttaaacacattttgactgaattcaactaattttaaccagattcataaatatttttaaaaatctaaaaattttggatgaaatagttgcatgagaggggaggatcctaaattcccaaattttggaattttcggaagttttggaccgaaattttaaaccctgtattgggcctatgcctatctcttggattttaaacaagagagggagcccagcgcgcggcaaaacaaaaattcagaaattgagaatttaatttacggagacgagtgttatattattacagacgtagagtcaacttagatgattcgaaaaccgtctgcattggacttctgcacacgccacgccacgccacggcgcggcgcgttgattgattttacctttctcgttggcgcaggtggagatgatgtccgccggcggcgagaggcggcagacgtcgcggaggagggcgaaggcgcggtcgacggggatgtcgacgccgatggcgcgctccagggtgtggttcacgatgtggcacaggcacaccgcctcccccttcacgatggacgacagccccgcgcagcacccctccggcgccgccgtcgccgccttgtccttgaagaacggcaggcacgggctcagctccagcagcgacgccacgcacgtcgtcgccgccgcctctgcgccgccgcccgccgccgcgacgagcaggacgaggaggacgccggcggcggctgtggacttggacggcgccattctagctaaatgtggattagagcttgagctagcttaattagctttggttaattggagtgatgggagtgtgtgtagatgaggctaattgcttgtgtctatttataatggctgtgattaggacttttgctagctaagagtgttctaagctgttgtagtgaagtttgagctggatcaaacatgaaaatggtgtgaatgatcagaaaagtttgtaattagcaatgcttaatttccactgtttttgttttgctgttatgtcttcctgtttttttttttctgtgcctgccctgaccaaatttattaagattgagagaaggtaaaacattttcaacaaacatactccctccgtttctaaatatttgataccattgactttttagcacatgtttaacctttcgtcatattcaaaaacttttgtgaaatatgtaaaactatatgtatacatataagtatatttaacaataaatcaaatgatagaaaaataattaataattacttaaatttttttaaataagacgaacattcaaacatatttaaaaaaagtcaatgacgtcaaatatttagaaacggatggagtagttattaatattacatctcttcctatggataaacagcactttacatcgaacaaatggaagcatacacgccgggttggctgccggcattgcaattaaagttatttcttcagtttgagatatttgtaaatgttaatttgcaggaactaattaaataagtttgttggagcttctagaatgtagattaattgtggctatgtgatcgaaatattctctacgaaatcgatctaaaatgtggtgcatgcattgtgcgtgtgtgctgatttaagggattgtatcgtgggagcacaaaacaaatgccgttcgttggtttcgctacaacccaacttaatttgcatctattaagatagtgaccaacctaaactgattaactgccatcattgtttttatatgatacctttattgtggattttttttttgccgcgccgggacaaagatgcaagcggaattttgtaaaaagaaatttgaactgaaccaaggcggcacaacaattataatgttatcgaaagatgtatgttccctccgttacaaaataagctaaccttgtacagtgtaggtaacattgaagatatattcacaccgtacgagtttggtttatttttggacaaagagacgagtaggtaacaacatttcagaaattttagtgactgacccgtagtgtcactcagtgtatttggaactcatttgtgtggcaaaaacatttccgaatgattcagggttttaacccttgtgaccacttttcaatccaagtgcaaagacaatagaaaggtggctggtatgggtgtacctattcagtgatcgtctgtcacctttatttctagtggacgaccctttcattggatgccatgtgtcatggctaaaatattgaactgtcatttaaattattaagtattaaacttctgttaattgaaaatatactgaggccccgtttggctaatgggaaagggaaatcatttcccacccactaaaagacatctttaaattttaaccatttattctccttcttccatttaatcctaacccttcgttcatttcccaatcccaattccaccacatatttcccattatccaaatacaacctgagggttttaaccaaaattcactttgaactgtgtaaaaaaaagaattcactttgaactttgagattgtcaatctcaacttttcaactcggaaatgaatcaaatgattcgcgtttctactcaaaattgcaaacttgacttttcaactcagaaaatgcttcaacttcctactcgaaattgcaaccttaacctcaaagcccagatgtgtccaacgtgaaaacccaaccatattattctcaacacaaaaaccaaaaaatagaacacctaatccaagggccgactcatcgttgataatcgtaataagtatacttaaggttcctcatctttccatcaagtttaaatatcatatccctacacacaatactaaaatcctaaccccaacttacgaaactggactaaattaggtcctatgacactataggtggttggttttactgacgtggcatcctagttagcaaaaataaataaaaaaccatggggcccacgtggcaatgcctgcttcattcttctctcctggaccctggtgatggggaggcggtcgggaagaagcgcaagacgtagggagagcgcattcacgaaggcggggacagatgaggcggtcaaggtgcgggctgtcgccctgaggggtggctgagggagtcggaggcgggagaggaatggagaggtggtcggcgagcccatccaagctcaagctcgcccggcctccatgcgagggaggtggacggaggagcgtgagaggtagtcgaggcgcgagctactaccacgctaggctgccatagagggtagtcgagggaggggaaggcggtcagcaagctcgtctgagctcgtgctagcttggcctccgtgcaagagaggtggaaacgagtaagggagggggttgcgcttgcgcggttaaggagcaatcggacgatggaggtattgtgccagagtgcatgctgaccacggcaaccggttgggtccccgtgggctctgcccccctccccccccttcccccctcctcctatctcgaatcgaccgagcctatgacaatgtcgccggctatctcccacatggcgaagatgagggaacggaagagaagaaaagaggagaggtgaagtagaagacggcgtgtccacttcaagttaccagccctgatccaacggagcacgtcgaagcccagcgcagcacaccagatcagttaccagccaacaaataaggcccattttgacccaagaaataaagcccaattttgcccggcccatgcatgcacccccagcttccacgtagacccatggctgccaccacacccatatccacgtgcatatatgcttgccagctcgtcccttccccggcatccaaatcctcgtacacgccatcccctcgccatggatggcatggccaagaaaccgacgagctccacctactcccc

SEQ ID NO: 60835 - DNA, 10148 bp, Oryza sativa
ttcccacatgtttcttcagctgactaacgtgaaacacagggtgtatgttagcttcttctggcaactgcaacttataagcaaccttcccaatcttttccaacactctgaagggaccataaaactttgctctgagtttcaatgatcctctcagcccaaaagcattctgtcgatatggttgcatctttaggtagaccatatcccctaactcgaattgtctttcactcctgagtctgtcaacaagctttttgattctggtttgagctttggccaagttttcttttaatcttgccaacatatcctccctctgctgtacagttgctcttgcctcttctgaaacatttccaggtatcgccctttccccaatatgtggtggagttactccatacatggcctcatatgaagtgacttgcaatgatgtgtgataagaagtattataccaccattctgcagtaggcaaccatttgtaccattctttaggctcctgaaacaccatacagcgaagataagcttctacacattgatttaccctctcggtttggccgtcagactgaggatgataggaagtactaacccgcaatgcagtacccattgctttaaaaacattttggaatagttcgctggtaaaaatcctgtctcagtctgacacaatagccactggcatgccatgaagtctgtatacattttccatgaaaacttgtatcacatcttgagtgtcaaaaggatgagacatggcaacaaaatgagcatactttgttaacctgtccactactactagaataacatcttttccatgagattttggcaacccttctataaaatccattgaaatgtgtgtccatgccatctcaggaatttgtaaagggtccaacaatccaggtacatgaatatgttcaggtttagctatttgacaggttgggcattcagtcacctgtctatccacatccttcttcattttaggccaataaaaaatcttcttaagtttatggtatgtcaccttcattccggaatgccctccaaaggtggaattgtgaaaggattgaagcagcctttgtctgatatcagttgattgtcccacataaattctgtttttatacctcagtaacccagattgtaaagtgaacccctctgctccttcattcagttcctctccagttactaactttgcatatttctcatcgcccatgtagttgttcttcacatcctccacccaagctggatataccagagtgattgccaagcacttgtctccatcagtatccctcctagacaatgcatcagctgccttgttttcttttcccttcttgtactcaatactgtaatcgaactccattaatttcagcaatagtttgtgctgaattccttctgttaatctctgggttgccatgaacttcaaactttgctgatcagttctgatgaccacctgatttccaagcaaatagtgcctctatttcttcaaagcttataagatagcaatagcctccttttcatatgttgaagagctagctgccttcttccccagagatttgctgaaataagcaatgggtctcccttcttgcatcagtacagccccaattccaataccacatgcatctgtctctaggacaaaaggttgattgaaattgggtaaagccaaaactggacaggaagtcataacttctttaagattgtcaaaagctttttgctgttctacaccccattggtagctgtttttcttcaacagatcatgaagtggtctgcatatggttccataccccttcacaaatctcctatagtatccagttaatcccaagaatcctcttaattttgagacatttttgggtactggccaatccaccacatcctgaattttactaggcttagttgcaacaccttctccggacactatatgccccagatattctatacttcctacagcaaaagtgcatttgcttcgcttggcaaacaatttatgtgacctcagtatgtttagcactatgcgcaagtgctgttcatgttccctcagatctctgctataaattagtatgtcgtcaaagaagaccaaaacacacttcctcaaaagtttgccaaaaatttgattcatgagagcttgaaatgtagctggtgcgtttgtcaacctgaatggcatcaccaaatattcaaaatgccccatatgagttttgaatgctgtcttagggatatcaccttccaccattctgatttgatggtaacccgaccgtagatccagctttgtgaacaccttggcaccattcaattcatctaacaatcttctatgataggcatagggaacttgttcttgacggttttggcattcaattgccgataatccacacacatcctccaattcccatccttcttcctcaccatgatagctggagatgaatatggactgagactaggtctaatttctttagaatccagcaattccttaataatttcttccatagcatttttctgttgatgtgggactctgttgggtctcaagcttggaggttctgctcccaccttcagtggtattgcatggtcacaatccctctttggaggtaaacccttaggttcagcaaatacgtcagcaaactcttgaagcaaaactgctatctattctggtataatggtttcttccttcttctcttctgttttagacaacacttctatgaagaaacccattatccccttatcaagcatcttcccaaattttccagccttaatcattatcttctcctatggaagagtatgatatacaaatttaacttgctggcccttacatgttacctaaagaactctctgttttaggtccagactgattggactatggtcataaatccaatctgcccctaaaatcacatcaaatcctttcaagggaattaattggaacactctttcaaatggatgaccttgtacagtatatgacaactgctcagtttttgtggaagaggagatcatacccccaccagctaccagtattcttctattgccagcttccaaaatttcacacccactttttatagcaaaatcatagttcatgaaagaatttgtactcccactgtcaaccaatgttacagccctccttcctttaacatgagcaatgagagagaaagtattacttccacacatcccctgtgctgcttgtgtagatatttgcatcaactgtccctcctcttcttccttcttagctggactaccaggagctgtctggtatccagtctctccattctcctcctgagtttcttggggttcctattcttctttaacctcctccatcatatgtaccaccttgccaactttatatttatgttggtaattccatggttccttgcaataccagcaagttttcttttctttctccaccccttgagttgtgtttttctggttgacaaatctggtaccactagactgggcaggctggaattgaggtttgtttctattaaattcagattggtagcttagtctcttagcaatacttgccttctcatacaccttagcataccaatatcctgccaacaagttctggggcttttgcccacatacatcatgcttaatgtcagccctcaatcccccaataaaacaactcaaaatgtaagactccgtcaagtaaggatgatcccttttcactaaagaaacacagtcttcgaatttgtcaatgtactgcattacactaccagtctgttttgcattctgcagtagttccacagcttcatgggcattagcttcagtaaaacgatctaaaaccattagataaaattgctgccaatttagacagtaccagggtatggccaaatttctaaaccatttccctgctcttcccactaagtgtccagatgctaaattaacccactgatccacaggggtgccagtcatctcaaaaaacttttcacattgttgcaaccaccctacagcatcctccccattgaacaatgtcaattccaacctctgactcctcaatgacatttcagtataagggtttggtatgacaccatgcaaatatctaggtggttcctgccagtacatacctcctcccgggtttggcatccctgctcttgtgcctacagcagtaccccctggttgcctagttggatatctccaaggctgattagtgtcaatcccataatggttcatccccacatcctcttgtgactctctctcaggaaaattgaaatttcttctctctggtaacacatgagttctagtagcagtggtgaaaactgggccaaaagatgggttcacagtgtttggttcaatttggaagttcacatttcctacagaagtcatggcaccctgtgtttctgggcagaaaggatgggattgtcacagttgaggtcatgcttccagcattaacaggatttacctgagctcccgaagtcagtggcgtcgcaccagccccggtctgaagtccagtggtgttaggtcggggactgaaacccggtggtactgaagaacttccagccactgttgcagtattgctcaccgttgctgctgctgaagctgccaaccctgctgccccccttgcaatgccactagtactagctccagccgttcccccaaatccaggtccttgactcgacatactcgcacagatactgctcagaagtcctttaatttcacccatttccaaccgcttcactctcggatccgccatctcatgcctaatctgtgtgatttcagcacgaacatcaaactccccagcgctgtccaaactgttgggggatctggttcgcgcaggcatcatcgattgactgacgaaatcggctcaaggaattcacagatccctctccccttaagatctcgccgtctaggtctaccgccaacctgagtaggaatcccgagctccggagattttacagagaacacacctgcgtggttctccaaccctcgctcaaaacaccttctcctcgcttctcctcgcctccggttcgatccgcccaagttccagggattttacggtgagaaatccggagatcctcccaaccttcacttggtgaattcgagagccaagaatcgggctttactctgatacccttatcaaacccaagaaaattcagagccaaaaaatggaattctcccctctctcacaatctgttgggcaccgcaagactcggaaaaaaactagggttctaagctactaagacaataatttggttcttgttgcccttctcattagtctcgctgggttatatactcccgagcggatccaaagcatcagttttaacctcatacagcttagattcagcattcaagtaaaagtaaacgagcataagctcttaaacaaaaattacatgacagtggataagagaacagcgaatcgccaccatcgaatcccgctgtaaatacgaatcttcgcatctctaccattcattctcattaaatgacgtcagccaaacggtatcaccattcttcagactttcttcagttatctctgaacttttcttcagttatctctgaaatctccacttctgacacggatccgccggcgaggagaccggggtcaccggatccggcggtcccggcctcctcactaggagatccggcggcttattgggagggagcggcggcggtagcacagtagaggagagggagctgcggcgacgacggcgcacacgagcgcaagaggcggcgaggttgcggtgcgagctgaggaggtgggcgacggcgcacacgagcacaggaggcgggcgaggttgcagagcgagcggaggaggttgcggcgcgcgcgtagggagaggagaggacgggcggctagggtttgtaccggttggcgaaatccaggccgtccgtccataatccgacgatcacacgggtaaggaagggccggcacagcgggacatgtggacggccagatcgaccctacggtgagatcagacggtggaaagaagcgaggactggcgcataattaaccgaaagtgcaggggtttttttcgcaaaaatcgatgatgtggcactcctactcttccggcgttcccacggcttttaagtaaacctatatttgctggccaatttgttgatgattttgttctctcacatcgagaaaacacgcgtgtgttcttgtttcaaaacaaatactccctccgtttcaaaatgtttgacaccgttgactttttagcacatatttgactgtttgttttattcaaaaacttttatgaaatatgtaaaattatatgcctacataaaaatatatttaacaataaatcaaatgatagaaaaaaattaataattacttaattttttttgaataagacgaacggtcaaacatgtgctaaaaagtcaacggcgtcaaacatttcgaaacggagggagtatatttttctttcagaaaagataacttgttgctcgtattgttgtctgagtaatcagctaatgctccactggcatgcgtactcttctgcttgtgaataggcaccgagatttgttattgccgttcaacttcgtcatatgcttagtccatggccacacctccatttttttttgtcctccgccactgcttctgtgtaatagatgagatgactctcctgattaaattagtttgctgatgcatgtgttcatctggtcccagtttacccctaccttgatgccatagagtttgccttttaattaagcaagtcattttgcaatgcattatctgcatgctgcagtttagccattattgtgcatgcaactatcagcaggatggccatgctaataatcaaagacacgagagaccaatttttctgggattcacgcatgcatgatatggtatgcagatataagagcaagtacaatagcagactataagccagctataaacataattcgaggaaataaaaaaggagagagaagagcagcgggttaaagatttgtagccagctgcaactatatttgtgtatgataggtgaaaccagacattattaattgtgtaatatatgtttataggtaattgttgtatgaattgactattaagttgactatagaaattttgtagccaacaattggctatactattaaacttgctctaagctgatgcatccacctattgacagtgtgtgatcagtccatgatgggagggggagatcaacctgggtttatcattaccaatgccgcagcgcactgatgtgaatcatgtgatcgatgatgatcatgaggtttcttacagattaatctccctggaggcatcggggacaacatggtaatctctactgctgtttcccaggagatctttggccctttttaagtcctaacgtatctaaaattatatgtatgtaatatgtgccaataaaacatggcaggctgagagagagctcgcaacaaatttcctgttgcaggacaagtttgtcgagatgggatgaaaggcacaggtttgaattcattctcttttttcaaccatcattctgctcatttgccagtggtttggaccacatatcatcttgcattcttgcacctatggtatgcttccgagccaagctgtgttaataggaccacaatagtttgatgcacctgtagaaatctgctgttgcaagcatgccctgctattgtgaagttttttaattaattggtgattgtcttaaatttggttcaacaatctaaggggctatgggtgattccgtaatccatatacctaaattatccatgtattttttttcaggaccattgtcatgataatattggcattgcattggcaatattaccatgattatatatattggaaaatgaattatctttgcctgttcgtcacagggaagctacttgcagcaggtgaaaacattaggagttcagcgtgctgaagaatccaaatttgttatggtccttagttaagtgactttcagtcttagtcgatcttgccgcgtggtattgtatacgtatgacagattagcgtgtccttttttactttgctagaacacatttttttgcacattattcatggtgtaatttgcgtgacagagttgcttacattttattatgttttgttctctgttccctatattgacattagccattttctactaaacacgcaacttggtcaataatacaactatgtaatactttatgaattgtctgaaagcttaggtgttgttagtcttacgatagaaaagccactatgctctcaggcgcatggtttttcctactccttccgcttcatcttattataaagtcatttaatttttttcctaaccaaacttatttaagtttaattaaatttatagaaaaatatgtgcttaaacaaatatggttcccatcggatggcataatcagccaaagaaaaagccaaattttgaatttttaaacttaattttgagattgattttgagacattttcaacgtagcttcttttacaatattggcttttaagccaccaagaacacatttataaaagtttcacctacaaattcatttttatttcctaataagccgttttagcttataaggaaataagccaaacgatgggacctatatttttaaactgttagatttaataaaactagtttcatattttaaatattgttaaattttttatgcatctgatcaagcttaacaaagtttaactacggaaaaaagtcaaacgatgaaaacaaagtttaattagaaaaaagtcaaacaacggaaatggagggagggagtatcgttttcgttgttcatgttatttcattggccacgccttagtgtttttcattgacctcatccgctaaagttaattagttatagttttactatcagtacatgctaaaatgtcccaaaaaaagccaataagcaatacctactgttttgactttagtaacttttgtactccctctgttttaaaatgtttgacatcgttaactttttagtacgtgtttgaccattcgtcttattcaacaaatttaagtaattatttattctttttatatcatttgattcattgttaaatatacttttatgtacatacatagttttatatatttcacgaattttttttaataagacgaacggtcaaatatgtgctaaaaagttaacgttgtcaaatattttaaaatggagagagtacctttctgtgtgagcggcgacagctcacatccccttctagttaacgagtaacgactagacatgagacaaacccgacgctgcgtgacgtgagtacgtgacgcagcgtcgatgcccgcgagagagagcaatcaaccgtccatatgcctccctcccttccccctgcacgcatctccatgcgctcctccgctgccgctgacacgtgggcccgccatgtcagtgagagggagagggcccgtgagtgggtcgacctatatatgtcgctcttccactccgcctcgtctcgcttcaggccttcagcttccattaatttccttccgtgggtttgcgtgcttctagctccgcttgcttgtctaccggccatgtcttcccgcggcggcggggtagggggccggcgcggtggccccggcggcgccagcagtgtccgtggcggcgagcgcggacgcaaacgcggtcgaggtgctttggacgccgtggagccccgcgtcccgcttccacggggcacgggatccggccctggggctggccgggacggagccgccgcgccggtgccggcgctgcaaccggcggaggcggatgtgctcagcggcgaggtggagacggagatggcggccgggatggaggcgcgcgagggggcgtcgtcgtcgtcgtctgcttcggcgccggcggtgggggaggtcgagccgccgtcgcgggcggtcggtgcgctgccgccgacgtcgagcaaggcggtggtgctccaggcgaggccggggttcgggacggtcgggacgagctgccgcgtccgcgccaaccatttcgtcgtgcagcttgccgacaaggagatctaccattacgatgtactccatcccggtttcgctttgtattttagtaactttttttattaagttgacttctagtacaagaatggattttaaactctgcatgtcacatacaatttctttcatgtcgtcgaaacgattataaaaaaaattcaagataaaccgagtttagttccaaactttttcttcaaacttttaactttttcatcgtatcaaaactttcctacatataaacttctaacttttcttttctgtcacatcatttcaatttcaaccaaactttcaattttagcgtgaactaaacacacccatagattaatatgtagtaatagatcattccacgac

SEQ ID NO: 60836 - DNA, 2147 bp, Oryza sativa
agggggggcagcaaatcagcagaaaaattatcatagatggaaaacataccagatggaacatgtggttgctgatttacattccatgccaaggaataaaagggaacatataatttataagtttgtattgtccacttgctatttaaattcagaatatgtagattattttaaagtaatgatattatctgaatatcctttttccagaatatgcagacacatttcaggtttataagcttggaaaaaaaggcactaacgaacattccatcgttggtcaaagaatcccatcatagatcaactggcctaaaaaagaagaaaaataagtgtttcatgcatagaaagtggtttcaattttatatccatctgttggatattaagacaaaacttgaaggagaataactattccacattggttccagataattaattacatccttttcatgagaaagcaacaattaacaattgcttttgttccccataacacattgggccagctgtacttcccaactatcatgaacaatttgtttaaacaaaaattagcaataaaacacatgggacattattcaaataccagtatgtccactatcattgtcagtaagttccaaacactgtcaatggattgtagttcctacactataagaactacctcatccaatatcctagtatccccaactggttgtcaataactgtaagcctacctgaccatttgaaataaaatatttgatagttttggaacacaggtagctgcttaaatagtatatagtcttcaatatgaaatgtcacattttagcaatatgactatgcatgtagcatgttaagcatatttctcttatcaataactatttcaattctaaacaaaaactacaacatgagtatatgtttttctttattgcctaaattcacacacctcagatgagataccatacttcccaaaaatgcattagtgctcgtacagagagaacctagctagtatttcttagtatacctctagctaagaagaggaaccaaattaggcgacaaagactaatgcacctcgtgcaagctggtgtataataaaaaaaagtcccatggctacagcataggacaatctttgttaaaattccagttctaaataggttacaatgacttcgtatgatgttcaaaaaaagtaattgattcgtatcgaggcaaaacaaaacttacatagatatgttccacttcatatgcactgggagggatacctgcatctggagaagcttataagcactgataaataaagaacagtagggcatttagggcatttatagtatggtctgaaaggctttgagttggatctgcactattatgtttcttgtgtacataatatgaactgaatcagcccaagaagaactttaccttggcaaccaaagagaatcattacatacatgtcaaaggtatcctaagcttgatataatgaacgaaagccccaaatcgcataaatatgccctgcatcacaaatgggaacaaataaacctatcaacaatatcgttttgccctccaaagctgtatatgcaattcctaactgaaacaattaatcacagcatagagaaatttgagtagcagcgtgtgttgtttcaagctaaacagtttgatcacacatgacagtgttgaagtacatgcagagggaaatttctccacacaacctacacactataactgaagaatgccatacacattaaaagcaaatcaagactggcactgtaactaaatcaaggcttacacattagaagcaaatcacggttgtaatcatcaacaactaaggtccaaccacttccttctcatggccctatggcactgagctagaacgaaaaggaaaaaagagaacaggaacgactaggcagctattgtcgcggagccgcagctgtcttcatcgtggtcctggccaagccgacactctcccttcccttctcatggcactgagcgaggctctcatggagagggagaggagaagatggcagtggcggcggcctactgactccgtctaggcagagagggacaggagaagagggcagcggcggcgccctgttgactccatccgggcgaccgattcaactggaggggaggccaagatcgatgaatcagacggtccccgagccatatttgacaccgcaaagagggagcggcggtggcagcac

SEQ ID NO: 60837 - DNA, 4284 bp, Oryza sativa
gccgcccgcccgtcgcgtcaccgcctcgagccccgtgccgccgcgccgtcgcgtcgccactcgtcgccgtcaccctgagccccgtgggccgccgtcgcgtcgccattaagccggccacccccctctccttcttccccctcttccctataaatacctccaccccctccccatttcttcccaccccattcccctcttttctcctctcttcctctcaaccgcgccgccgccttcgtgccgcagtgccgccgcgcttggtgccgccgcgccgtgcgtcgccccgccttgcgccgtcgtcgccgccgccgtcgtcggtaagccgccccccccccttgttcggtcgccgttgccgcctgggtaggcagggagccgagagggaagggagaagccgggagggagagaaaaagaaagaaaagaagaagagagaaaaagaaagaaaagaagagagaaaaagaaatggaaaaataaatagaaaattagagagagattaaggaggtttagaacatttaaaataattagaatttaattatagattatttgtagtcgtagaattgcaaaattttatataattatagattatttttggtaatctctataactaatcaattcgcggtagatattcggatttaattactaagagttgtatttttcgttgaattttaaagaagatacttttaaatcgcaaaatgacttaggttgaatgagcttaaaattggaatagcgtggtttcgcaaactttgtagtcgatatagaaagatcgattcgcgttcgactttttgagtttattggatttttatttgaattctaattgaattcaaatcgtttcttcgcatgtaattttagggcacaagggagttgcggatccgagcgaggatcaagacccgcaggactacgagcaaggcaagtcatcactattctttgaacatgttgatcccaattgcgaaattgttctgtttacaaataaaattgcatgcaatgatgaacatcctacttgagatgcggcatgtgcagacatgagcgccacattgccatgaaattgatgacatgatttgtgaaaggagaaataaaactaaacaactattttcgactggggcggacggaggatttgggtgatatctggaaaaggctagtaccgtccccggtcaattaaggaccgagccatgaagttaagcatgaaacgacccccgtacaatcgtacatctcgaatgggtatagacctagcggattagatagccgagcagaggcagtatccctgcatagatggttcacccctaagtgaggcatgtgcgctaccgtggggcagccgttgaggtagggccacgtggcgtgctcctacatcggtgtcgctattggtaggactgccataagtgtgtgtgagagagaacttaacttgaaccataatttaatatgtgtgtgagatgtctctttcccaggagtgccagaactcctctcactgctagaaacatggacgcctagagtgcatgaggatttaagttcatggagtgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccatgcttgcggttattgagcaccgggacgtgtattacacttggctagactcaaaattcttaacttgtgtgggagggaaggtggacgtcctcagaaaaccatgacgactcaatggcgggaagctatccttgggatcacaatggatggtggacagaaccgtcgttgtttaatgtgaacactggtactaaaatttgatcagtctatgctaggttttaggcttgtgaaaagaattacaaaacttgctttgcgcaaaagaaccatagccattccttgaatacccgctatcatgtacattgttgttgtgttggcttgctgagtacggttggtactcacccttgcaatatacaaacttaatcagaggttggagatgaagcttcggaggatccctacgcttactaccaggagggtgatgaagacgatggcgctcagtaggtcttagttacggtcgttgcctgtggcaatggtgtgccgctgccttagctccgctgccttatctacttctgcttttggaatgtattccggaccattcggtcctatgttctatgactatgcctgcgggcctatgatgtaataattcacactagaatctcgtgtatgtgcacttggtatttctgctatgaactcgtgtgtaccagactacttgatccagggaaatggtactatttacacaattgattcctgttatgaaaacgggggtccacaatctgtatggcccatcacaggtatctaatcacctgtgacgggttgagaatgcaacccgtcacagctctgacgggttgcattctcgaccgtaaacgggttgcattcacaagtgagtagatacctgtgacgggctatagccggatggctcactaatgacggcatcccgtagaacccgtcaaaggtaaccctcatcactgaccaacacttatgcccatcacaggtatgcagtcaaaggggtgaggatatggtgtagtgtgatcatttgcctagccacaagatatctaaaagtagtgaaaagataatacttcttaccactagaatgcaccacgccaatacgcaattataagccgtcagatctaagacagatttaatcccaactattaaatcaagaatgaatctaagagctcctttgaatgcaggaatggaaaaacaaaggaataaaaaaacacaagattctgataggaatgtaagtgcaaaacagacgattgctaaacacaggaatgaccattatttgattggaccgcaggaatcagacgagagataaagattcattcaaaggataatttctaagatgttaaagcacttactaaattgtctccaaattctctatacgtttgtccatttcagaagcattttaaaggatatgatagaatttaatcctttgtttaaagatagcgctattccgagcgcaagagcacggaatattgtttcgagcaccgcacatcatgtccagagtccacagaaactggtgttcggttgccacgttcgatctgtgtagattagttctatttgaattcggggtaaatcaattacagatccgtaaaattggtggtcggatgaaaataatcgttgtaattggtttatctctgtttccaatcgaggtagttacgatatggtgtgcaacaaactgagaccaaatcttgtagtaaacgaataaccgttgatataaataaaaattgatggtgcatgtacctgcagtaattggattaacgacaaccatgcttggtaaaatcttgtagtaatcgagttactgttgacataaatgtgcatgtgcttgtagtagttggattatgaataacattggttgatcaaatcatgtagtattcgtattactgtcgatgtaaatgaaaattgatggtgcattaacttgtagtaattgcattattgccagccttggttgatgatttcttatagtgagtgcatcaagcaagaaaaaaaggaaaaataaataaggagggagttactggggcctaattagtttgccccaaataacacgtgaatcaattttttacttatacattgaatcactccatcctaaatcacgggacaaaaaataaagattttacatgcacatcatagtaaaagcacaagaataaaaattttacacacaaacacatcaatacacgccatcgccagttcctcgtgacggctgaatggagtttttgtcctggtagtgagagcaagaagacaaagcggtagagatgcaggctggagccgaggcagcaccaagtctggcctctacgacctcggtaggagccggatccggcgacggagctaaagatggaggtcgccgttgccgttgtcaccgcctcactgtcataaactgggcaacgacagaggtgatgaaacaaatcacagtttcttgccgatgttaccaaatcgattgaccatcacaaacatgatctccgccatgcaagggagaatagagaagcacgccaagctgagtgctcaacccaatcgaagtcagactgcatagaatcaagaaggatatagaatttaattaatcatagattgtatacaattcttgcgagaaatcaagaatctcattaggaattgctgagagaactcaccgtccccatgacgtccaccttgttcgccatgggccagacgtctcttcagctcgatctgaagcagatgctgcggcagcgaggcctaaa

SEQ ID NO: 60838 - DNA, 1457 bp, Oryza sativa
tctttggaaatttgttgacgaatcaatgcttctagttagtagaagcgggttacatacttctctcacgtatgacgaccgggtggaatttattagaaaaaaaattgacagtttcaacttaggttagcaacttttggtgcaacttccttgtcgatcgtacttttgtgatgacgtatactgccgattcttggatgtctcaaacaacttcaacacgagccatttatttttatgcaggaggcacgagccattcttttagttagattcagtactttgagcagagtcggcgagagctctcccagagaaaaagaaagtgctctttctgccgctccaatggcttcggttaccggtaactggaggtggagtatatatcgtctcgtagtagggtttatccaattcttctttagagtgtgtttattttacgctaaaattgaagtttaattgaaattgaaacgatgtgacgaaaatgttggaagtttatgtgtgtcaaaaagtttttatgtgatgaaaaagttaaaagttctaaaaaaaagttagaaactaatccatgccttagttatttgccggttcctgcgtggtgcaagagattgtcggcatcgtgttgtcatgtcccatcatcaagccatggattcctgctatttactttcgtggcttttgggctacagattgctcagattataggtatcccatacccacataacatggttatccgactagttacaggggataacttatatctatggaatatgtaatagatcatgacttgggtaatacgtttccttatatattatggaatggcctttagtcctggtttgataatattgtaaagtagatttaggaaactgataccgtattggttaaggtttctatcttgtaatcctgcccccatcctatataaggtgggcaggatgctctctagggggcagatgacatacaatcagatcgtcagatctataatacactcggcggattcaaatccccaaataggagtagggtattaattctcattgagagggcctgaacctttctaaatcctttgtctttgcatccctccacttttaggtctcgtgcgctaccctctttatattgctgaaatattgtttcgacagttggcgcgccaggtaagggcttcgccgagtttctgtcacggtctcgaattcgtaggagagattcggtcgagtagagaaggaaagagattgagagagatggcttgaggaagaagaagaaggagaagatcataacagaattgaacaggacagagatggaattgaatttgagtttgtttgattacatgatttgatccccttcctctcaatcgtgccggcttatatagcatcgaactacacagtctctctcactcactgacagttgcctagccaattactactgggtccacacacttgcagggaaacgggagttgggctgcttctcccgtctaggccgattcataggctgggtcactg

SEQ ID NO: 60839 - DNA, 2990 bp, Oryza sativa
cctctccccctccccctcccacccctaccccaccccgggaccctaacctgtagggtcctttatcgaagtctagggtatcaccggcgcgggagaagacgaggaggttgccggagttggaggagaaggcctggagtacgaatctcgaaactcatccggtggcccaaaatctgcaagatttggggatacaatttctatccgcatgaggttagcaattctgtttaataaatactctctccatctacttttgataagcatattaacaaatctgaaaaaattatttttgatagacatatttctatccaacaacctatcctattaataactttctcggatttaatgcgtgactctctattcttccacacaagatttactacatgggcatcgagaaatgtaaatattaataaatcgtttgtttacgaggaataactagtaacatgtttaaatagatgacaagtagaattacttatcctgcaaggatgaaatagagtagatggggaagtacaatgaaaaaaagacaaaattccgatcgtaagggtggcgccgtaaacatgtaatatacgtggttgtttttgcaaaacgtccatccccctcaccaagcccaccggccgcccctccggccccctccctgccgcctcgcacgctcgcatgggcgccgcccccacgcacgcgccccgcgccgtcgcctacgcctctcggcgcctcgccgcctccctacacatagcaagctgccatgacggagggttcgacaccgatcgacgccgtggcagtggcaccactacatgcacacgcgcgaggccgggtgacgcgtcggcgagcggcgccgctatccccctcccggcgaaaaaggtaaggcggagcgccgcccatctggggcttggttgccggaggggaagggccgggggcgggccgcgactagctcgaagtccagctcgtgtgcgttgtttcctactttcctgtgctagcttggctgccctctttgccggcgtacgttggccctaccgcttcttctgattgctctgcacttctctgcttgctggctactcggggtgccttgacttggcggcggattcaggccttttctgtggggtcagcacagctttttgaaaaccatcctataaatctcgattttcatgtataaattcaaaataatttagagaaatgcctcacttatagtaattgattctacaggcttaaatttctggctccgccgacttactatctttggttggtgaggggatcgggtcgtgcaagcaaccccgcccggcggcgtagtgcctcgtcggacgaggcctggccagagcaacgccattggaagcaggtgttctgttccctgcatccgtccaatccccagccgatcctgtacctcgcatctgcatctgccgtacgtccactccgttcactctacttgtttattcgttcccacttcattaacaaagtaactgttgtcggttccaatcctggttcttgcatatgcactaacattttgaattttttttttccaggcttgagcatccacagtgtgttttgtttggttctaatccttatttttcttctgagttctgggcttctggccttttcaagaacagagaggtggcatcgctttgttgtcaccagatgagttgaaacagactttgcatttctgacttctaagtctgttagcaccctttttttcccatgttctagctaaagagtctatgttcatgtcccgatttgtgatttttgtgtccacttgtgcatagccatcataattcgaagacttcacaatccttaattcgaagacttcacaatcctgaaaaaataatcacatgcttagtggacatgtatgtagccttttctcatctgaacgacagaatgatcttggttaatttatcttgtattgttctcttagtttttaagtgcaaacaaaatttaacacttctttattgatcatctagattagccgtctcctctgttcgcaattcttgtttcttcattcctactacttggacaaattaattgttgccagttctaattcgaagactgctgctctacgtagtcctatattcagatatgtgttctttcttggcaggggcacaaacttccgcttccacaggttaagcaccagagaaggtctaaggtgtagattgtatacaaacaagcaataaggccactaattttatagtatgcttgcagatcagtcagatggagtattgtagtagtattttgttgaaataaataaacattctaggatatatatcattttgtagtcattttggacaacatcactaggtgaatggatgtagtaccatttttcaaatgtcaaaatggaaatataatatatacatcattttgtaatgccattttggtttatggatgtatatagatatcaggatatatcattttgtaaatgtcattgtggaccagtgaaatgagaataaatcatttatttcctgaaaaatgtcagtatggagatgtactccgtagtataaatttcctgtacaaggacacctcgtatatttgatattttgctattttttagggggggggggggggaattggttattttattcttcacccttttttattattatctgaagtcagtgtttgtgttttggaatgtcttttttgacttggtcacccttttttttggcagatattcatccaattcttccataccaacacatgcacaccattgttacatttcttttttcatctcttgcagctgcccttctgtgcaggggcggaggactcggttgggcaagggttggcgcgcgccatacctcgctcccgacgcgagtacccccacccccgatggcgcaccacacggctgcaccgccgcaggcccgtaggcagtagagtcactgccgaccaagagagctaggggtgacggcgagcatgcggcgcgggcgtacagcaccgtggcgcgccagtgcagacgcaggtggcaggacgtagatggtcagctcttgaccggctcctgccatggcatccacggaaacagcaagaaaacg

SEQ ID NO: 60840 - DNA, 2089 bp, Oryza sativa
  unsure (1)..(2089): unsure at all n locations
agtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggttggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagcgccgccgtcgccgccgtgagtccagcagtgcgccgccgccgttccagacgtctccgtcactcgggaaggtcgtcgtcgtggtcgccaagtcgtcgcngtccttgtcngcngcttcgtcaccgtcggaaaccgccggagcatcgtcgcngtcgtcaagccgcagtccgccgccgttccttcgtcgtcgccgtcgccgtctgttggtcttccgccgctcccttggtcgccggtgagttcgccgtgccgtccgctacctgttggtgccctccgttcgtgccgtagtgccgccgttcgccggcgagcttgcgccgtccgagctgggagccgccgagccgccgccgccggtggtgacgtcatcgctgacgtcatcgtccccgtttcccgtgagccgccgtggacccgatcgatctcggccgtccgttttggatcaagtcgatctcggccgtccgttcccgtgaaccgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaatttcataactaattcatcttagctccgatttagttggttcaagtctctaaatttttctaaaattgagatatacatattaaaaatatccacatgtactgttcatgcttgttttgtgctgttttggtgattttgctcttttttgcttagattccgtcgtttccgaagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcctttttgttcttgattactttattccttgataccttgggttattataatttgactagttgagctttgtttatattggttcaactagacgtat

SEQ ID NO: 60841 - DNA, 635 bp, Oryza sativa
gtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgatt

SEQ ID NO: 60842 - DNA, 109139 bp, Oryza sativa
  unsure (1)..(109139): unsure at all n locations
aaatcacagggaaaaaaatgtgtgcttgctcaaggctaggaaaatgtcaagacccttgtttgaatgccaccttagtttttaacagcattgaatgacaagcaggatatgagtctaggacggaaggaaatggtaaatacataagtggagctaaccagtaacaacccagcggtcagaacactgcaaatgtatcaaggtgcaattatgattttttactgacatgaatgaatttctaatgtggacttcaagctttaaactaattgggtatgacttccccctgaataactttaggagcagttaaatcaactaactttggtcaatagcaggttgctgactattattcatggtcgggggcctgtagttcattgatgggggaacttcatcaagtccaatttctcgttcaagagtgctcctgaactcccttgaaacatcctatatgcggaaaaaagagacacgttacatatgtatcaaggaatcacatcagacaagtcacaaaccaacctgtagctctctaatggttggctggaaagcacgcaaagtcttccccaaattcctggctacctgcatacaagcaagcaagtgagacctaacagttcgtaatgatagaaaggttggcaggaagtacatgctcattttcattcacagtaaaataaagcagaacaacaacatgacatatttaaagtgaagaaaacaacaacataaaatatttcctgcaaggctttttcttttctgtatgtagtgtgtgctttcaaacctttgcagaaaacctaccacgatctggcagtacatgcaacaggttaagaaactataggcgattagaatatggtgctaatgctgagggtttagtgaagaattagctagaataggaagccggacaacagcaaaaatatgatgtccaggtttgttgggaaagagtttacctctgctagtcctttgggaccaaagactaacagagcaaccactccaatgaccagagcttcgggagctccaactccaaataaagaagcataaacacccgttccacgacttgttcttttgctctctacattgaagaagtcaaagaaacacaaaggctgtgagatgcctaatttggcaaagaattatggaacagcacgatacgaatacaggcatagtaaatatagtaaagggaatatccttcatccagctatataaagcaggaaggtagatgggcagttatagcggcgaagacaaattagatgggtataagaaatcctgatctcttcctttcctagtctttagctttcctgtttttcatacaaagatggtagtgtgttgacgtctaattccagcccaagagaaaatttgtagatgaggttaggaatggtagttatggaaacgaaggaagaagtggcgagcagccaggtgatcccaggcattttcccgagcttatggtgggcagcagctgagcctgagcagcacaaggacaaaaaatgttgaatgccgcccaatttgtgcactgtatagagcttgtgacaagagttgctatttccatccaagatatgatgaatacttttgacggatagtaatacaaagaataaggagtacaactaaaaggtaattagatactactactaaatgaatccaaacaatcaaatcaatcaatgaatcgtctgttggttgtgggagagtacccgtacggcggcggcggcggaggaggaagcggtggtggcggccggagacgaaggataggccgagcgtgcagtagggctgagcgagcgtgagcctcctcctcctcctcctctgtgaggaagggaaaggggaaggggaaggagtgcacatggcgacgcacggaggaggtcggagtagcaggccagcgacggccatcgccggcggcgggcttcgaattcgattcgattcgtagggtatatgcagctcactcgcaagtcgcaccgcaccaccacaacacaagaagagggaggcgaacgatagagggagatattgcggcggcgcccgacaacggggacggcgtaagggggaggcggaggtggcggcgcgaggggtggcagaggcggcggcgctcggtggcggcgccggagagggagagggagcgggcagagcgagagggtgcgagcggcggcggataaggtttgggttagtgggtgttattttgccaaaaaacccctactcttttctcattttgcagagcggtcccttttcgcccccaaatactgtttgtaatggcctatatataattacagaaaatcgaaggtctttttcgaaaaattatcgacccacttctcccatggctgggagtactaaattaaacaaattgggtgtaaattgtgaaacgaattttttaagtttaattagtccatgatttgataatgtggtgttaccgtaaatatttactaataatggattaattaggcttaataaattcgtcttgcagtttgcaagcggaatctgtaatttgttttgttattagtctacgtttaacactttaaatgtgtaccgacatacccgatctgacatgtcaaaactttatactactcgatctaaacacaacctaaaatttaaattcctgtcacatcggatgtttggacactaattagaagtattaaatatagactaatgataaaacctattttataaccttgaactaattcgcgagacgaatctattaagcctaattaatccatgattagcctatgtgatgctgtagtaaacatgtgttaattatggattaattaggctcaatagattcatctcgtaaattagctatcatttatgcaattagttttattattagcctatatttaatacttttaatgaaggccaaacattcgatgtgacatgtactacaatttagtccttatatgtgaagttgtggggagtcatctttcttggtctctgcctctctggtgcttctgatggaatattgacgaggttctatcaacgagtttcctgaagtaacaatgtggaaatcagttttctgctttaatacacattttaactcttatcgctagatatttaatatattactccaaagaaagcagttaactgtagtgctaacagattaagaaagagaaaccggttaacatgaaaaataaacattgaagatatcttggtcggccgaattacccctgaactatcgtggtcagccctgaactatcgtggtcagccgaattaccccctaaactcgaaaaccagacattactcacaacgaactttcaataccggacgaattacccccctcggcccaatccagagcgattttgtcctacgtggcgtacgcgtggcaatccagtcagtattttatttaattaaaaaatgtgggtcccacctgtcatactcttcccctcttcctctctcctctctctcttctttctctcttacagggcagcgcgcaggggtgaggaggtgggcggcgatgcagggacgggcggtgggctggaggaggtgtagcgccggcacctgccggcggtggtgtcggtggtggagggtgccgctgcggaggccaaggcggcacgaggtgaggagacggcggcgagagatgaggaggaggcggcctcgctgtgcggccgcgccgccaccaacagaaacctcgccgcggcgcgctccgtcgcccacgcggccacgccgtcggcgccaccgtcatcaccaacgaacacgacgcaggtctgcgcgcccgctgcagcctcgtcggatgcgtcgcctccccggaagacagcctcgccgtcgatgaaggtgtcggcagtggagggcgccgccgcgcggaggccgagctggggcggtcggctccggcacgggaaacggaggcggcgcgagacgaaggagggtcgccgagggagctcgacacggcagcgggatcgtcgattccttcccgcgagatccgtcgtgggctacgcgcacaccctcaacgcccctgccatgcccgccgccggcctcggggtctcacctgagccgagaaggagagagacagagagatacacacagagagagaaagagggacgacatagcccgctggccgcctcgcctcctcaccgcgcgcgccgcgtgcagcgccgccgcgccctccccgtggaggactcgtctcccgctgcctgcctgagctgagaaggaaagagacacagagagcgagagagggagggacgacctagcccgcctcctccaacgccttcctcggcgccggcgccgcgccatcctcgcactctgctgtcgacccccgcacgccgaccacccgcctgctccaggtgcgtcgtcgtcgccgccgcccactgcctatccacgtgcgctggagagagagagagagagggggggtagaggggaaaaggggtaatgacatgtgggccatatttttttaatttctttttctgattggatttccacgtcggcgccacgtatatgccacgtaggataaaaactgctcaggattgtatggggggtaattcgttcggtatcaatagttcgaggtttaatatgtccggttttgtggtttaggggagtaattcgtaccgtcgcaatagtttagagggtaattcgtactttttccttttagtgatgaaattttcatgacatcataaaaatttccgcccaaacaagccatcatataaatttacatacccaagattttgactgcttatctttattctcttgtacagtgcttgctgccaccatcaagttcatcattatcaggaccaacaagatcaacaaaggtaattctgctagtctgtgagctgctgaagccatttgatgagcaaccctgtaatttggttgaacaaagtaaattcacaagataatgacagcatgtatatatatttgctgatcagttagtggaaactaatagaattgaattgactaaagagcatactgattttttaaatgataatactgacataactattgcaataagagaagttaaatatagctggttatgaggtctccaaacaacagaagaaataccagaggtttaatttaccttgctccatgcttcaatgacacaagtgaatattatatgagaacgtgaacttttcaagttcatactggtggtgccaacttttctgtttggaaggccctgtaagaaaaacaagctcagacaagctatcaataacgcttgagcaatggtaggcttcaattcagattttaatctctatagaggagaaggcagtgactcagttattagaaggacaacatgaaacaaatagtttcgaaagagcatgatacaagtagtaatatatgcgatcttaacaaaaatacagcttgttatcaagacaaaggtctttgtgactacagggtagatcaagcagaggtcctggttgtgatcctcatccatgcagaggtgaaattgaaaagcaaagaaaccctagttttaaaagcaaaaccgaaaggacaatttctttctgctactcttattgatcaaaattgtcccactgatgtgcctatagaggaaaaaaaaattttcgggctggttttgttggattactccgtgccataaaaggataaagaagattttctgaacaacttgacaaatgccttgctatgtttgctttatttatttattgttttgcgaactctccttgctattttctgacagaaacttgcagattagtgcagccacttcctgaccaaagctgtaaagcatcactggctacaaagtacactgacaatgcaatgaattgaaggtcattttgattataccttcatcaagatctgattgacgtcctcaaccgttgactcatactcatcggtcaagttctcaacatggacaccattgcaagcattctctcttatctagaataatggagctgaataagtttaatgcaatccattagcaaacaccatatacaggattagaatatacctaaagttacgctgagatggatccaacaggtcattaatctactcattatatacctggaaagcattgagcaaaatttgcatcatgtcagatatagaaaccttgttaaattaactaaattcagaaaaaaaattcacatctagatgcacttttcagttcaattaagaacacgcagatgagtcagtactcagtactcacctcaagaaacgagcactggcattggtagcttgtctgcttctccggtgagatttctcgcctctgtaccaggaataaacagaattgtgattatatggaacaactagaattttagaattttcaggatataccacccaatacgcactgttttccggatttatcacccaattcacactactttcagaatacactactggagtgtgaattttcttcattccgggccactctgtctaaccaaagctacacatcgtcagttcatcccactcgcgccgttgcccacacgcatctggccgccggcgagctcgtcctctctcacaccggcgagctcctcctcccccacgcgcgcgctgtttggctgtcggcgagctcgtcctccccacaccagcaaagctcctcctcctccatgcggacggcgccatatatgcgcgcggacggcacgaagtagcagcacgagggtgacctctggcgagctcgctcgtatcgtccccaagctcaaccgctgccgcaccgggctgctgccaccacgccccgagccatcgccggtccaatctccgccaccgcagcctcgagctcgtatagagctttgccaccggagctcgacgccctctggcctctgccctccaccgctgctcccttctcctccggcccaccaccacgtacgccaatgacggcgacgaaccagcgacggcgcggctgacgcgggcggcgatggacgggcaatggcgaggctgacgcgacggacgggcgacggcgcggttaacgcaagcgcgagcggtggcggactgatgacggtggcgccgggaggacggaggatgatggtgtgactgacgctaggggatggagtggcccggaacgaagaaaattcacactccattggtatattctaaaagtagtgtaaattgggtgataaatcctgaaagcagtgcgtactaggtggtataatctgaaaattctcatggaacaacaggtttaatcaaatttctcccttaagccttggatttgagcaacgagattctggaattcgtaggatttgtgcaagagcatgcagaattgcaggaagcttagattcaacccgaactcacaacggtgggccgcgttgaggacggtggaggcggcagacgctgccaactgccaactgccaaggcagggggctatggcgacgtggcgaggagtcctcgattccgtgcggcgcgcatggctcctcctccacatccgccggcgcacagctcctccttggtgttcgccagcgagcacggctccacctgccatccctgtcgtctccgccacgtttggctccgcgccacgccgcgcccacgatgccggagggaaggagagagagtttagtactactccatatgacatgtggggcccatgttaatttttaattttttattttttattggattgccacgttagcgctacatgtataccatgtaggacaaaactgttccgatctgccacgtgtacatatataccatgtaggacaaaaccattccgatctgccacgtgtacacgtaggatgaaaaccattctatattgagtagggggtaattcgtccggttttaaaagtggttttaaaagtttagggtgtgaaatatctggtcaaaccgtcgggatccaaaaaacacgtatcgacgaaacaaagtgcatctaaagcactcctctctcaactaagtgcacctaaagcactcctctctcaactaacgaactatgattgaaacctcgaagtaatccctctcaactaacaaactatgattgaaaccttgaagtaaaccctaactttttttcttcgtctcaacccctcatctatttatataaaaacttgtaaaacttttattaacaataggactcaatcccttaatttccaaacctatacattttccgaaactacagccggactgcttataaaccaatcaaactcctgcgcgaaaccgactgcccgtcgatctccgtttcctgtcaacacacgtgcgcctcctctactgaagcttcacgcatgggccatctcctccacgcgctgacccttcttccaatgggccagcaaatcaccaagcaggccgtcgctcgtctgggcctcctcctgggtcggttgttccagcacaagccgacgccaacacaacagtatagcacacgcaagtacgcagcacatgcatgcaacgagacatgcatatgcaccacgctacagtaccatgagtactgtagcaaccatatactccgaatttcctcaaccaatttccttcgcgaacaccgacacttgcatgcacacctcgtgaagcctattacgaagatttctcccacacgatgtccatccaccgtatactatatcgtatccaacttcgttattcggtatccttgaccgtctggacctcaactcctccctgagtttagtcctgatccccaccgttgaccaaagttgatcgacctctaagaatcctgactctagtcaccttctcatatggtattccgaccgcactagacctctactcctctctgagcatagtcccggtcctcaccattgaccaaggctgacctcaagtcacgtgcacataatcagataaaacaatcgtttctgggtacagatatcacaacctgacccacattagtcacacgcactcacaccaacatccacacatcttttcaaaatcaattcattgattaaatcatttgtaaagccaatttattcatcataaaatattaaacatgacaatgatttcacaatctcccccttgatgaacatattggcaacatcaccaaaatgcaattttgtatttttgaaaaataaaaacaaaaatcacaaaagtgaaaagaaaaactctccccctttttaaaagaaagaatttctcccatcaatttataatcaaagcacaaaatcgactatttttacaatcaaaacaattcaattctccccctttcaaaaagcattcattttgcatatttctccccctttgacaatgatttcatcaagaatgcaaaagaaaaaaaataataaacaataaagtacaaatgcaatgatgtcatgattgtcacttgaaataaccaattttttcttttctattttctaatttttttcgagagctttgaagtgcaccaaaagcaatccatgatcgtgtgttgcaagacaaagaagataaattaattagccagttagcaagcatgcatcataatataaacatgaatcaaagatattacaattaagcttaaattagcaataaggattcataatttcaaatgatttataatgcaatatattcacaagcacatagattgaaaaataaacactatacatatatacctattacatttatcactctttctcaaattaactttagtacaaaacaatcaagagaatttttaaacttttttttgagcctttttgctcactttttttctctcaattattccgggtatgtccttgtcgtcaagactgtttccaaggattcggcactcattatttttgctcacatcgaatatgtatttatcgtcatgactatttccaaggattcggtattctttttttttctttcatagatattttttattctcttgcacaatgagcaaataaaagctatttgaggaataacaattcaataaagcatatacataagcatttataaatcaatccatatgctatcatcaatattgcatattttattaattcaagtaaaagaattagtatcatgcatcatctcacttaaaagcaatatctaagccttatataaagactaaaacgcatacaagctaacattgcaacaaatatacctcaattattttgctagcatgcacaagaatatactagaggtataaaacaaagctcttcttttttttatttttatttattttcagaattaaaagcaatgcataaaaataaacatgaatgcacgaaaaagcataaactccacctcaaattaacctctaattctccccgaagaaaaatcaagaagaaatcaaagattttgaaaaagacatccaattgccaatgatatcaccaaggttctcatgaattgacatgtatccacttgtattaacaaaaactactatctcaaacactagcatatgaaaacctaataatcaagaaagtagaacaaaattatgtcaatccaaaattatcttgatattaccttgaaaagcactcaccatctcaacgttgaacgcacatagggagtatgccaccaaaatacctacgaacaagaaaatgtcgaggcctccatgttggggttagaaataaaaaattttggaatccaacactgagtcacacgaccagtagaaccaataggtacatatgcactaacaaaatcagaactaaacttacctgaaaacttaccttgtcgtttcacaaaagtccgatttgaattacgtgcaaaatcgcccggaagccggtttgaccaccgttgtccctgcggtctgaccgggcctggcatctagtctgaccaccggttcaactgcgatctgaccgctggccggtctgaccgactagtcagtgtcggtctaaccgtgctcctcgaaccaaaacccgatttttgccatcgtcgttttgcaaaagcaatttctctttcctttttctgtttacgggcaagtcgaaaacaaaaactaaccaaatgtgcatcttttccacaaaaagaacaaatataattctcacaacaagtttgtaaagtagatggttttgaaagatttgtttttgtttcttttaaagttctagaaagagagggcaaaattccagcagacttaaaaactgttttcttagcacttggttttctcaaaatttcaccatgttcagtcacactcaaaacattgggatgatttttggtgaaatagttatgaacatcaaaaccaacacccctattgtaactagtcaccttagattgatccaaaatcatgttgagctgtttcttaccatcagaaaatctttgcaaagaacttttcaaataagaaacttctttttccaaattagcacaattttcacaatctaccattatacttttgcttttacaacatttggggcaagaaagcacttcatcagatttcacaatattttccatatgctcaaccagtcctaaaacatctttcaatttcatctcattcaaaaaacactttgaacaattttgagaaaccaaaacatctttgttttgtttaatcctttttgcacctaaaacattgaacaaagaacttgcagaaaaagtaactttgtattttgtcaaaatgttctttgtcaaaaccaattcatcaacaacacaagcatgcaaagcaaatccaagaccaaaagaagactccatttttttttagatttttcaatttcatattccaatttcttgcaattaatagaattgacatctcgcaatgcattaatttcagaaaataaaacttcacaagatttgcaatcatcatcattaggaatcgaagattttaatctatcaatgtcagcattcagaatctcaatagtgcaatccctctcatcaagcatattagaacatgttttaagtttctcagcaaatttgaaagcaatatgttctaattgatcataactaagcttttcttcactatcacaattagatccatccacattaatttacattactatcagattcatcccactcaaaagaaaattgtgagctttgcaattattttcaaattcattttttaaaacaacagtattaatttgattaggaattacataaggattagaaacttttctccaaatattaagatcataatgtaagattgcatcttactacaccaataacaaaaatccgttccatcgaaaacatggggcttacttataaacttattagccattgcaaaaactttagatcggtaaaaatctaaagaagaaaacgagctctgataccacttgcaggatcgaatactaactattgttgtattttcttgcctttttttttctgcaaaattgtgtcattctgtctattcatcttgcattttcctgcataagtcgacgtgttctatctattcatcttgcattttcctacataagtcgacgtgttcgtgccgtgggaacatgccatgacatgccagaatacttaagtcgacatgtcttaagtgctctctttaatagtagttttgattttctatacgtaccatgccataatgactgttatgcagaaaacaagaagatgattaggtaggatttcgttttctggccttttccagcattgtgccgttatgttttttttctatctttgttcaggttgaagttttgtttccctctagctgcattttcctaaattctgcattgtcttatgtctatgttgaaaagtacctattactatattttctttaacaaaattatccaagcaagtgctaaataaatatgagaattgctattactacattacattgtattctagcacacctttagggcccctttgaatcgtatgaatgaaaaaatagaggaataggaaaaacgtattctaacaggaatgtaaatgcaaaacagaggattgcaaaacgcaggaaaaacaggaatgaccgtttgattgaaccgcaggaaaaatgcaggaattcgaatgttttcaagaggttgaagctcttgctaattttcctccacaaaatctctataggattgcccattccataggaattttaaaggatatgataggattcaatcctttgtttcaaatggcttcattggaaattttcctgtaggattcaaatcctctaaaattcctatgtttttccttcaaatcaaaggggccctgagtttctttatcataaaaattaacattgtattgttcatcatgcttggattagccgccgaattacatttctaggtgtggctggtggggttgtgttgctaatctatgattaaggtcattttttttatgattattgttagcagtgtcactagatgtttctattatggcagtgtcactagatgtttctattatgtagacacgacgtattgactttttgtctgcctgacattccgctcaaatgatttagacatgtatttagcatcaacctatctaagtatcacttgattgtcagtgatttatcacactgccctagtagtagcaatataagtgggaaattccgctacacgcataaaatccatatttattcccacttgctaatttatagaattgtgataagcggaagaaataagcttgcccacccacttacatcttttaatgtagtatggtatagctatgttataaccacaccggctaaaaaaatgcatatgccgctacctactggatatatttatattggcttataggttgcatgatatttttgggaggttctagacttatattattcttaaatatctttgaagagggttctagagagcatgtctagcacactgaggagtatatcttagttgtgttatggattaatagagtacactaacagatatgggtaaaagtacatataggtctctaatgagttttggattgttgacgacaagaccaattaatggattgataggtttattgaggataagtgaatgtattagtccctattgtgattctgataatgtataacgacatctacaaatgaaagcaacattaaaaattaatatcgtattgttcgtcatgcttggattagccgtcgagttacatttataggtgtggctggtggggttgtgttgctaatatatgattaaggtcgtttttttcaggatcattgttagcagtgtcagatgtttgtattatgtaggcacgacgtattgactttttgtctacctgacattccgctcaaatgatttatgcatgtatttagcgtcaatctatctaaatatcaattgattgtcactgatttatcacactagccctagtagtagcgatataagtgggaaatcccgctacacgtataaaaaccacatttattcccacttgctaatttatagaattgtgataagcgaaaaaaaataagcttgcccaccccacttgcatcttttaatgtagtatgatatagctatgttataaccacaccggctaaaataatgcatatgccgctacctattggatatatttatactggcttataggttgtatgatatttttgggaggttttagacttttattattcttaaatatctttgaagattgttctagagcatgtgtagcacactgagatagttgtgttatggattatgtagtatactaaaagatatgggtgaaagtatatctaagtctctaatgagttttggattgtattagtccctattgtgatattgataatgcatgacgacccctacaaatgaaagcaaggttaaaactctcaaggcatttacattattttttattttgaattcgagtcataggaaatgccacactatggagaggtgttcgagtcaacgctgacttttgtgtctgctcaatgttactttgatctttagagagagacgttgcgcaacacccacatgggaaagatggggttcttatagcttccatattggaacttctgatagttgaaattggaatctccaatcatagctctatgcctattgtggagggacgatggaaagtcccggtggagatcattggaagttctgatcagtgctcctcgccaggacagaggattgatcggaagtttcaatcccctttctcacaatatgcgaagtgtggattaaagttctgatcaatctaatcaaaacctatgatattcaaatatgtgagtaatgactaatttcgcggtaggtcaagtatttaaatgtttccatccactctttggaaggttagctttcaacctttcagacctatcttggatcatgagtatctgttgatgcgaaaacacgatggcctcgaagatttgcttaacttcagtgtaggtccaaagcttcaggttcagggcatgccagttgatttgatcctgcaaccaataagatagactatagcaaacattagaagatgatagccaatcagctgatgttgtatctgtggggacacccgataaagtcatggtgcccccacgaatacgtaaccgcctaggatgttcaattatgcatgaaatgatataaaagcataaacttcgattatacattacttaagtcacttagttcacaacacaacataaatacaaaccattacatatatggcctataaatccttatttctacaaacagataaactactagactccaccacaggaactgcctgatcatagaatgacctagaaaccatagctgtcccatctaacaagtcaacgggatctccacaagcatcttcctcctcatgatctgaacccatttatgaatacaaaaggtactcaacaagacatgcttatgatagcaaatacaataattgcaatataaaacatgccatattaagagcaggaaggtttaaaccctaaccttaacaattatttcatagagcctatcttaattatcatttgatataaacaacactattgaacatttaatcttaaaaataataacgggcataaaaatataaatgttacttataaataacttgaatagaacatcaagtaataaataagttgaccatattaattaatagccatttagtttaacttgtggccacaatctggtatacccatagacacatctccattaactgggagcacgtcgtattcgaatactctacgactctgcagcgtctgcccagctttacccacacgatatccacaggctgaaaagtaacaaggtgtaatattgctccatatatctctcttttctgcttagtaagttaaaggatgctcgggtcgttactcggagtgatccggtccgaggtgtgtaccaacctacctccgcatccacttaccattgttcgttactgggtggacagcccagaacttcatgggcccatagggcagttctaaactctcgggcccatcaagcccacatatataaatcatataaacataaaccatgtcactttgcttcacacttgaaatctaatggccagtacaccgaaaggcctatagaagttcaatcaattggagcaatatacggctaggttcgacaaattgatcgtgtggatgggcgaaactatgtcattcttattgacacaagggggctgattattatatcaattttaaataagaaataaccataaatatatccatatattcaacacgaccataaacaggtccataaaaccaaacacatgaactctatcatgtgtaccacccactcacaagcggtgtcaacagttcttagcatatagctattaacaattccataagcatgttttcatatgcgataataatatccatattaaaccaatagcatgctaaataattaacagtttgttaagtgctcctcaaattttatcctaagcgttttagactctaaggctctttaatgtgtccataatagcaacagaaaatataatgcaataatagcaatataatttagaagcattcgtgcagtctatcatactccaaaggacaagtacggtaccaaaataactcactaactactgggattaaattgttcaagggagggtgcatgtcttgcaaccttcgggctcgatgtagtcgtaggaccaatgttagcgttttctatttatgcaacaatcaccatcacaataaataatagaaaaacaaagttaaacataacaaatggtatcataaagtgcaacgatgggtggaaaggattttaaagatttaattttagggatttttggaatttcggtgaacgacgaaccctaggggtaaaattagggtcgcgtcaacggttgctcagattgcaacgaaactgacacggatggattcgggataattctatgagtttaaaacaggtctcggattttgattttgaggtcaaacggatggtcaacataataggaaaagaaaaagggtattttctgatttatttttcaataggataatctaattttcttttcttctctcgctctgcacaggaactggccggcatctccctggcgccggcggtgaagatggctggttttggacaagggggcgccggttttgcggtctccagggtgcggcgactccgttcccgtggtcggcgatggcgaggctggcgacggcggccaggagctggaggcggcggcggcgactccggcgaactccggggtgggcggcgggcctggtgagcatcaatggagtgagatgagtctcagggtggcgacggccgaagctagggtggcctggagcagcgcgagcaatgcagccggcggcggccgaacagggcggtgactccgggaggcagcgccggcggcactccggcgacgggctgagggggaaaagagaggggaaagggagtactcatcatggagattccatttttaccatcaatttcagagggttggcgatgtatgcgacgaatttcggagattcttttaatggcgccggattagggtttcggggattttttcccccgacgattgagtccgcgggagttggggcggattcgaggaggtgaaagaggttgaaattgcggttcttttgcctccggtcttgtcacacccggaatttctatccaaaattccaaacgcttacatgtgtgtgaaccctcgtccaggaatcagccgaggcacacaataacaaattgataatagagtacaattatcactctaattaataagcgaataaaatgtcattacagaggtagatagttgctctcaatcaataaagatctaagcagcggaaaaaaaagataaactgcgcagacgactccactccacaggcagcttgaccagggctacacctaatcttccacaccatcaacatcactgtagaactcctcctctgatgaatgattgcaaggtgagtatatgacatactcagcaagccacgcagcaaatatgcaagtgcacaggataacaaaggatggcatagtatagtcccatttgcataaacaacatttaataaatattttagaatttaataaaacagttaaatgataattaaacaatattaattcaacgttatacaacataccctgttgcataggcccaaccattctgaacaaccaatcccggctgcacagttctatctccaaaccaggaattaaccattccaaaccaggagctaatcaaattattaccagttatagaatcttttattatgattggaagtgtgagactaatcacgaaagacattgttagacccgtccataaccgcgggcacggctattcgaatagttttacactggccagaaatgtaccactatacccacaagacacagccccacgacatgtcaccatgcgcctcaataccaccacggtacctcggaaaggagctgtgacagtacccctcgcacaacacaatccaccacagcgcactgttcctggatcataatcgcccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcatgaccatcaaaaccatgtgctcacaacccaccattatcaggttttagttggcaaattaattaattaaccaatcatgattaaccatcatgagctatcattaagccatcattaaataatagtgagtcaaaagttatcccaatagtgtgctaatgtttctaagcatggctaagcaatcatatctgatatctagctgaaccaatatataaagctcaactagtcaagttataataacccaaggtatcaaggaataaagtaatcaagaacaaaagggctataacaaacaataggttaattccaccccatgacattcgaaaataaatgcaatagttgaatagaaacaatagctttaaatgggatcaacatgctcaaagggttgtttgggatctgtgtgacttgccttgctggccttggaactcttcaaaatcttctcctgcaaactcagactctccaggaacgtcggaatctaaagagaaaagagctaaatcaccaaaacagcacataaacaagcatgaacagtacatgtggatatttttaacatgtagatctcaattttagaaaaatttagagacttgaaccaactaaatccgagctaagatgaattagttatgaattttcaatgattaaatcagattaaatcatttatatggattttaattgaattatgacgcaataatgcattatttttgaaaaggaaaagggtattattgcgtcagcggctagggttcgcggtggatcgggtgcacggcggtggctcacggaaacgaacggccgagatcgatcctatccacaacggacggccaagatctaacggtctacgaccggtctacgacggacggcaccgatgacatcggtgatgacgtcatcaccggcggcggctcgggcgcacaagctcgccggcgaacgacggcgcgacgacacgaacggaggacaccaacacgtagagggcgacgcggcgaactcaccggtgaccaaaacagcggcggaagatcaacggacggcgacggcgtcgaggaagaagcggcggcgaccttcggcttgacgacgacggcagtgctccggcaacctacggcgacgacggaggggtggacgagatcgacgacggcttggtgaccacgacggtgacctcctcgagcagcgacgacgaccagagcgacggcggcgcatggctggagctgcggcggcgacggcggcgacggcggcgcacggctgcacggtgctagggcgctacagacggcggcaggcaatggcgagggtggcgacggataacggagacaccgggggtccttttataggggctaggaggcggcggcgaaggcccacggcgaccggcgacgcgatggaaggtttagggttcggaggagagagatcgatccgaatcgaactcgaatccacggatttccaaaccgaattggcgatcgattccaaaaggaaaaaggtagaggagatcccgggaatcatttcccctctattgatttcaccagagaaggaaaggcgcgtccgaatttggaaggagacggcggcgcggcttggttagggttcggatgcggcagcggcgcgaggtagacgaagactaacaggcgggccccacctgtcagcgggcggacgcgcccgcgcgggcggcgctcggctgcgggccaacctgggccggggaggagagagagagaggtttgggccgactttcggcccaaagccaaaagagagatttttaaaactttttccaatttaaattattcatgaaatgcaattccatttattaaaaatactttcttggctcaaataaatcccagaaaaatctaggaactatagaatcaagtaaagtatttaataaaattttatctggcccaattttatattgggatttattatttaaaaaaaatagatcttctcgtctaggcttttaaaatcatttctaataattccatttaaacaacaatttatatatttaggatttttagggtgtgacaggtcttgagccttttagtggagggacgaaggagatacggaggcgggaaactggaggtgtcacggcggcattcttctgtcgttcgtcctcgtgtgtgcgcgtgcgagtgtgtggcatcatgcgtgggctggcacgagctgggcgcaaggcggcacgggtttggcgcgaggcagcaggagaagagaagaaggaaaagaaaacagagagagaggggaaagaaaaaggaaagaatagaaaagaaaataaaatagatggaaaaagagaattaaggtaaaattagagaaaaagaaaatatggggaaaattaaaataaatagtatttgaattgttgtaggctttaaatggttttctactcgggatagaattgaatttggatcaaaaagaattgttcggaaggtgagatgcacattgcaaccgaattaaacaagaaataaacactagaaacaaacatggaaaataatattttaaataaactactaactcgacggttataattttagagaaccaaagaaaattaaatcggttttaaaaagttgtcaaaatttagggctgttacagtatcgtatcagccgatgcacgaatgaatcgggtataggtgaataggatgctactcatagactagctttagattgaatataactgtaaacagcttttctttaacaggaccaatctcataggtcgaacctaatcgatgtagcataagattgaagtcatttattatacaattatataacctaaatagctagccgatggacatatatttataaactaggcccaacataactacaatcgactgtagagataaatgacttgtaattactaatttaatctttctcttaaatacaagcaactatgatagatcggacataatcgacacaatattaattgctgatagccaagatcagacaaattaataattatatggatttatatcatagccggtgaagtaacttaggtgattgaagataatcaaatttagattaaagaatataaaatttaggttaaatctatttaacaagctgtaatcccaatagatcagacctaactgagaccgcacggaattgatggcaagtttaatagatttaaaggtttgataaacttatataagatgacagatataacacattaagcgaaagacaacttgcaatcttaaagcaaaacaattatacaggtaagatcagctgaaactcgatattacccctaccgacaatcaatgagcatgttaattcttacaacttcaactacaaattagtaggtcaaacttaattgatgcaaaaccaagttataattgaaattataaggtccaaacatgcttttgattgtgttaacgaccaaatttggtaatatcagtatcggagatgaagatgaaatcgaagcagaatcgaagataggggttttttcggaaacagagtaagaatcggctggagtccggatcggctacgactgggatcggctaatctgagttggactggttaagtaatacagccgattccgacaatatgacccgtgtgcgagattgggtttgagttgatgtgcttcaagatgattgccacgcatggatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcgggtataaatagaccccgagccctatgtaaaaaaaaacacaacacacatccaatacaattccggcgcatcgccaccttttgctttagttttatttcgacgagttcttgctttcaggttgagctgcaccggtttcgatcttcaacaagaggtaaaactcgtcgtggcgaattatgttcttagggattagtgcttccatcttcatgacattctaatctcgtttatataattcgccgagttatcatatatcttatataatctctagcaatatcgctatctaacccacaatcggctaacatctattaacagacggcagccgattgggttaaatgttgacattgatctagattatataagatatctaccattctatgaatcttctagtagcttgattgtctagatatcattcttcttttcatacttaatgctgcatcaattgagtttgatctattgagtcgtgcttagaatattgatctctagcctgccacctagttgtcgattagaatagcatcggagtttcagccgatcgtatctgatttaactataattatttcagtttgcttcactgatatgttaaatctgccctttatgccaagatattgctgtatttgaatatattaggcgtttgcttgatattctatgcctgttttaatatcctgacataaggtagtatcggggtatttgccgatacatgctagatctatatgatcggctatgctgtaagcttatatagtcttgttattagtatatatttcggtctaagtgattcattctgtctcggcatggcgacgatctatcccagtcacttgatttaagtatatatcgagataaggagtatatatcgctaacatctacagccgatcaagtaggtttagttttcttccttatttattcacgattgtcgatcgatgcacagatgacatcggctcagatataaatgatatgtcatcggtaccaaaccgatcggctatcatttataggtttaactatggttcttttgtctttatttcttgttgattgtaggatgaaatcaactggcacgctcatacatccgaaggcaagttttggacctgcactggagttaagcagatctcccaggcctcgtgttttttgtcaacacgcttttggcacgcccagtgggacctgattagaagtcaggcgttagttcttcctcatggccgagaaacaagcaccactaccatcaagcccaggctctgttaaaggcaaattaccgaagccgggattgactgacatcattgatgacaatgtcctgccgatcgatcccgagaaatttacgcctgacaacaagcaggagtttgaagcaatgatgcagcaagcacgggatcagtatctgagctcgttcatgcaaacccgcaagggaacgctagttcagaagtacaagttaaaactggttgctgatagccctggaaccggttcttccaaagatagagaagtgaaacaagctccagatggctcagctcagccgaacaacaagggtgctaccgggggttctataggaaatcaaggcgataaccctcaagaagtgcacggagctccaggtgatgctgctcaagggccgcaaggaggaaatcttaatcagaatattgagctagcacaagattttttcaacaactttcaagattgggttgattacgcggtgcatcatgctttgatcaatcaatccggggtcttagtcaatacaatgtcgaacatgaataaaacgataccactaattcagccggtggtacagccgatccaacaacaggtcgtgcagccagttcagcaagcaccatcaacgcagtagcatctccaaccaatctagcagacaccgccaaggcaacggcttcagccgatccaacagactccgatacgacagcaggtcgttcagccgattcagcacctggggtcggccaatgcatcggctggatttgcagcacatggggggcaacctgtgcagcagtttgtgaatcaagttatcccagagcatttggttcatcatgcacaatcggatggcaccgtggtacctcagatggttcctgagcacttggtgcgcaacattcagccgaatctgcataactaccaagggggtaacttgagctatcagtatcagcctccatccccgcaagcccaatatcaaccagcgggatcggcccagcaacaattcgctcatcagtttggtcagttcgagcccatgcagcagcaaccacaaggagcagctcagcaacgaccatgggctgatgtcattgctgatgtaatgagggagcaatttgggctgagaccaaaagagactgggagtttgtatcggcagccttatcccgagtggtttgaaagggttcctcttcctaatcggtttaaaatccctgatttctccaagttctcaggacaagagggcgtgtcgacttatgagcacatcagccgataccttgctcagtgtggtgaagcatcggctgtggacgccttgagagttaggatgttccgattatcattatccgggtcagcttttacttggttttcatctttgccatatgggtcggtcaatagttgggccgatttagagaagcaattccacagctatttctacaacggggtccacgagatgaagttgtctgacttaacggcgatcaagcaaaggtatgatgaacccgtacacgagtatatccagaggttcagagaggtgaggaacaagtgctttagcttgagtttgaccgatgcccagttagccgatctagccttccagggtatgattcctccgatcagggagaaattctcgtccgaagacttcaatagtttgtcgcatctgatacaaaaggtaaccttgcatgagcataggtcggctgacgtcaggagaagctccaggaaggttaatcacgtttgcccgtatacgtatggatcggacgatgaagacgatgattctgagatagctgcagtcgaatgggtgaggagcaaaaaggttataccatgtcaatgggtgaaaagtcctgggaaggaggaaaagtatgacttcgatatcaccaaagccgataagattttcgatttgctactccgagagaagcagattcagctccctcctagccatatgatcccatcggctgaagttattaggcaagaggagatattgtaaatggcataattctgggtctcattctactaatgattgcaaggtctttagatagcaaatccaggtagccatcgaaggggggaagattaagtttgacgattccaagaagccgatgaaggtcgatggaaatccttttcccgacaacatggtacatacagctagtcaagcagccggtggagctaagattattaacaagtatcaaaggaagtatgataagcagcaggcgaggcgttatgaagagaacaacaatggtttcgatcctcattgggattgtgagttctttagattcttctgcaacgaaggaatgaggttgccatctattgaaaactgtcctgggtgcagtgacgtcattgagagctcaagccgaccacataatcagggtgatcggccaagacagacaagacttcctgttcatcaaagattgggtccgatgagtcaagatcatggtcaagaagatgaagggactaggaagaatcaatggtgtccctctggtatttacacaaaaaatcagaaaaggagggtccagagattgaggagcagggaacgttttcaagaggttgaagagggaatcaatcatcggctgaggaaaccaagaccaaggcaggtgtggcgtgttaagaatcaagctcctacagccgatgatgctgcagccgatgaagcgaagaggttggcaaaaggaaagagtgttgttacagcaccaatcaacatggtctttacgctaccagccgaatttggaatcaatcaggccgatgttgatgaagtagaggaggaatcggccaagttggtcctgtcaccagagcaagcggtattcgaaaagcccgagggaacggagaatcggcatattaaaccattgtatgtaaacggctacgtcaatggaaagccgatgtctaaaatgatggtcgatggtggggctgcggtgaatttgatgccttatgctacgttcaggaagctgggtaggaatgctgaggatcttatcaagacaaatatggtgctcaaagattttggtggtaatccatcggagaccaaaggtgttttaaatgtggagctgacagtcggcagtaaaactattcctaccacgttttttgtcattgatgggaagggttcatacagtttgttgcttggaagatattggattcatgccaattgttgcatcccttcaactatgcatcagtgcttgattcagtggcaaggtgacaagatagaggttgtgccagccgacaggtcagttaatgttgctaatgccgatttagctctttgggagatggatgaccttgattgtttatctggaaaagtctgggatggagattttctaaaagtatccgattctgatatacagccaatcgaagatggagaacccaagctattactttgagggcgttgtggagggttcagatgtttacgctaaggatacagtagatgatctcgatgacaagcagggtcaaggttttatgtcggatgatgatttggaagaaattgatataggcccaggtgatcagccaaggccgacattcattagcaaaggtttgtcttcggagtttagaaccaagctgatagagctcctaaaagagtttagagattgcttcgcttgggagtattatgaaatgcctggactcagccgatcgatcgtcgaacatcggttacctatcaaaacgggagttagaccacatcagcaacctccgaggagatgcaaagccgatatgcttgaatctgttaaggctgaaattaaacgattgtatgatgctggttttattcgtccctgccgatatgctgaatgggtttctagcatagttccagttattaagaagaatggcaaggttagggtgtgcattgattttcgagatttaaataaagcgacaccgaaggacgaatatccaatgccggtagccgatcagctagtcgatgccgcgtcagggaacaagattttgagttttatggatgggaacgcaggttataactagatatttatggctgaagaggatatctataaaacggcttttaggtgtcctggtgcaatcggtttatttgagtgggttgtcatgacttttggcttaaagagtgctcgggcaacatatcaaagggccatgaactatatatatcacgatttgatcggctcgttggttgaagtttatattgacgatgtggttgttaaatccaaagaacttgatgatcacatagccgatctaagaaaagtttttgagagaaccaggaagtatggcttgaagatgaatccgacaaaatgtgcttttggtgtatcggctggccagttcttgggatttcttgttcatgaaagagggattgaggtaactcagaggagcattaatgcaatccagaaaattaagcccccggaaaataagaccgagctacaagagatgatcggcaagataaattttgttaggaggtttatctctaaattatctggaaggttggaaccttttacacccttatagcggttgaaagccgatcaagaattcacttgggggcagagcaacaaaaagctttggacaatattaaggaatatctcagttctcctcctgttttgattcccacacggaaaggaataccatttaggttgtatttatcggctggtgaaaagtcaatcggctcagttctgattcaagaattggaagggaaggagcgagttgtgttttatcttagtcgacggctcttggatgctgagactcggtattcccctatggagaagttatgcttgtgcctttatttttcgtgtacgaggttgaggcattatctattatctaatgagtgcactgttatatgcaaagccgatgtagtcagatatatgctgtcgactccaatattaaagggatgaattggaaagtggatattttctttgactgagtttgatcttcggtatgaatcaccgaaggcgattaagggacaagctatagccgattttattgtggaacatcatgatgattcaatcggctcggttgagatagcaccgtggactttattctttgacggatcggtacgcactgatggttgtggcatcgacttagttataatttcccctaggggggcatgttttgagtttgcttatactattaaaccatatgcgactaataatcaagctgaatgtgaggcagtgcttaaggggttgcaattactcaaggaagttgaagccgatactattgaaatcatgggggattctttgctagtaatcagccagttggcaggcgaatatgaatgcaagaatgatacattgatcgtttataatgagaagtgcctggaattaatgaaagagtttcggctggtgactttgaagcatgtatctcgagaacaaaatcttgaagctaatgatttggctcaaggggctcggggtataagccgatgatcaaagatgttaaagttgaaattgcggcaatgtcagccgatgactggaggtatgatgtgcatcagtatttgagcaatccgtctcaatcggcttccagaaaattgcgatataaggcgttgaagtatacgttgctgggtgatgagctctattatcggacgattgatggggtattacttaagtgcttgagtgccgatcaggctaaggttgcaatcggtgaagttcatgaggggatttgtggtactcatcaatcggctcacaagatgaagtggttgcttcgacgtacaggatacttttggctgacgatgctggaggattgtttccgatattataagggttgtcaagattgtcagaagtttggagcaattcagcgagcaccggcgtcggctatgaatcctataattaaaccatggccgttcagaggttggggaattgatatgatcggcatgataaacccaccatcaagtaaagggcataaatatatattggtggcgactgattatttcaccaaatgggtagaggcgattcctttgaagaaagttgattcgggggatgctattcagtttgttcaagagcatataatttatcgatttggtcttcctcagactattactatggatcagggttcaatatttgtgtccgatgaatttgttcagtttgccgatagcatgggtatcaagctgttgaattcttcaccttattatgcacaagctaatgggcaagccgaggcgtctaataagagtttgattaagttgatcaagcggaagatttccgattatcctcggcaatggcatactcgattggccgaagcattctggtcttataggatggcttgtcatggatcgatccaagttcctccttacaaacttgtttatggacatgaggctgttttaccatgggaagttagaatcggctctcgacaaacggagttgcaaaatgatttgacagccgacgagtattacaatcttatggccgatgagagggaggatttggttcagtcccgattgcgagcccttgcgaaggttactaaggataaggaacgtgttgctcggcattataataagaaagttgtgcctaaggatttttcggaaggagaacttgtctggaagttgattttgctgattggtactcgtgataataaattcgacaagtggtcgccaaattggggaggaccgttctagattcaaaaggttgtttctaagggagcatatatgctgcaagggcttgatggtgaagtttatggccgagctcttaattgtaaatacttgaagaaatattactcgagtgtatggattaactcgtgatcggctactaatgtcgatacatgatagccgatgtgtgtacatcgccttgtgatggccgatattattatatcgcccttagttgttttataatgtaatcggctgaggtttgccaattgacaatggccgatattgttatatcgcccttagttgttttatagttttatcaatgctgttgacattgtaaaactagggggcatagatctgttacaatgcagtaaatatagtgcaaaattttttgagcaaatctcacagtcatactaatcggcacagaaggatgttaagggatgaagaatgtttagccgattgcagaagctctaagtcctattacagtaagattactgcgataagtattgctggatagccgatatagctttctgcctaatctgctctacttcctctatggcttgagcatcttgcgcatcggttgcaggaataacttttaaggacttggtcagttcagcaacatgcttaatagcctatttgagcctagctttctgctcttcaatggactgggggagatcggctagcttcttgcgttccatatccagctcagcgttgcattcttcaagttgtgctaagagatcaatcttgcgagcttcaagccgatcaatgttagatttgattggaccttcagataattgatcgagcttggatttttcttcatgcacaagttgacggttggcttggatagtgccctcgatgtccttacgttctcgctgttcggccagtcttaatttggctttctccaacttgaattggtgctgctcaaggtaaacagctggagtaaggacatcggctaattcatctgggattaaggcttggatttcatgcagccgagccctgattggaccatagtcgactaccaagctatctagcgatgatgcttctagccgatccaagatacttcttagagttttcttgacatcatcagataaaggagccaatgctttgcttgtgacatcttcttctccttcgtcaagatagtctttgatgtcaaaagagaaaagatcggctaggacctgtggtgacaatttagaagcagttagaggttaaacaattatagccgatttggatgcttattaggagaaacttactgggatagcaagagcggctagttgttcttcttcttcaacatgacgacatcctacagctgatggggtccgatcgcttgatgcttgttgaataggaggggaaggaggctaaaaatagataggtgttatataaaatcggtcgagattaactaatgaaagaaataagattattgtaccggtggggctggctcagatgtcattggagccgatttcttcttcacagcagccttccttttctgcagttaccgagtatgtgagcaatcggccataaagtgatatgattacaaaagtgattagagaaggttgcttactattgtaaaatgagttggagcagaaggagttggaggggcctgcttaggtgaagccgatggtgttctttcaatatcgcttacctcggctgcggcttgatcaacatcttctccgatttcttcttcatccagagcttgttcaatggatggatctagggcaggcagatcatcagctggtttagctttctttttgatcttcttctttggagccggggctaaagcatctacagccgatgatctggttttccttttcttaccggcatcggctggttctctgataagcccttgaagaagagctgaagtcttgggggcatcatagccgatgacaggaggagatggcccacctccattaggaattaagcctggggcgtaggtgatatccctgccacgttgctttgatgaggaggggaggattctgttgcctacaaattaaagaaacaattagttaagataaatcggctaagcggtcattcaaatgaaatcaagtaaagttaaagacttacttgagggacaacatctggaaagaggtctatcatgtacattgaagctggttggtggaatagatgcaacttccattcaccccaccatctatcaaagtttttgctcctgaacattgctagttctatgttttcaatgctgcctagagggggtcctggaaggttgagcagccgatccatcatcaaggttgatgaaatttctcctcggcattggatcttgtcagcaaagaataagccgattgggagttggcccattccaagctatctagctgaactcatcaggtgatagaattcgtaaggggcttggatgtttcttccttgatggacgccgactggaagaatgcatgggctgattgcagctgtgaagacttctctggatgtttggaatctttcatgattaatgtcttctaatctgaaatctgatggaagctcgaggtctgctgaatcttcatagggaaaccaaactcgagcatctttttgaaagccttcatagaagctgcaaaaccaatctttgagcagttcggctgataactttgctccagcatcggccggtgtggatgcgtattctccatataacgtacatcggcgatgagtgcgttctttgttgtcctctatgatcggctctaatcttggaaattcagcttctgtgacggatagccgattgacgactttcatgactattagattcaaccaagtctgcagcagccaccatggtccacctgctatgactattgagccgacagctaacttagccgaagcattgttcagcatttggtacaagtagccgaggaggattttgcctaaaggaaattgtttctttgcttccaaagcttcggctacaaactgccagttggttgtaggaccacagcttaatctacaaaagagaaatttctctagccacatgagcaaaaaggccacatgttctcgaggggtgacagaaccctgacccatgtatgctgttacatagcctgaccaacctcctatactcttggtcttaaagtcatattggttttttgtgttcagactcatggggttagccgatgaagtgacatccagacccgtgatcataatgatgtctatgagagttggggtcatcggttcttggttgaataagaaggcgttgatggtgttggaccagaaataggaggcggctgccattagaggttcatccttggctgagtttgctatggttaggttaagtgcttggccgattccaatttcgtcccaatgaactcttttgctagccgatatgcgcttgaaccatgtaatccaacttttctcgggtgaagttttttctagagatggccaagatttaaaggtattcttccaatgacctagatctggattggatagtctgaaaggaatcctattggtctcaccgatgatgaactcagtggggtcgaggttgccgactaggccgagaaagtagtggttttcatgcgacaaggtgggaattgcgaccaaattggagagatgctacaagttcaaagtaaccgagaaaagaaagcagtaagaggcgagagaaaactgatccaatgatgaaaaaggggatctagctgatggtaacttacctcagcgtattcggctgatggtgcggcggatggactggcggagatcgacatcgtcgtaggcggagatctggccggagatgaagtcgcctagggattgccttgcgcgtcggagggatcgccggagagagagagggtaaaagttttgcttaagcggggaaaacggaagtcacggtgtgagatctcggggataacggttagtatttgaagcactagagtaacaatcgggaaaatgttagagtgcgaaacttgttcggagtcgatacacggcaaatccggaacattaccaaatatcccggacttggggggcatgtgttaacgaccaaatttggtaatatcagtatcggagatgaagatgaaatcgaaggagaatcgaagataggggtttttccgaaaacagagtaagaatcggctggagtccggatcggctatgactgggatcggctaatctgagttggactggttaagtgatacagccgattccgacaatatgacccatgtgcgacattgggtttgagttgatgtgcttcaagatgattgccacgcatagatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcggatataaatagaccccgagccctatgtaaaaaaaaacacaacacacatccaatacaattccggcgcatcgccaccttttgctttagttttatttcgacgagttcttgctttcaggttgagctgcaccggtttcgatcttcaacaagaggtaaaactcgtcgtgacgaattatgttcttagggattagtgcttccatcttcatgacactctaatctcgtttatataattcgccgagttatcatatatcttatataatctatagcaatatcgctatctaacccacaatcggctaacatatattaacagacggcaaccgattgggttaaatgttgacattgatctagattatataagatatctaccattctatgaatcttctagtggcttgattgtctagatatcattcttcttttcatacttaatgctgcatcaattgagtttgatctattgagtcgtgcttagaatattgatctccagcctgccacctagttgtcgattagaatagcatcggagtttcagccgatcgtatctgatttaactataattatttcaatttgcttcactgatatgttaaatttgccctttatgccaagatattgctgtatttgaatatattaggcatttgcttgatattctatgcctgttttaatatcctgacataaggtagtatcgaggtatttgctgatacatgctagatctatatgatcggctatgctgtaagcttatatagtcttgttattaatatatatttcggtctaagtgattcatactgtctcggcatggcgaccgatctatcccagtcacttgatttaagtatatatcgatataaggagtatatatcgctaacatctacagctgatcaagtaggtttagttttcttccttatttattcacgattgtcgatcaatgcacagatgacattggctcagatataaatgatatgtcatcggtacctaaccgatcagctatcatttataggtttaactacggttcttttgtctttatttcttgttgattgcaggatcaaatcaactggcacgctcatacatccgaaggcaagttttggacctgcactggagttaagcaaatctcccaggcctcgtgttttctgtcaacagattgttttttaggtgatagatacactaaacaatctaacaaagagcaatctaaacgatatcggcttattcaacgcgaatcaaccgataaggataaataacactatttaacttagattaaatagcgtatatgataaattagcacttgtatcgactggtttagagtgtcgaacttaaccgatggaaaccctagccctgccgatacaagcaactacagacggaactcatctcttgtcagagatcgaacttaattgatgcagcccaactcaaagacaagaactcatcgagaaaaatccttaccaacacaactcaaacttcccttaaggataaagcaaaaattacaagcacagtcgaactatacaaaaaaagaaaaataactgactccacctaattaatagataaatcaccttgccatattctcctcgaactcagcctctccttgacacaatatgacaaactttccccaaccaagtctgactagaaatcgacttctgaccattgtccatcttccgtcagctacctccgtaatctagcttgcaactgatgtactccagccgatactgctttaccaatcttaattagccgatgcaacgttctaacttataatacgaaacggaggtagtactaattattttaaacctgaatattagattaatatgatttttctaaaagtaacttttctatagatttttttttgcaaacaatacatttttaggagtttgaaattcgtgcgcacgaaaaacaacataaatcttctctcaatctctagcgaatgaaaacgcccttagagttcatacataccaccagccaaacaaagttttctatacatccatcatcttctatacaaacaactacatgtatatatcctttgttggatcaaactcgacctggattagagaaatgaactacgagcaagcaagagcaaacacaccctacactcctaaacacatcgccggccacgatatagccagcccatggagtcgcattgccatcgatcccttcgatatgcgtgtgtacaaccccacgaattaagtacacctggccggctgcgtttgggctagctcagctcagctgctctcgatcgatcaggtggtgtttggatccagggacttaactttagtctctgtatttagacactaatttagagtattaaatatagactacttataaaactaattagataaatgaaagctaatttgtgagacaaattttttaagcctaattaatctataattagataatgtttactgtagcatcacttaggctaattatggattaattaggctcaatagattcgtaacgcgaattagtccaagattatagataggttttattaatagtctatatttaatatttattattaatatctaaacatatccgatgtgatagggatttaaaagttttaatcccatctaaacaagtccactcggccacaaaagacaggtagctatagtgtccgagtgagtgagagagagagagaaggcacctgcacgcacgagcgggtagcagcagggaggcagcgactggcactgcgactgcaccggccgtaccgcgcgcgcactcattgcgacgactcctccactgtcgctatatgtgttacatccgttatatttggtgttagatacatgtttgtgtttgtaaaacggggggagtacgtaggagtagtatgaatgatcaacaggttaaagatgaaatgaggaggcagaaaaaaaaaacaaaaaaatgataacgattcaaagttaattgctcctacttctttttgtgggcaggaaaatcattcccctttggcattaaaaataaggacaatttgaaccatgccacataaattttacaaaatttgtgatatgccacctgatccacgtatcattgacttatgtgggtcctacatatcattgagatacgggtggcatatcttaaattttacaaatatagggtggcatgattccaacaaacccttaaaaatactgtgcccacaacgctttgttcactttagagcttgatcacgtaaaacacattgtaaattatttttccaaatccggtctccgtattcacgaaacggacgtacacggtcaaaacatattgtaaatacacggcaacaccaccaaaataatgatgttgtagcatgcatgcatgcgcgtcatgttggctcgagccaaggcattcgatcgtatatggctactgcatgggattcactacatactctagaacacatgcataccccactaaatagggctaaatcgaaagtgattaattgcttgaagattcctacacccaggccgtgtttagttccaaaataattcttcaaacttccaacttttttatcacatcaaaactttcctacaaacacaaacttataacttctccgtcacatcgttccaatttcaactaaacttctaatttttgtgtgaactaaacacagccccaattccttctcctcatggcagtagcgacagagctatgaggatgttttcttttttttttggggggggggggggggagggggggtcatcaccaacgcggttagctccttccctcatctattttcctccaaaaatttctccaaatttactttgtgtatgtactcatgcttatacccctggctacccacatgaacatgcacataagagcatctccaacagcctctctattgagttgcatgcaccgaccagttcaacccaaaagcttaactaaggtgggcaatccactttatattccaacactatctactcaactctccaagctaaaaatttggcaaatgaaccaaatacactcctccaacagactctccattcaactctccaagccaactgcctctccatccaagcccacccactggccaatattggccagcctcctagtctagctatctctccagctctcctctactcgtgcttctctcctctccctctagctccactgccacgccacatttttgtcgtcagggtcaccgcggcgccgcctctccgtcaacggcatcgttgtgccgtctctccatgttgccatcgtcgcctatgggaggagcgtcatcgtcgtctccttacaccgggaggagcgccgccgtcttccccctccttcctccgcggccgtcatcccccgagccaaggagcgctgatgctatccacatctcgatctgccaccagcctcgcctcatcactccgtccaccaccggcctcgacgagggagaggattggagagaggggaaggaagaagaaagctcgagaaggggaaagaaaacacgcctgtctcgcgtggtcgtcgtcgcgagccgctgccgccaccatcgctagccgccgccgccccgtcgtcgctgcgcacggcaaccgtcgctgcgcccgaagactgctaccccgccgtcgccgcgtgcggccacactgccgcaagcaaaaaggggattggggaagagagggagcaggataatgagaaagaaagtggtatagaggctgacatatgggtcccgctgtcatagactcagaatagagaggatgaatggagaggctgttagagaaaacaatgaatttgacttgctaaattaaatggagagttagctaaatatatatttgaagagactgttggagggcaacatatcctatgcacacaggccctcacgtgtacacacgtgcacaccaactaaaaaatgtcaccaaaaaatctagaaaaaatcatacacatacttttaattgtattacacctagagttaaaatcttaacgtcaaattcattatattttagccgtaacaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttatgataatttttagttggtgtacacgatgtgtacacgcgagggcctgtgtgtataagatacgctcccctgttggagatgctctaattaagatgctagacccatccatgtcgtccttttcccatagatgctttcactagctacttaattatctaacagcaatgcatcatgtacgatgtttgatggtagcatatatatatatatatatatatatatatatatatatatatatatatatatatatatatatatatatatatatatatacacacacacacacacacacgtagcattgctagctctacctagctactccctccgtcccataatataagggattttgactttttacttgtactgtttgaccatttgttttattaaaatttgtttgaaatttttatttattttatttgtgacttactttattattcaaagtattttaagcacttcgtttttaatatttacacaattttttttaataaaacgagtgatcaaacagtgcaaacaaaaagtcaaaatctcttatattatgggacggagggagtaccaatcttctaggtagctagtttggtacttcctccgtttcaggttataaagacgttttgactttggtcaaagtcaagccacttcaagtatgactaagtttataaataaatataataatacttataataccaaattaatttaattaaataaataattgaatatattttcataataagtttattttgggttaaaagcattattattttttctacaaacttagttataaagcaatttgactttgaccaaaatcaaaacgttatataacctgaaacggaggcagtagtacgaacatatctgcacaaaatgccgactagatgcatgacatgtactacatatatttcctgtcgtgttggttactgtactgtctgtacattgcaatataagacgaatttatttgtacttcattttttgcaatttgcagcaataggatatttatgcagctcgatcgatcacgtaatccatgtagcactgaatgattttcagaaacgtgtcctgcatataatgttcgcgtacaggtcatgcatggcccacgtacagattcacaccacatgaacaaaatcttgctctagttattacacggtcaaaggcgcccttcgcccccaattgcttcatgcatgctgcggccacagtaaaaactactgtttaattaattaaataaatagtatataatccaaaaattaaattgatccaatacctgctacattatatagtacaggttaatatgatgctagctgttcattgatctggcctgtcaaaaatgaggtgctcatcttacatggacccttgagctaacaccctaaatataaagctgcatctatctatctgcagctatagaatggcaatgtgcaaataaaggatagcttaattagagcaagaataatagcaagctataagaagactaaacgagtaaatgatgaggtggataagatatgagaggagagagatgagaagtaggttgtaagcttacagccggcttagacacaggaactaagaaaatatataagacagacaggtggaccatatatttatagtgaagaactaaccactatatgagtgagctgagagatatactataaagatctatacaatcagcagttgggtgtattattagcctgactctgaattggctttctgacatgaacagtgaagctacacaaaagctatggccagtataattcctaacactagctagggcaatgtgttggccaaccaccatgaccatgttccatatagtatatgcatgggccctacccctgaaattcactgtagacacaagttaacaaaactcaggaggactacacccatgtggtagggtcctccagtaaagaaaggtgtagtgtagctgattttgatgaccaagaatttttcatttgtaagattcctttcttcctagctatagctcctctttgtgcatgatcatcttctctcaccttagaccatgggcacaatcagtgagatgtatggcccccatgtgtctggaggaagagaggcaggagaaatgccattctagaggaggggaggagcaggtgtgaggagaagaaatgataatcttttcaattgagttagtagtagagatgactagacgtgtacttgtacaagtgtatgtacagcaaagaacactgcatgcatgcatgcatgcatgatgtagaagaaatgataggattgcatgcatgcattcattcataagtgtattaaaaattaaatctcatatggtccatgcagtatagtttaagggatcatatagcaccgtcagtatgtccttccaataaggataagaacgcatggtctaattccttggataatattacactcagatttacacacctcttgcaattaatgcatgagttcagagtttggtgttggcaaaatcaattcccccttgcacaattggtttatgcgccagatacatttttggattttaatcgaacaagctagtggtaattaccatgtggattttgtgatgcgattattattaagacgttgtaaaaatataaatcattagttggtttagtttgttattaattacatgaccaaaaattaaaagaggatttagccatgcgatacggtgtgctaaattattcaaggatctaattaagatggcgtactaattatgaaaaagccgcgcaaaatgctcaaattaaggcgagatatcaaattatcgattaagaagaattatagaaacaaaatattaacaaaaaagcacgggaatcttgtatgatgcaaacactatacatgtagtagctaccagggtttttaattttgaaattggattatttgctagggggccaaaatttcggtaatttcggaaatttttggcagaaattatttgaaattttgactgattttgaatgaatttgaataaaatttgactaaattcaaaaaatataaaaaaaggaaaaatttcgggcgagatgtgagcatgccagtgggggcgaaattaccgaaatttcaaaccctggtagctatatctctgtcccaaaatataaaatatttgagggagtagggagtaaaaaccataatatattctacgacacaacatgcatagatggatccaaatgcgtatgcttttcatggaattgtctctgcacgcgtcatcatttgatcgaggtagcaaaacgacgacgatgggggagagagatgttgttttccatgcatgttcccggggagagagagatgttgttttccagctgaaacaatgtacgcttgcatgtacagtactaactaattaagaagatgagaataaattaacctctacagctctactagctaattgacaccacttggatgaaatttgtgcgttctcaacttaaaaatcaatctgcatttgaactcaatttctttgtgttcttttctaagaaatgcacactatccatacttgtaaacagtatgatttttacaaaaactttgtatatatcaatttcttagaaaactgcattaaatcaaaatttcaactttataatagtaaactcattcgtctatatcctcaaatagttatcacaaaatcattcgatcattcagccattcaactattaaggggagaaaaaacatgctattaccttcgattttgctccaagattcgtgtcatgcatgttaggctgtgttagctagaagaagttcccatcaggaacagtgatcatggaaaacggagcagtccattagcgtgtgattaattaagtatttgctaatttttttaaaaaatatggattaatttgatttttttaaaacaactttcgtatagaaacttttttgaaaaaagcacaccgtttagcagtttgaaaagcgtgcgcgcggaaaacgagagagaagttggaaaagggggcgtccgtacacagccttagatttcttctccagtgagttcgccgtcgttccttccctaccgtcacccatgttgttaaagttgtattggcttaccaggtaagaaactactccagcattgattgtttattacctgctttattcccacattgtggttgctcttagtgggctacttcttacgtacttgcgtccaaaataaattaatcctgggtttgaactggatacacgtatgaagctatgctcaaaagcgacctctcagctactcgacatttgcatgaaccataaaaccctagcaagctagatacctagctagctactcaagctcaatccatcgactggtcgtttccattattgaactactccaagtgatgatactactgcaagtagggtttgttgaagagttaacatgcatgcaaatccgggcaaaaagcaattaattaaatcagccggcgacggcaatagtactgagagatcgatgtgatcgatcgttaatataactagctgaaatcccgcgcattgctacgaaaatttagtatgataacaataaaaaaaatacgtgtaagatgataacatcagattaaataagttaatgtggttcatgataatttaaatttaaatagcatgtagaatgatgatttaaatataaaaaagtaaagtggtatgactttattaaagaagaaaagtagggagatagtttgaaccgtatattaatcatctaaagacaaaaacaattaaggtggtatggcttaattagagaaaaaagagaaagttaatttgaaccataaattaatcatttaagcactaagtaagtgatgatgaactatataagtatataggatatcataaaacataataaagatatacattgaaatattatgtaaattatgtgggatgataatttaacatgcttgcatttaaaaagctcttaaattacaaaaactataaaattatagataatatagcatgtttgcatgatgtttaaatgtgatgattgttagtggatgatgatgtggcatttttgcatgttaagtttaaggagttagtggtttataactttataataagataggatacaatgtttgatatctgcgatcgattgataggtaggatcagtctcgatagcaagttaatttttggttgatgaaacgtacatcgatttggtcgatcatgttggaaccaagtatataggagtacatatatagcttccaaactctaggttttagggcagggataggtagcactcactggtcgtttcaaagtaagtttggtgaagagtctcacctagaacaattttacctatttatgtttacattaaaaagtattttgtcaactaattggtttgttgccacatgttgccaaacactgtcaggcccttttttttttcttttcgaaaaaggttaccttactatcgtaagcttttttaaagccgttagatcaaatccaacatcacgcaccagccattcactgagcctattttgtaatagtgtaattcatgtagctttatagaaactcccctatattatatttctataaacccatataacccattgggtcaattgacaatgctttaagtttcgcaaagactacagtgtgctatatatatatatatatatatatatatatatatatatatatatatatatatatatatatatatatatatcaatgtatttttaccgtaaactaaattcgatctgctgctaatatgtaagttgtgaaacatataaagctcaacactagagaaaatcttcgtagttgaatatatatgatttgtaatatagacaaacacggaaaattctcgaccatataacaatggccaaccatgcagaccctgctactatgggatgtatgagaagaacaaccatcactagtacttactccactctgttcatcctataaggtgtattttgaaattcttttaacggggacatatcttcattaatgttttcctcgtccctttgccctcttggtcaatatatacagccatgaacacagtcatgcaggcaaccaataaaaccacaaggccacattactccctccgtctcaaaatgtttgacaccgttgacttttttagtacgtatttgaccattcgtcttattaaaaaaattaattaattatttattcttttcatatatgttttatctacacattataactactcctacattgaaaagaaaaaaagacagaaacaaaattacaacaggtgcttgctatacattgggtatagtcaattgggacaccatcacaccattgcttccacctatttgtagctacctcattcactcactcactcactcccacacactgcagccagctgcagctgcagcatagcagccagactcactctcacacagtcacactactactagactactactactcccagcaatcacatcctctctctctatctctctctttcaaaagcgtgtgtgcctgtgagcctgtgactgacgacggactgtctgctggcacgcacgagcgggcgcctgtgcgtgtgtgctccgacctgcaaatcagagaccagatcgagccccctggccggctgcagctgcctccttgcttcctctagctcctggagtgaggagagctcgccattgctgtctgctcaagctctctagcgtagctagacttctccggcgtgtgcttggctgctgctagctgctagctggccagtcttcctctcttgtccgccggcgagatggtggtggtgggcgccgtgagctgctgccggagagggagttggcggcgacgcgccgccgccctcgccctcgccgtcgtcgtcgtcttcgccgcggcagctggtgagtgcagagatggcagaggcgagctagctctcttgccagctcttcttttcatgcgtgcactttttaatctgagcgtctagtcttttgatcttctgcatataatcagtgattacttgctctagctctctctttttccttcacctttttggtgcttttctttttgtctgaagaccaaattaaccggatctttgattaggttcatcagaagcttgttaactgcatgcaggttgattaattaatctagctacaatgttttactactttacatataacattagagtggtagctatctctggccaggtcttctctctcaaggaaactaccttaaacaatcttaaaaactgaaccttaattaaattaagtgttcttctctagtggttagttttttttcttagaaattcttgtggttgattagcatgccgtctctactctcttcatgtaccgaatacaaatatcgagaggcttatctctcaaatggtaacatttttatttgcttcccttctctcttgatgaaaagttttggtgtagttcttgcatgcttgcaaattaaggtccatatatacattctacacccttctctctgctaattacttttcgtcccatcacctagcaaatacactaatataaggcacctcctcagagactaaagtgtaattagcccaaaagctaattaaattgcaatataattaacaatttcaatttccttgttgcatgccattgatctttagtttcctcacacttgcaacatcctagctagctagtgaaagaaagccaccaaggtcaggatctcttaactttctcattaagctgtacactcaatcatatctccacacattttcaagatgcaaacctatattaatttgcttcttaacacacacacacactctctctctctctctctctctctctctctctctctctctctctctctctctctctctctctctctctctctcatagtctcatattctcatttggtcttcaccaactagagcctttttctcccagcagtgtagtgtgctggtgcccacacgatggcactgcacgctctggtccagaaaataatatataacacgatcgacctactaatataatacacgacatcagctttagtacagggagagaagaagaaagattctgcaagagaacagcccatgcaaggccaatacacgtacaatccacagcccaattaatcagctagctagccacaaatacatttttggtctcacctgcttaacgtttaggacgccgaccatatgctccaatctccttgagatcctagctagctaactacccattctaattagcaatggtcaccacgaatgattaatgtagagtatgtaattaggagatttttcaagggttctttttgctgtattgagaggcagatgtctcttgttgtattaattctgaagtatttattatttattaaatctggaaataacatatatatatacatcgatacatttatacatcctataaaaatactaaaacacaaagtctagagctttgctagttgagataagtgatatgaccggatatcattcatgccgtaaaaagagtcgtatttttaggcgtggagctaataattcgaggtaataatctggtggtgaagtagttgaaaagaacgtacttgcattatattagtaggtcgtgtattatattagtaggtactatttaaaaaatataactattttatatatggttatattttttatagattaaatagtacaaactgatcgagcaaaaaaaaattcataggttggttttctacgtacggattcatcgatgatccactgttcattgtaaaaaagaacattaaaaaaatatatcaatatagttatatatgctttcagtaaagtttatactaacaattaaccatatatacatgtatgcatgctacagttgccgctgctgcaaggaggccaatccgtgtactacggagaccagcagcagcagcggcgcacgtgaggagactagactcgtcgtcgtcgctgatgctagcgaggaggaccaacgcggcggccggcggcggcgacaacggcgacgtccggcggcggcggctgatcgggcccgggtcgtcgccgccgacgtgccgggcgcggtgcgggcggtgcgcgccgtgccggccggtgcacgtggcgatccagccgggcgtcggcgcccagtgggagtactacccggaggtgtggcgctgcaagtgcggcgataagctcttcatgccgtgaccgccgccgtctcgccgccggcgaaccacgtagcgcggcggcggcggcggcgccagccatggctgcgtggatcgatcgatcagtagcatagttttgaaaggggtgtagtagtgtgtaaaagagggggaggagaaagtaatttaagttaaaaggttattttgtggtgattataaactagttaattaatcaactaggtcgatcttaatcttaagatggtgtactgatcgagttgatgatgccggtaatgtctgtaaatgtgaaatttaagatctggattttaccgtgtatgttcttctttttgatttatctgatttccctttttcgactagttcttttgcttaggtaatttttcactttgcattcttcaggttgtaggggttatactgtgtcattgtaattgcaaattaagatggacaattatctgtcttgtgctcttacatcacgcgattttctcatgatattggactaggcaagagtttcctagccgtctaaaagtgggtgagaattgaagagagaataattaactaggggttcagcacgaatcttaaagcatataaggccatgtttagttctaaagtttttttttccaaactttcaactttccatcacattaaaccttttttacacacacacaacttttctatcacatcgtaccaatttcaaccaaacttccaaacttcaatgtgaactaaacacagcataagccgtcctaaattgacagttgtacttaaaaaaacagaatagttcgacgaataacaagtattacaaaatatatatacactgagattttactaataaataaaccaacctagctaaatttacagtatactccctccatttcatcatattataaatcactttgatttttttctagtaaaaaagattttagctaaaacaccaaattagttttagtagattattataggatgtctagattcgtaatgttaggatgtgtcacatcctatcgtgggtttgtttttttatggaacggagagagtattacattaacatgttgcaggagctcatcatagagctaaaataccaaattagttttattaaatctagcattcaatatattttaatattatgtttgttttgtttcgaaaaaactactatatttcttataactttgtcgaactcaaaaaggtttaattaaaaaaataataaaaaagacttataattaatataaaaaaggaggaagtagaatattatactatctacttcctccgtcccataatataagggattttaagtttttgtttgtactgtttgaccactcgtcttatttaaaaaatttgtgcaaatataaaaaatgagaagttgtgcttaaagtacttttaaataataaagtaagtaaaaaataaataataattctaaaatattttggataagacgagtggtcaaacagtgtaagtaaagataggaccgagggagtagttacaagtctatttggactgacaacgtgaaagcaattctcagctgttagaagtctggtgaggtcactcactctgatagatcacatcatcacatggatgcacggagtactaaaatgtcaggacgatgttatcctgaaacttcaggctacataaccccatgatactaggagtacagtgcctactacccgtacttcagcatcgatcatgcatagaactctctcatattcagattcattatattagaatgtgtcacatctaataaaaaaatttatatttagttgtggagaaagtatatgcatggactttctttttttcattttctatgcatagatcgatgcatggtcatatgaagttcagcttgcattagcggcgaatccaacagagtttcaggctatgtttagttggatctaaagtttggattttggttgaaattggagataatgtgattaaaaagttgtgtgtgtatgacaagttaatgtgatggaaaaggactgaagtttggatttaaactttgcatctaaacacagcctcagtctttcagagtctgagcaaatcttgttatgctccctccgtcccataatataagggattttgacttttttaacactgttttgcccactcatcttatttaaaaaatttgtacaaatataaaaaacgaaaagttgtgcaaagtactttggataataaagtaagtcacaaataaaataaataataattccaaatttttttaaataagacgaatggtcaaacattgtaagtaaaaagtcaaaatcccttatattataggacggagggagtatttgcaatgaaaattgtctccaaatcttccgaaaacattcaaattctattgtatactctttccatccctaaatataagggattttggttggatgtaatgtatcttagtactaggatacgttatatctaactaaaattctttatatttagggacggatggagtatctttctaacgagctcagacgacaatagggtcgctgggcggtggatccgccaatccaatgcatagtttggtcaaatacagtaccatgtacattctactttattgtacttgtctagttcttggtccaaatatatgaccagtatttcttatattttggtacgaatattctatattatatatgatagagagggcaataatatcaatggtttggttacaattgttaccccgcgctgtttgactggtaaatggagaaacaaccaagcaaggaaaatacaaaagcttgtctgtttgctcatgattaaaaattttggcttggaatgaactccatagtcttctccaggatttgacgtctatgcatggccaggaccgggacccgggttcaaagctggcccctgtaaccctgcaagagtactcctccccagtccaagccacatctctacactttattcctctcttccttttcttacttttctatcttctttcactactctcactcaccgaccaaatataatgttcaacacctgcttccttgcatccttgttattcaccggattaattttataaaatcacacagtaatgactctgattgattgagctaccgctaacgagacatgaaaaataagcaaagttatacaaaataattaacatgtactctctccgtacactattttttaatgtttcataatataaggtatgcatgaatgtatattattaactagaacttttttcccactaaatttattttttaaatcctccatacttaagatcgttaattctattgtgtatgcattatatttatttgggtgatcaaaattatgaggtgataataattatttgttgatatttgggttaagggtggttgagcgttatattttggaatggagggagtaaaacctttatactactactactagatatttaaaagacaaagctaaaaaatagactccaacaaacaaaccatcgctcccctcccatcgaaaaataagttttatgacttagatttctgcggccaatccatatcctatgaaattctgatgtctcaggcccgttcgatttcttacttgagagaggttttcaacgcacgtaaaacgagaaagcttattagcaaataatttaattacgtattaattattataaaatcaaaaaaaatgaatttatttgaattttttaaatggcttctacatagaaaccatttataaaaggatgaagaattacgtattaaaaaataatttaattacgtattaattattataaaatcaaaaaaatgaatttatttgaattttctgttaacagtttgaaaagcgtgctaacagaaaatgatgaagttaaaattgaagttatagagcacacaaactgcaagagtaaccacaatatggctaacaccttttggctataaaactaaggactttttttggatagcaggagattacataacaaattcaaaaacataattaaaatctaattaaaaaaaactatgtttcagaggactcttatgatgggtcgtatccaaattacacatttcaagacaaacatgatgaaagcagctgactatattacttagagccccactccggtgctttctactcgtagtagaaaataatctgaaccgttgatcttatttgatcggagggttcaaatctatttctactccaactacatttaacggtagtagaatcgtagaggggtatatttgtccaggaaaaaatatttacggatgggtattttcgtcctttttattctttaaccttagctgcactttctcctgtctcgttccagagccaacgccatccctaacctaagccgaggcgaagagaacctcgcagctccttcctccgccgtcatcgccgcctcggacgacctcgcctgctccgccgcatggtatatgttcagattgggaattcactggaattaataacattaattccatagcggtaaagaactcgatacgattaaaaatataaaccgcaccaattgtaaacgggatagtacgggaaagaaacagcaagtgcaaacggagaaaacaaatcacgttaaaacaggataaattgacgggataatagatggaaacggacggatcgataatgggtggaaacggggtaataggggaaagaaactgcagtggaaacggagaaaatggatctcgtacgaacgaaaaaagaaaatggatctcgtacgtacggaaaaaaaagagaaaatagagaaaacaacatagatgaaaaacggaaagtcccggttgacatacggatagattctgacaggaataatatggttggtccaaaaaacaaaaaccatgtactccttccgtttcaggttataagttgtggttgaagtcaaactgttttaagttggaccaactttatattcatagaaaaagtagcaacatttttaacccaagacaaaattattatgaaaatataaataatttagtattacaaatatctgtagctctctttagcaaaggctgggatgtttattccattatctaaaaaaaattattattattatatttatctataaacttagttaaacttaaaacaatttaactttgaccaaagtcaaaacgtcttgtaacctgaaacagagggagtatttttttaatccacccggtccggataggctggacggattctggtgtaaccagttttgtcataaaataatatttctgcgcacaagcaagaaaccacgtgtttttggtcaacccgtggatccggacaaactggacgaattccaagagttgtaaccattattgtgctaaaatagtatttcccctttgttctatgtttacaatacgtaaaaaccacgagttttattaatcgacccggttcggacagatcggaccgattccgagcgtaactaattttgtcctaaaataatatttctcctttattctatatacacacaagcaaaaaccacatgttttttaatcgactcgagggtccggacagaagcggacggattccgagcattgtgaccaattcctaaaatagtatttctcctttgttttatgtgcgcaaaactaaaaaacacttaatttttaatcgatccggtccggacataccagacagattccgagcgtaaccaattttatcctaaaataatatttctcctttattctatatgcgcacgagcgaaaaaccacgtgttttttaattgacccagtccggatagaccggatggatttcgcatgttgtaaccaaatttgtcctaaaatagcatttctcatttgttctttgtctacaagacagactggacggaaaaccacgtgttttttaatcgacccgatccagacagactggacggattccggacataaccaattttgttttaaaataatatttctcctttattctatgtgtatatgacaaaaaaaaccatgtgtttttttccaacttggttcggacattcccagatgaattccggatataaaatacgatgtgtcctaaaatatatagtagttctgttatagtataaatttcgtctcaaattgaaaccgagtttcattgagtttaaaaactttaaaccagttttcttgtcgttgtagcctaccttatcctacgccacagacacgttctttttattttttttaattcgacacattttttttattttttttaccggacgtgtagtcacgtacatgtgtgcgcccctcatcaacacgtccgtccggcccagaacgccacggcctaattgcgaagagaaggagcaggcttgactatgggacccacctgaagaaataagtgccaaatctaccccaaactaatttactccaactttactaatctacccttaaaaataaacggttcagattaattatacttgtagtatatactacaagtaaaaagcatcggagcgtcgccctattacttatcatgttgccatcccatgagtctctctgatctgtgcctagctgctccaatggctatatctttttggcctttctgttccatccatgtttgcacagatataaataatctcagagattttatatgcaagaggcttgttgtggcagctatagctatagctagctatatatccacagtgtcacacactatacacacccctgtagacgagtaaactgaaacaggagatgggtgtactgatcaaaaaaaaaaactctaaattcttgagcaaagaagagacaaggcgtgcagatcgatttctcctcccatttcatgcatgcgtgcatatgtatgatcggccgatgcaaacacaacacgctatccataaaaaccgtgcactcatgtgtggttgcttcgaatgtgaaagtgctataggtgtacaactttaggatatctcctgtgagattcatcaattatatgtgagcagtgcatatatagtatagtctcgctacgatactctctactggtagcataatataataggctatgtacgcatacacgcacaccaaataaattgtcgaaaattggctcttgggcgacactctagttggttgctataacacatagaattgtttaagtaaccgcacgaaaattcaacacatttgttacaatactatcgaagactcttgcatgacgctttaattggttgctagaacacagaaaaagagttaagtaacagtaacatatttgttattatatatagacgatagagaatttcatagaaggcacttgaatacaaaactaagctattttctagaggttgctgaatagtcatgtgtacaagattataagatagccgctagatattatatttggaattctgcacatattctaccatctgaattaatgcgaacactcgctatcaactgtaagtagggatggaatgatgctgcaggatgcacataataacaacctgtcaactgtacccctgcaatactcctccctaatagcaaggttaataatacagccgacctgttagctataaggttctttgtagcattctctcagcctaccatataatagttagctctttacaattaatatatggcccacttgcctctctcatagagttttttggttattgtgtctgagccggctgtaagtttacagcccgtttatcctctctctcctctcttctcttctccacatcagcatttagccggcttatagcctactattatacttgctctaacctgaaactgctgaactgcatgcagtgtcgaaaacttcaacatccttgaacagatatactaccagctagctttacaacatcccatttcaacctggtagactggctatgtctcacactgattccaaaatggtcactgccaaaacaggaggcaggagctgtccgatgatcagctgctccatgttactgcaatactagtagtagtataagatggcatgcatctgatcatcatcatggtactcctgtctttctgaatgaaagatcattcactattcagataggagtaatatcataaggagaggattagaggggttgaaaaatagtgttcgcccatggcatagcataggtcagcaacccaaccccacagactccaacaagatcgagggggttgtttggctagcagcatctttggaaaaaaaatatcaaaatagttttgtcatttctgaagtaccagtgtacttcctcagtttcacaatgtaagtcattttagaaatgacattttccacattcatattaatgttaataaatctagatatatatgtgtgtctagattcattaacatctatatgaatgtgggcaatgctagaatgacttacattgtgaaacggaggaaatatatttgtattctacattttcttctccatactactacaagtaaaggagtacagtatatctttttgttgtttgtcatgtgaggttcaagggtacagggtacttgccctgcagccgtaccgtccttgtgaaaaggaggcacacacatgcatattgatacttgtgagatactgtgcatattgatacttgtgagagatactgtgtgccactactaactttctcacagacacacgagacaaagagatacagatggataccgctggggatatattgggttgtcgcacctttttcgtgcagcttacaagaaatatatatcggagaaatctagccgtcctaataggcaattaatcctataatgcagagtcctattaaaaaactaatccgaatatattatgggccaaaattcagataacatatttaacaggcaaaatgggctgaaactaaaagatcaagacatatttttcggcacatgatgaaactgatgaagatgaaagattttttgcgcacgtaaacgagaaagctattagcacttgattaaatggatatattttatattttaaactaacttctatataaaaagttttcgtacaaacgctaaaactaacttctatataaaaagttttcgtacaaacgcaccgtttagtagtttgaaaaacttgctaacgaaaactgaggtaaagtttgtatcttaatgagaaaagaacggttaaatagactgaaaagatcaaaaccgaaaaattcggttaattagtagttcgatctcaactgctaactaattgaattttatttgatcagttcagtcaccaccatcgtttaaccgaattagatgcgctactgaacatgtaaatagagtagggctcgatacggagtggttcaatagattagctcaattcctgaacatgcgagtgataaataatgccaggattcaaagaaaaataagttcaatggctgcttgcatgtatggagatcaatcgatcatcacgtgccatcagctggtatctgtcgccaatccttacatataaactacggacgcggtgaacgccaattcgatcctatatatctaaattattggtgctagttaattagtcaatggcgcatctgtaagaaaaaaactttgttatctagctaaatttatgtttcctataaacatgctccatccatcctaataaaaatcaaatcataacatcacaatgagtatataagaaaataaataaaatacccttaagtaggaaagttgtattcatgaatgagtaggtgggggtattgaaggcataaaatttatcgatctgcaaaccaataatagatagaaaaggtagtatagtttggaggacaaaatttaaactctaaatgttaatttattttggaacggaaagagtagaatgtgaatgcacagtgaattttggcagtcaaatctctgatggtactgagaggagactgaagtttctggtaaacaaaaaagacgtgatgataatttgttatcctgactcacgtctcactaactgaaatgatctttggtgttatttctcatggggtggcaagggacgatctagggagtggcagatcgttaaattttctgtaaaataaagggcatatgtctccccgtctgaaacatcgaagattaactttctcgactttcagttttgaatatttggttggacaatttgccagaagtttaaagctgcagtggcaaggcaagcctacatcatagaaatggagagaggcctctgaaaactgtccttatttttgcacggtcaaatgggccaatctatgggctgtttcttgtaacagacgaacatgaatgggctggccggcccgacaaatgaataggcagtcccatattatttctatcgtctgtgcagtgtagagatgcctctgatcacgacgtcgccgacctccgcatacttctccttgccacgagtgtgtgtgatcatcatctggttcgttaattgtttttttttttgagaaccatctggttcgttaattgagaagttgaattccaattccttctccttaatttatccgctctcttttcagtatcagtatgtgttcgattgattcttttgtgtcaatgtttggttggttcttcgtgagatgaaattagtccaaacttgcaacatgtagaggtgagatgaatttagttcaaaattgtatcctgttttaaaagaacatacttcctccgtttcacaatgtaagtcattctaaaatttcccacatttatattgatgttaatgaatctaaatagatatatatgtctagattcattaacattaagaaatgctataatgacttacattgtaaaacggagggagtataaaaagagcttcatgggcttttgttttcttctctgaactccctcacgaaaagcccttgccacgtggcccagcatcgggacgtacgtggctggcttgcacggtggctgcggcggaggagtccaccatcgccagtgacatcgccgtcgccggaggagggtttacattacctctactaaatttcgagccctattagtattatgatttttgataaattttaactgaatttactgtttaaccttcgaaattttgatcaaaacttaatttcgagccatgttgaaacatcgaaatttcacgaaattcgaccggttttcgtcggaactgtgaacctgcaccggagtaccaaagtggcaagacgtgatctgcaaaggcagaggatgctgccgtgtgaagtggccaagctagctttcctggtcaaaacaaaaaagtgaacaaaagctagttacaacacctgcatgtatatttataccataaaaatgggaaaacgagttgaacgagattgcacgcagttacaccggagaggaagaaaaggttgcaaaattgttgcacccaaatttggggggagtgacatgacacggcaggggaaattccgtgaaatgttacacagcaatgtgcacggcaaaatttttgaacaagttaaaccaccctctgcctacctagatttagggttatggaaaatttaattcattttccttcttgttttcttgtaccagttcctttcaagtttgtgtgtgatctcagagtttttttttttggttgttgaatgatcattggatatgagtcagcggtgagagcgagaggttagttgggttcgccgcgtaaatcaggaaccatgtagctcaagactaggggaagatgttgaagaagaggtgattggaggtgggcagatggaaaaactttgagcaaatgaggaaaaagcataaatactacactttggtcttgcatggtgaggtcatggcaatgtggcatacaacaaggatgacacaaaacaaagttgttagtactgaggagtgaggatgcgtccgtttgaagcacaaaggataaatatagctcattttttatgcgtacgtttttcatagaaatgttaatttaaaaataattataccgatccatttacaagtttagaatgcttaatatcaattaatcatccgctaatggttacaccttatcttgcatatcttcataatattctctttttcacctcctttcaaaacacaccctaaatatctacacaatttgctattgttttatttcttacacctgcacatacttcctctattaaggccctctttgtttagatttataagccaacttataatccgaaaagtctaagcctaaacaaacaagtggcttttttcatttggcttttttgaagccataagacaatctaacacttttaagccaaaagctaggttggagaagcttttttgacttatttgacttaggacaataaatccaccggcataaatcatataagccaataagctgacttaaaagtttaatccaacaaacctataaacctaaacaaagagggcctaagtatagtatatataagtagcattagtcagtggcggattcatgcttaatctatgggatcggttgaccctagcttttccaaaaacaccccaacaaatcatgattctcgtgtataattttttttaaaaaaaatagagaaatgtcatcacttaaatataaaccagtagtaattgatctcacattgtaaaattccctggtactagtactacttattggtatcttgaacaaattattacctttccccaaacaatagaggcgttgtaggtctaaaattcttgatgaatgaattccaggctaaaatgttggctaagcatgtgaaatataagatgaattttgagctaaaatttgtcatgctaatcgtaacttaagatgcattggaaataggtgtaagagcggttcacaagagagcgtacaggttacttcctatgaggattcgctctaataactacataagttattgtagcggatcctctttacttgtggagtaataagtagttggtgatacgtgttagccacgaggcatatattctataataatacagtgtcttgtttcgattgtaaagtgaatttgaacaagcacaatttctaaggtgaatttggataaacacttgttcagatatatcctaaaaggttgatttttttatttcagagaaggagggtataaggatatttattagaggtatttcatcaacaaaattaacccacatacagcacagtaacaattttatattgagtttattattacaaagccaccaaccagcatatatgcccaacgatttcgctatatctcactcgaaagattttttcttatctctcactcaaatttacagtgtgttttcttgtaagttacagtgtaattttttaatcttcacatgtaagttttaaaatttatattggatatggtctttttcttgcagatatggtaatttagtgtctattatggtatttttttaattgcttttatattttactgtatttattagattttaattaaaaattaaaaatctgtgtaggtactccaactccgtgtgcccaaaaatgagcgtgagcccaactcgccacaatcctccaaccacccctagacacgtgtccagagaatctctaaccgatcagtcgaagacgctccattacactgacaaattggccccacatgtcagtgactgggccttgctcgatatatccgcgccatggcttccgctgtgcagttgcttttgcttcgtctacctctcgccgccgttttccccccaaaacccgcgacgacgaaaaccctagccgtcgccggaatgtcgaaggccgaggccgccgccgccggcgacgccgccaagcccgacccggagatgggagtcgcgggggagaaggaggtggttgcggagaaggcaccggcgaggaggaaggtagcggcggaggaggaggacccgcggctgcggtgggcgttcgtgcggaaggtgtactgtatcctggcgctgcagttcgccgtcacggcggcgatcgccgtcgtggcgtgggccgtccgccccatcccgcgcttcttcgcggcgggctccctcgcctcgtggctcgtctacctcgccatcctcctctgccccttcatcggtctctgcggcctcctcctcctcctcctcccttcccttgcttggttcctcgatctctctttctttcttccatggtggtatctgattggggttttggggtttgcgcagtgctgtggccgatgctcaagtacagggagaagcaccccgtgaacctgctgctgctgggcctcttcacgctctgcgagagcctcaccatcgccgtctgctcctcgaccttcctcggtatacacgccaaatgcgctctccatttctctcctccccaaaatgtctccatttttctttctccgaagaaaaaggtctccgtttttttttttttttgggggggggggaattgtgatgctctaaacgtgggtgattgactgatttgagatgcagttgggttcggatgggtaaattttatggctggttcttgggccaattgattgtctccgtgtgatttggttctggacttttggtgggattggcgattcccaggagttctttctttttctctctcagtagcattgttgcagggatgtagctgctcgtgcattattgaacagatcagatgtcgtgttttgtgattagatggaaaagttcgaggttgttttgctgtggagtgtatttggttgtagtgttgcgtactgttgtatgggtaggaccatcaggatctggaccacttgctgttcctattacctgggagattatgatatttgttgctatcaggtgtcagaattttaattatgaatgttggctgttgactactccagaatgttggctgtgcattatattgtggttgtttctgatcgagaccctgattagatttttatagtcttgacacatgttttataagtggggttagtggtgggggtggggatgatcttggtggtcaactttctttattataaaacgcacgcactgcttggaaacaccatacacgatgccttttcccatataaaatactaccttacaagatcaccattcttggatatctatagtgttcagtttgttaagaagaattttctatcttggtttttctggacaacctctacaagctgcccatctaactgcttgcaactacctgttgaattctaagtacattttcaattactgttttctttcttgtctgctgtatcacttaaccatcacattttcatacacactatgtattattaaaggttagtctgtaattctgtatgcactaaccagtttatacacttccatttcttagattctggctaatcagtgtactactgttcagtcaacaaatttgttgctctctctcttgcatggttgcagccttgcaggggatgtacttcctccgtcccaaaataagcgcaaccatgagtttccgtgtccaattttgaccgtccgtcttatttgaaattattttatgattagtatttttattgttattaggttataaaacatgaaaagtactttacgcgtgacttatgttttttagtttttttcaaacaaattcaaataagacgaacgattaaagttggacacggaaactcatggctgcgcttattttgggacggagggagtagttggtagtgcattattgaacaaagcagatttgtgttgtgttttctggtgggaaggaaacatttgacttttgaggttattctgatgtggagtatatattggttgtagtgttgcatattgttgtatgggtaggaccattatgacctggaccacttcctagttcctattacctgggagattatgatatatgactatgttgctgttaggtgtcaggaatcttaactatgttgcatattttggttgctgtgactgactgaccgaggtcctgattagataatgatagtgttggcggtggtggggatgatcttagggtcagctttttttgggataaaaaacaaaccctgatgtgccaacaccatacaagatgctttttccctcaaaaataccatacaaaagtgtttgttaagcggaattctcaattttgtttttttttttttggacaacctctataagttttgcatgtaactgttggaactacatattgtgtgctgaatttattttcaattactgttttctttcttgtctgttgtatcatttagccatcacatgtttcatattcatactatattattaaaggatggtctgtataccctgccctgtttaaatgcttccatgccttgaaaattctggctaattagtgtgctactattcagtcaacaaatttgttgtggtagcactagtaggatgctaagtttcctttgtcaagattaagtcccctgaccccttttgcatcatctctgttttttttttttactctgtgtttgtgatggagcaagtggctcctccagatctacttgcagaaacctccgctgggcttcactgcgttgagtgcttggtcgctatgttttatatcatatattgagattgaactgccaaccttttctatcttctgtctttattggcaattgaacaccatttttgttatggcacaaccagggtttcccaaaccgccggggccgaggttaccgcgccctgggcggtaagcacggttaccgcgcggtaaccgtgaaaaatcttacgaaaccgtgcaaaatttatcaaaaaatcaaattattttttaaatttaaggaggttaccgcggtttttctattaccgtacccccgtggtaaggccggtaaccacgcggttaccgacggtaatgtaaaccctgggcacaacacatggcttctcattttgagtgattgtagatttcaaagactgcaacccccaaaacacagaacttgttctttagatctgagctagattacatggatgatttccttgacacctcagagagtttcttgttacttcctgttacttgcaaacaagattcaaatactccttcagaatgatttgtgtatcctcaattgaagttcacatttctttgctcaatgctaacaggtaaagtggttctgcaagcagcaatcctaacggcggttgctgtcatcggcctcaccattttcacattctgggcagcccacaggggccatgatttcaccttcatgtatcccttcctggccgccagccttctggtgcttctggcatacctcatcattcaggttatcttcttcttccctgctcaacctgctccgtttttcttttcttctcaagtgctgtctaactcattgtgcaattcaccgtgacccggcagatctgtttccctctggggagggctggcatgacgatctacggctgcctcgccaccgtgctgttctccgccttcatcgtcttcgacaccaatcagctgatcaagcgccacacctacaacgagtacgtcatcgccgccatctcgctgtacctcgacgtcatcaacctcttcatggctcagctctcgttctccatctaagtggcacgcctgttcttacgcccttcaacggttgtccagtacatggtggttcttacagctgaagaaacttagttacatttaccttacctaccatatcctacactactatatatgcagcgagaagtcttgcagagctggagactctggacctgtaattacttaatcatctctagctatgttgcactgtcgttgcgctgatagcacgatagatatattctggtacctttgagacatgtttgcagtgatctgcactacatcggtttagatctaatcagtggagcgaaaaacttcaatggagatgttaatttctcacaaatcacttgatttaatctgggccatgatcaagcaagcatctatcatgttttgttggtgtgcttgttgctcttgcatcttgccaatcagtctttgcatgatgcatcactgtggtctgtggacagaacttctgaagctgttactggcttgctgctgctgatggtggtcagatcttttgaagagtatggctggtgcctggtgtgatagttagcgcagcattattatctactgatgtgcacaagatcttctactgctaagtattttatttctatgaaattattaacatacactgatgatcacatgaatgaaacaaaattcctactgaaaaaggggtgtaaataggaaaaagaaaacgtctcctcaatatgggaaaagaaatctctgcctgtctctctattattgctactagctgtgctctgctgttcatcctatcatgaaggaggagaccagcacgaggaggaggtggagcagcacgccgccgccggccggcagaagggaggaggcggcggcgccggacttcttgacggtgaacgagaacggcgccggcggcgccgtccccggctgcgacccgttgaacatgctgatccccaggccggagcagtccgacccaagcgaacctgccaccggagaagaagaaaaacatcagtcgccggcgacgagctaggcccggcattcatccagccggccggccgcaggataagatttataaaagtttttgaataaggcaaacaatcaaacatgtttaaaaagtaaacggcgttaaatacatgtttaaaaagtaaacggcgttaaatatttagagacgaagagagtactaaatatttgtgcaattagcatttatttcgttgcgaaatgttttattgttaaaattattttaagcatgatttatatcttatacatttacatcatttttttaaaataagatgaacgatgaaacgtgagtcaaaaatatatatcatctactcccaaaacgaaggaagtattgcaaattaaagctgatgcttacactgccggtagcaagggtaggaggtgtcgttgagaaggttctggaagccgtcgtggcaggcgcagcggtggccgaactccgacgacctctcgcagctgccgccgtcgccgcagtactggaggaggcaagctgcattcattcaggcaacaatcaacgacggcgagaattaattaacgccatgatcagctaaagctaagaacagtttaatttgacgacatgatggtggtgattaatcttgtgggttttgagtgcagtagttgagagattattacggtcgtagatggagaggttcgtcagcgacggcatcgccggcggcggaggaggtggcggtggcggcgacggcgacggcgacgacgacccgttctggcacgagtagttgatggtgcctgcgaggaggaagagtcaacggtcaaactcttctctgggtaatcactgttctgcctacgtggcactacaagtcagtccagcgtgcgtaactacgtacacgtggcaactctttgtgactttcactttgactttggggttaaccgagcagtaaagcaattaacagcttgtactctgcttctggaatttggacttcttgacacgataagattaccgtaggcacgtactataataacgttacaacttactacttcctccgttacacgatgtaagttattctactattagtcacattcatattgatgttaataaatctatatctagatttattaatatcaatataaatatgggcaatactagaatgacttacattgtgaaacggagggagtaactcgtttgttctttcaagaaaaaaggtgaaatttaactcatgtttcatgagcaacttaatccaaacatgtggtggcaaagtccacagatgcagtttggacctttgttgcacgccgtttgaccaataacaacacaagttgaagtgtccattcaatgggtttgactatggcctcgtttacttcccaaaatatttttcccaaaaacatcaaatcgaatctttaaacacatgcatagtgcattaaatataaattaaaaaaaattaattgcaagtttgaaaggaaatcgtgagacgaaccttttaagcctaattagttcataattagccataagtgatacgataactcacatttgctaataacggattaattaggcttaataaattcatctcgtggttttcagacgagttatgaaactagttttttcattcgtgactgcaaccccttccgacatccggtcaaacgttcgatgtgacacacacaaattttattttcgccaactaaacaagccgtatgttagaggaatcttcccacatactcctagtacttagcaagctaacatttttatatttgttttttaaaagccataagttaatcatacacatttaagctaaaagtttaagcatcttattatttcctatttgaagtacacgtagaactacaccattgaacttgaggcttaaagcgcacatcgagatctctaaacttggtttattgtatcatttcgatccaaagcgtcgtttgacagtggtcttacctacgtggcacgccacgtggacgatgacatggtgtttttttttctttctctttttctttttcctcctattcttttatcttcttcctccactagagctacctcgagctcccccgtgtcaaagaggccgaagaagagagaaatgaaagaggaagaagagagaaaaaaaggaataataataataatgtgccatgtcgtcatctacatgtcatgtcaaatggacaagaccacggtcaaatgagactttggaccgggataatataataaatcaagtttagggacctcgatacatgctttgtaagtttgtggatctaaatgaaacctgcttacaagtttaagaaccgcaagtgcaatttactttaaaaaaattaggtacattctattctgtcacttgggacataaaaaggtgctatgtctgaaacatcgatgcctataaaaggagcgttaattgtaaagctaggatagtcgatggtggagaagctaatgacaacgttaagctatgatgagcttttattagctatcagtaggtttttattaatttcagataatggattaattaaaaccacgtgacctctacgtccaaacaaaatgtaacttgacaaaacctagtattatatggacagtttttagtagccgatggccgtggtgtttgcattaaacctaagcgaacacctctgcacaatcgatgttcacgtggttaactattcaaatatgacctaaatcccgaaccaaccgttaccacgaaattcagttaattaaccaaatattttcctggttataatcttcagtgttataacatttttcccctgatataaaacttcgcactatggtgcgggtcgtttcggaaaaaaaataaaagaaactttttttcagcccaataccatcgcacacacaaatcatcaaagagattaattgggaaatcaacaaatataggtaagtaaatcttgagaagagatgaaatgaaattacagttgggtatgacacatgggaggaaggggaactgcaggttgccgaggtggtagcggctccacccggggttgcacctgcacgcgaacccgaacacgtagtcgctcgactcgctgcagctccccatcccgcacctcaccttgctgcacctactcccatctccatctgcaaccaaccatgcaaccaagcagcaattcaaccaccaaaaaattcagacaagaaaaggagagaggaacacccatcgatcatgcactcaattagctagcttgcagtactattcaggcattcagctgctcactttgtgctcctgctccatctggcagcatggcgatcatggcctgcagagaaaccatcacaagaactaatctgactctgctgcacttcatcgtctctaatttcagagagttcagagagagagagagagagagaaggaaggtaagctttgtttgcaggaagataggaggatgtagtggcgacttatatatttttggcgtgatgtcgatcgcaatggcgcttggaactaaattaagactaaaaaagaagactgcacctcaagttataccgtcagatttgacagagaaaaaaaatggtcatcaccctaattaattgggcaacatatgcgtcctctccttgcttgtttcttccagaacatggagacgtaggagcaataatctgtgtgaaatgtatggatgaaactgtcttaggtcaattgatgtccatacttgattaattattaattgctctagttttgcattcactccaggccagtgccggcctggaatttctttcttccgtgtggaaataatgaccgagaaatacagataactgaacttttctttttctggttcattgaatggaccaacatttggtggcttggtgcttgctgaaatataatacctggctgctgttgatgctgttgctggtgcaatgatgtggcgtgtgttctttgcttctcgaaggttgaaaggcttgaagcttagagtcaacctttgtgtagggactttttcatgcacctactaaatcatgtctaaaaaaactttaaatctttttttccgtattatgattgtacgagtatatgataaaacagtattttcagtgttgggcttttcaccgaggcttagcttcgaatttttatttatttttgaaatattttaatttttattttgaaaacaaacccttcaaaacctaattccaaaatctaaactcttttcttcaacaccacctgtgacgtgacagttttattttaccacccaaccaaaacaatgttatcgctactccctccgtctcataatataagatataagggattttgagtttttacttacaacgtttgatcactcgtcttattcaatattttctgaaattattaattattttatttgtgacttactttattatctacagttctttaaacacaacttttcgttttttagatttgcaaaaaaaaaattaaataagacgagtggccaaacgttacaagcaaaaactgaaaatcacttttattgtgggacggagggagtaaaagatttagatcgggaaatagtaaggtttagtagtttttttaaaataaataaattccttagattctctttctcacatgtcggcctcggctgtgtgtagtgtaccgaacagaacatttgggtgtagttattatgttctaaacttgtctaaaatttggctaacaaaattaataaagacttgcatgatgaacaaggaatcttgtcagttgccacaagtgtgactacagaccaagccataaccagatgaccaactacagaccaagcccaggctgcatagtctcaagtacaccaaaaaaatacattcagatgtgtcagttgtccggacccatctttcccttaaagttggaaaaaagaaacaatacctttttttttcaaaaccatatcatttgcaattgcattttatcaccaatcccctacaacaaacttcccaacatatttcagctcccgcagcccatataaacaaaccgggataaaacacacaatatcacagaacctaaaagaagagaaaactgaagaacaaaactttgtcatggtgtctatgtcagttcatgttctgctgaagacaatgaaaaccctttctttttgttcctttctttcggaaactgtgcagaggaagaagatgccaaatcttccagcaagctgatcaagctacaaagagggagtccaccgaagggacctgcgtcctgcagcaggggcagtctggttggatggccagccaggggaggacgcactccgagtggtacttgtgggagcagggtagcctggtgacccgctggtgtcgctcccgcacttcgtcgaggcacacagcgcagagatcggccttggaaagtgtcctcctcatctcgcggcggggggcttttcttgttgatggcgcctccagcatggtcatcgaatgtttgggagtaggcctgggttcagtgggcagctgaatctgctgctcttgctggttgttctgttgtctggaggttgtgctcccatctcgttcgcgaaatcgcctgccccacctgcgtacgtaactgattgttagctcacaggaatatcgatattcagtttttgtcgttttgctactccatatcgaagcaggaagatgtttatgaagagaacacattgatgatggatgagaaaatgccaaatctttcaaaaagaattcaggcaagtagtagaaaaaagggtattgcaaaaaaatccctgaaccctcctctggaaaatggagatgtctggttagtgttcttatttaggtaaaaagtatatgcggaattaaccaaatcaattgagaaccaatgctacccaaatctgataacagctatattattctatatgcattttcaatttcaaacatctgataacaaaagctacccaaatcaattaaccaaaaccaatcacttgtgacaggtttaccattcatgccagtggtaatcccaaaaactagtaacaagatagttactacattttatatgctgaattgattactataatttgtgactatacccataattggttgtttggttaatgaagaccaggtcggatctttcaccggtagttttgtcaattttaagccaagctgcacaagcaagaagccatgatgtactgaaggatgattctatttactgaacaatccagaacccatgcagacgctgtgacgtctaaatcacaaatacgcgggaaaaagggcacacgcctttcgcatgcgtgtgcagccgttggcctaatttctggatagtacccaaaacaatcaaactgaaacagtgatggcgtaaggcatacatcggcaaattccctgtgcatatcattgtgtggcttgatctaacatgtggtagttttcagaaagcagagacatcagatggtgccatccaactagtttggcttatggctatacaaaataagatcacccacatggattaatcataaaagacgtcgttatcagtgggtttgcaggaagcttaaaaaaactaggtgattctcaatagcctcgtatcttgtcttgggaaaaaaaaacaaaggtgttcctatatcttttttttaaggaactaaaagtattctatgtctgaattttgctagtacacatggaattaaaagtattctatgtctgaagtattgtggaatagctgaatgctgaaattaagcaaagcctgatacactgttcatatggaattactcctatgtgataatatatagcttctagttgaatccaagaaactggttgatgaaacaatcagatcttggctcccttcttgccatcgaattcaagaaccgaccgatcctctcccccaattcgagcagaagtaaaatatattagccatgtagaacgcgatctttttttccacgagtccatggctggatctcaacacaaagaaaaggggaacagaaatgaacagggaaaagagggcacggatgagggggattcattcacctcgagagagacgacgagggcgcggccgcggcgccccgcagcttctcctcgagccggatgcgcgccgccaccgcggggctcacctcgccccctgcgcccgcccccgcctccgcgctcgccaccgcctgacggtggtgctgctggtggaagtagttgtagtgcccgtggtggtgctccccaaaccctgcccccgccgccgccccgtcgccgtggtagtgcacccgccgccgcctcgccagctccacccccggaagcatctcctcctcgtcgtcgtctcctcgatggggggttggtgggtgggagagagctcggagaaatttctcccggcgatttataccgagggcgcgcgatggcggaggaaattccgcgacggcgacgagaaagacgacgacgacgtgacgtggggtcttggaagctgctaggaagcagcagggttacttggggaccttgaggttggggtggtgaaattaccttttcgcccttggcatgatatatcctccatgattatccatccatgcataggtttgttgctagtagcttatacatgttttttttttaatatcttgaatctatgtttggtgtcttaggtgagatggtgtttgtgttggtatggatgatcgggtgatataaattatatctggtgacgagaacgggttttggattggctggctggttacttgacgtatcagcgcatacaaatagagtagttaacggaaaactgtaggggtacggtaggtgcgtgcaaagttgctttttccgccaatattgaatgtacgtaggacaaaaccgttgcataacaatatagatctaagcggtcgtttgagtgattaaataagtgaacatatttagagtttttttttcttttgaaacgatgacatcatgaaattagaaccgtctgcgtcgagccatatagtagataagtttccctctagttaaaacaggttgtagtagtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattgtatttatatgagtcgataagttatgtatctacgtttctcagagcatatcttaacaccataccttcaaatttttatctaagatgtcaaccaacatctaaagggttattcggattaatgccattttaaaccataccattttttggtgaagttgtcaaatatatgcatctatttagttcctcaccgaactctaataaatacataagaaatcctacgaaagcttggtgataccgttaaattgtcaaaattttggctacaccaaaattatttgttaagatttattttagttataatttgaataggtcctaacaccgggagtaacactataaagagtttaagacattcggtttcaaaaaaaggaaaagaataaagagagattccgatatgcccagctaaagcaacggattccagaaaaccagcttcttttcatctagaagtatcacgagatacttggcaccctgtttccaaaggggcaaaacggtcaagccacatagtgtcacggatgcttcgcagcagcttctccagaaaattccgagagcgcatgaaaaaaaaaagaaaaagaaaaaagaaaggcgaaaccgatatatatgcacattggatggacatcgtcatggccttatcaatcgatgatatcgtgacgttgataataccgagtcagaggttcaggactttgaataataggaacgaaaaaaaaaagaataaaagaaacataagatttgtatagaaatataattgcaaacacaggagaaaaaatatataggaatgaccgtttgattgaaccacaagaaaaacaaaaggatttgaggagagataaagatttttaaataattattttcatgaggttctaacttatgttagtgtgtagccgccgggggtactatttggggacaacttgcatgaagaagcctccaaaacttatatgggaagagacattccataagaaatttataggttttattcctttgattcaaagggttatgtaaaaaaaattctatagaaataaaatcctctaaaatttataggttttattcctttgattcaaagggttatgtaaaaaaaattctatagaaataaaatcctctaaaattcttatgattttccattaaatcaatggggccttctcggttggcataactagttaaagtaaaagtataaaaaaaattcgaatgttgattctaagaaaattttaacgtaatttttttaacattaacttttgagttgttacgaacaaatacataaaagttttacctataaattgtactccctctgtttcaaaatatttgacaccgttgactttttagcacatgtttgaccgttcgtcttattaaaaaaatttgtgaaatatgtaaaattatatgtgtatataaaagtatatttaacaatgaatcaaatgatatgaaaataataaataattacttaaattttttgaataagacgaatggtcaaacacgtactaagaagtcaacggtgtcaaatattttgaagcggagggagtatttattagggaatacaggtagccggtgagactcttcttacttatgtatggtatcggctggttcccgattaatttcggttgttccaatcaagtctattgaccggaatggctgaaattgatgtcacttgatcgatctggtaccattcttctaaccaactaggtgaaaccccgcgcattgctgcggaaatttagtatgatagcaataaaaaaaataacgtgtaaaatagctagataacatcagattaagtaaattaatgtggtttatgataatttaaatttaaatagtatgtagaatggtgatttaaacgtaaaaagtaaggtggtatgactttatgaaagaagaaaagtagtgagatagtttggaccgtagattaatcatctaaaggctaaaaacaattaatgtgatatgacttaattagaggaaaaaatgataaagataatttggaccatagattaattatttaagcactaactgaggatgaaccatataagtatataggatattataaaacataataaagatatacattgaaacattatgtgaattatattggataataatttaacatgtttgtatttgaaaagctcttaaattataaaaactataaagatatagcatgtttgcatgatgtttaaatgtgatgattgttagtggatgatgatgtgtcatcttgttagtggatgatgatgtggtatctttacatgttgagcttaaggagttagtgagggataactttacagtaagataggattccgtcgtcgaatttggtttaatcagttttttagaactatggtttaatcaattccttaactatgtttagctacgaagttatttttgtctatgccatatattgggccggtactgaccggagtgagatcgaaattgacataccggtatacgacttgttgttctacaataagtgatccttctaccgaatatggctttagtcgatttgaattatgtttaagtgtttaactattaagtaacacatatatatgtttttggattaagtgtttctctcattactaccatcgttgtcaaatattattatttcgcatgaaattttgatgaattgatgttaataatagatttatgatgttgtacggccagtatagtgtcattcccgtgaaggcagtcgaaggggttactggtatgtcaagcggcgtgcacgtcagtagtagagccatgtggatgttgtcgttgtggcaatgccgtcgatctcatccattaatgttgtatgatttcatttgcaggattgtttttttagttctaccacccttactttcttctaaagggatggttttgttctgtaagcatgtgtttgttttcgggattaggtgggatgggataaaaccatccctgattttggggttgggatgattccatttacttgtttggtttgtaggataggacaatcctaatttttttgtttggttgaagggatgagcgagagatgggatgggcgccgtttgctatcaccatcagcgagaaagaggagagtgagcagagatgtgtgacgacagccttgtgggagctcagcgggtgggcggatgagtgcgacgatggctagcggcgagaaggagtggcgcaagattgcgagcaggcggacagacagaggaggagcacggatgggcgagcaggggtgcagttggaggagcacgacgatggccaagcaggcggaggagcgcgacggctgtcgcgcgggcgaaggagcaagctggcggcgagtaggtagaggacgcggatccgcctccaccgccatccccaccactaaatccgccgttgccaagccccccgcggtcgctgagcccctcgcggtcgccgtcatcaagcctcccgcggccgccgtcgccaagcccccgtggccgcagccgcggtcgccgtcgccgagcatgccgcggtcgccgtcgctgagcccgccggtgtctgccgctgctcctgagggcgagtagggcgagcgcgcaggccggccctgagctcgagcaacgcgtcgtcatgccgttcgctcgtcccaactgggacgagttcatccgccagattttcccggatcggttggtcctggatctgagagggatattcctctccagggaccaacccatcccactcacccctcaaccaaacaaccccaaaagtgggttcgtcccatctcatcctatcccatccttgcaaccaaacgcaccctaacatctttggttgtagacattgtatcggggatttcatatcctctgaaccctgtctttcatctatactccctccgtcccataatatagcaacctaggatgggacctcatatccagattcgtagtcctaggataggtctcatcccatcctaggttgctatattatgagacggagggagtaatataatataatataatataatgagttcttaaaaaaaaagacattccactccttagagccaaattcaaatggcctctaaaataaatttgacaagctcaaatggtctctaaaattttagatcactcaatgactcaatatgatatatctaatttgatcataggttgctatattttgagatgaagagaatatttttttttcttcatccatttgcagttgaccctatactcaatctgatatatctatcactctatgtgcctctatcctaaaataaattacttcggtagtaactcttatgcacgaacatggacatatcaactttcatacataaaaataaaaaagaaacaatttattttttaagacagagtgtgtacactaaaaaaaaaagctcacagagattggcattataggtgccggagcagttaaaaccggcacctataatacttttcccttccctacaagttaaaaacacataaaaccgacaccttgagtaattataggtgtcagttttaaagaaaaaccaacaccgtatcagttttttattcaaaatcgccacctagaatttattataatggcggttttgtataaaaaaccggcacctatatggagccgagccggcgagccggccttatccatccgcctgtccttttattagtcgctcggtcgctcctgtctctctctcgctcttgctctctcgcctccctccatcgctctctctctctctgtggcaccggcggcccgatggaggcagcaatggcggtggcccgtcgaggtaggcacggcggtggcccgggggaggcggcagccccatcgaggtaagcgcggcagtggctggcggcggcgcgccctcccctccgctggatccggttggaggggaggtggtggaccttggggacggccgggcggtggtccggtggaggcggtggcggtggccgcgccctcccctccgcgagatccagccggagaggaggcgacggaggcggcacagcggctggcagcggacctcagcggaggcggcagcagcggctggcggcggccgcgccctcccctccgctggatccggatggaagggaggcgatggacgtcggggacggtcgggcggcggtccggcggaggcggtggcgccagtagcgcccgatggatttttgaatgattttgtagttcttttagatgtttctgtgatctgtggatgattttgtttctgaatatgtttcgatctgtgatttgtgagggtttggggatggcgcaatgactacgattgtgagttccggcttgattcgagccggctctttttttttttttgctcgtgcaaacctataggtgccggctctattttggtataggtgccggttgtttttattggtgccaaccaataggtgtcggttggaaaaccggcacctatagtcggttcccaaccggcatctatcatggctcttgtactagtggtataggctaactgcagttaattactcggtggtttcgttatttgtcctaaccatggaccattgggtctccatcgccatgtcactgtctcatatctaattggcatcttatggatttatgatgctgagatatgtgaacttccgtgtaaactctcgatggatcgatgtgaaagcttcaaggttttgagcaatagattatctaagatataatggccgagctgattcattcagagtctcaaaattaaatgtttacttggcctattaggccaccacatcaatatgaaatgaatctatgcgtagacaatgcaagtcagtacaaaagcacatgaaaattttggacagaagttaaaattgtactacctctttctcaaaattaatataacaacttaagttatgattttggacataagatatacgatcaaaactcattatatttttgagatggaggtatagtatgatttattgttaaaccaagaattaattcattaaacacggtgcacagtgcacacagtcacacagataagagtacgtactgatatcgacttgattgtcatttaatttacataccgctgaaaagatcatttacgctgattaaacatgcacttcattgtgtaattaggggtcttattatattaattagagagtagaaattggcgagacctccttaattatggcgatccgtataacagcccatatatatggcacgatcgcaggccgtctgtcagagcccaaaattagtaatgggccgtaattttaaatggcgatatgctaattccctctcttcaataccgtacctacgtacacttcatcactgaagaaattaaggaaataaagaatgcttaccaaaacttaaaacggaaaattaaatgttgacctccgatgtttagatcatggtaacaagcgcgttatcttttcgcttatgtttatgcttattagctaaaatttaaatttttaacattaaatttggagctgattttgatttttttcatcaaagtttatttttcagcctttgcttttaagtcgctaaaaacacgtatatgaatgttttatttacaaattatgtttcgtttgcaaatatgttatttggtttattccttgtgtagtctgcgcatatgtgtgtgttatgtggaggattatggctgtgttcgctgtagcatgttcccaactagaacaatgcgcacggaaaacggaacggttcattagcagcacgtgattaattaagtattagctaattttttttaagaatggatcaatatgatttttttaaggaacttttgtacagaaactttttgcaaaaaaacgtatcgtatatcgtttaacagtttgaaaagcgtgcgggcaaaaaacgagggagatgagttggaaaacctaggtaagaacacagcctatatgtgctcgtgctccacgaaacacgaaaacgaaaacatgtccatgtatttccttgtaggattgcaatatgattttagtataaattaaaatactataaggttgttgcaaaactcatagatttcaaaattgattggtatcgtatccaagaaattaagtgtcctctctataattgtttttcgatcaatagttttggggacaaatgtgtggtgcggtaagtcagtagcaccattccttatttactccctccgtcttataatataagagattttgggtggatgtgatatatcctagacaacgaatttggatagaccgggacggagggagtagtatttacaccccctaaatctttaaaaaattaatccaagtatacaaaataaaccaagtatatgtggtcacctatttcacttacacgttaaacttattagataaaaggatttctgttgatttgataaacctatacaaccttcccaccgtctcatttctttattgggtaatttggaaccatgccattataattttgcaaagtttgagatatgccatcggtatctcaatgacatgtaggatccacatgagtcaatgacattgacatgtgggtcaggatggtatatctcaaattttataaaattataatggcatggttccaatttttcctttatttatccaccgtagcttaggctgctttcggcaatagcagattgatgctttctaatctaataaataatgtgtgttttttgcaaaaaggtttttatatagcattttttaaacaatcatattaatccatattttaagttcaatatgattaatacttaattaattatgtgcgctcatggatcacattgttttacctaactggtcaattttctccttttatctcctctcaagcatataacacaattaacatttaaagtcaaactagtaaaatacccaaaaccctctcaaccatccacgaggagacataaatagcacactccaaaccgcaataccttaggaagggaatgtttggtagagattgaactcctaaatttaggttgaagagttgggactagagtggagttgtggagcagcataaacccagcttcacctctctagatcattttgtgagagagctccacccaactcctccctcatttcaggtagagctaaggacctgtttagcacatagctggagctcagctaaacagtttcagctccacctaaaatggaagcggagctgagtggagcactcgcataaaataaactagagagatgtgaaggtggatttagacaactccacaacttcactacagacctaatttctgaagctaaagttagaagttagagctctattaaacagaccctaaaacacagttggactaagaaacgcttgaagaaaggaaaaaaactgcaatatcttatttctcttgtcaccttcaccaattttctttccccgttggtttgccacctcgccaaaaaaaaaaaaaaaaaaaaaaaaaacagaaccctctcacgtgtggatccaccgttggattggaatggaaccccctcgcgactccgccagccgttacctcgtcctcgacacgccatccttttcctcccccacgtacaaaaccccccctctccccctcgcgctgccacgtatcgctctccctcctctctctctctctctctctctctctctctctcttcgccgcgcggcggaggcgttcgtcgcgagctgtcggcttccctcctcgcgcccgcggcggctgtggccatggaggtccccatctccggcggcggcggaggggagaggttctgccacgcggcgcaggtggtgggggcggacggggagatggacggggaggcgatggcgcggttcgcggcgggggcggggctcctgggccgtggcctctcctacgccgtcgtctccatcgtcgggccccagggcagcggtgagagaaccttaccccctccctcctcctcctcccacgatcaccagttcaccacccctccatctccatgtagagagcagagtagtctgttagtacttgatgcttgttgtgtggttgatgggatatcgagattggatgacgctagtagcatattctgttgcggaagtgtttttaatttttttttgcaccgattttttactggacatgtttgttttggtgatttggataataatatggtagttgaaattgatgtcgggaacatctctgatgctgatgctttgccttgttactctggctagggaaaagcaccctgctcaaccaactcttcgggacaagcttcacggagatggatgccttgaaagggaggtaaacatttacattgctgctgcccaccgaaatgcatgcgcgctgcttttcttgtttgctcttcgattgcattcaatcggttgtctcacatttggagctaagatgatggattctgttcctgttttgtttgtttggttgttgtcaggagccagactaccaagggaatttggattgccaaggctgtaggcattgagccgtttactgttgtaatggatttggagggcacggacggcagggaaagaggagaggttgagtgttatgtgcttttattataataatgtttatacgaataaaaaaccttccataccatgtttccttttgtaagattctgagtacaactcttccatgccatttctaactgcgtaaaatatttgatgttttatcttgtggttaattagtagcagtagtcctgtgtacctgagtatttaggctgtggaaaacaaaaaggttgcttttctagtacttgctttatccacatgtggcgttgtctcccttaataagttttttgctaggaccttagggccttatttccaaaatagttgccatgtagtgggtgtcattagaactcggcctgcaatgagctgtaaatgctgttattgttgttgtagtacaattacttaatcaccctgtacagctgattcatgggagcatctattagaaatgcaaggaagtcatgcattcatactaattctctacgcattcctgttcaatacttttagctgtgatttctagcatcaactctgaatatctgccgctgtcatttttacagtaaattgtgacatctcttttgttaaagtgatgctctatatctttcactttcagtctatcaatctctgtgaaccgttcatttgtgaagctacatcgcattcggtcctcatccaaattccatctgttatgcttgcaggatgatacagccttcgagaagcagagtgccctttttgctctggcagtatcagatattgttatgataaatttgtaagtttctatatcgtttgatacttcattattggcgaatataacgttaatgagtcgggagaacttcattttgcttttctcaaccttcttatgtggcttggtgaatatgccttttataggtggtgtcatgatataggacgagaacatgcagctaataggcctctgttgaaaacaatatttgaggtagcatccgtctcagtgacactaatcatgacttttgtctcagttacatattttaatctattcgtttttctctttctatttgaggtattgatgcgtttattcagcccacgcaaaacaacgttgctacttgttattcgcgataaaaccaaggtttggacagtctcagagaaaaccaaataaaatttacaaaatatgttcctcccatttcttgggcagacatccttaactggtatgagttttttttttttattgtctctgcagactccactagagtatctaacccaagctctgaaggaggatatccagaaggtgtttatgtcttatgttttgctcagctgcctttcctcattgccacactaaaggttttaccacttcttctgttcttacagatatggaatgctgttcgcaaaccagaagtttacaaggaagctgcactaagtgaattcttcaatgtcagtgcttaggttttctgaagtggaagttgcatatataaactgatatatatatatattttgttatataaaggtggaggttactgctctgtcaagttacgaagagaaagaaaatctatttaaggagcaggtaaaatacttattttttatcctgtaccacagaatgttctttctactaattgcataatcacattcaccgcagaatgaaacttacaacttgcaagcgtgtcacttcaatggagacatattgtattgttacttacttctattgctacaggttgggcaactcaggcagagatttattcattcaatcgctccaggtggtctagcagctgatagaagaggtgtgattcctgcttcaggtttttgtcttagtgcactccagatctggaaagtaatacgggaaaacaaggatctcaaccttcccgctcacaaggttttttgtgcctttttggtgcttttgattgtgaacaactaaatacttgcattataatcattaccaattcaccactccatgaacttagttgcaaatcatatattatattttatctgttccatatattctgtagatcatggttgctactgttcggtgtgaagagattgcggatgaaaagctcagaagtttcatatctgataaggtagcgtgttctcattgttgtatctatacattattttatttaattggtaccatgagaattaactattcatctctgcagggctggttggagctagaaacagctgcaaataacttgtctagtaccaggctttggaaagaagcttaatgctattcttgatttttatctatctgagtgagtgatatgactaattatccttacaatgttttcaagtattaaagtgtttctgttcttgcttaacatgtccattgacctgttagttttattttctgctatctatgactaattatcctatctgcagcatgtccattgacaatgtatattttaatggtaatctgaaagaatggatattcctttgttgttcttatttatgtttcttcttccaatggttttggagttttctttttctagtaaatagactatgtttggggtcatggatgccacaaagtaaaaatatagagttcttagattgcacatgtaacaaatgttcatttatttttattcggagttctgacagtcttaacttaacattttcctgcaggtatgacacagaagccatgtactttgatgaggatgtgagaaccgctaaacgccaacagttagaatctgaaatcctaaaagtgagttactcatttctatgttactaattccagttatggcttagagaaagtagtttaaccagatgatggtgtttggttatgaagattacactagtcaatgtaggaaaatgtttgtttttcttaataattcttgcttgttcatgacatttcaaataatggattgctaatatgcacacatacattcgaagaaaggtcctataaatattttaggcactctggataattacagtgataattgcatatatgactattataatataaaaatttggctcttactaattagagaggatgacatctgtcagaaaaatgtaaatcgactgttttatttgtccttatttgatcaactggtctcataaatcttgggttttgcagcacacatatgatgctttcaagaaaatgttagaacacctgcatcatgtggttctgaacaaattcaaaagtgatctagaacaatcattaaggagcggtgagggatttgcagcatcagctcgttattgtgtgcagtcatcaatggcggaatttgatgctggattgagaggtaaacaaaccacggctaagatttattgggactaaaatatttagccatttgtcaaatgtgacatgcatgctgacctctttctgctgtcatttttttgtcctgcaaatccaatgctgcaaaagccaaatctccatagtttggtgctcatttgatagttttattgtcaatgaatgtctaaaccatacgtcgactagtactatgagcctttgcttcttgatcttgttttaagcctcttgtgcttgctcctgccaaccatattgtgtatgtttttcaaataatagtttattcattcagattatactagaaatacggcaatgttcaacataagtaaattcctagtagtttgaagtaatgtgatttgaaactcatcattccttaaatctttggtttacgatacatgacatcaagtccctccattgtcatgcagatgctttggttaagcatgcagagtgggacacgacaaaagttaggagcaaactggagcagcatatagaagctcatgcaacatctgttcggggtacaaaactggctgaactaaaggctaattatgaggttatttttcatactcagtgcacggtttattattgcaatttcagcatgttcctagaattccccatttcatgagttcttacggtggatttttaaaaaaaccatcctcatgcttggaccttttgttgccgcaatgttcagaaaaaactcttggatacacttgctggacctgtacagtcaatcttggaaactggtgaaaaggactcttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctgtagaaacatgatctatgtatcaccttcccactgcaggctttaagacttatgtcggtaatggcagctgtacgtttggacgataaaccagataaaatagatcgggctctaacgactgctcttttagatggaggaccgctttcacagaaaaggagtattgaattcacatctgatcctcttgcttcaagcacatgggaggaggtgctgacacttagatttagaaatttatgatttagaagggcaaatgtgatgaataagtcgttaacatttttaagtctgtacaggtgtcagaaaagaatacgctgatcacaccagtgcagtgtaaatccatctggaggcaattcaatgcagagacagagtatgctgttgcacaagcaatttctatgcaggtatatttctgggccatttctgttcaagtgggccatttctgctcaagtgcttatccagtatattgcataacactgatttattttgatcaaatggataggtaaaacataactgaatttgttgttttcttattatgaagagtgaaccatgaaccctggcctgctaatttcagaggcgggtcttcaatgcccttaaaaaaatactaaaagaagtgataagcttttcatgaaatatgttctttttgtccattatgtgaaactccatttatgatatttctatctgattgttggtgctctgtgcttaccaaattttcttccaccaggaagcacacagacgtagcaataattggctgccacctgcatggactgttttgcttctcgcaattttaggttacaacgaatttatattccttctaaggtaatcatctcaatgaagtagctttcttatccttataaacgcataaactgagaaatccgaacttgacggttaacatatgtaaccactaaccagcatcttctctctgtttatgaactcttggacaggaaccctttatatctgctggggctcttcgtcgccttcgtagtatcctatgctgcatggttgcaatatgacatcacagcctattttcgccatggcacggtaatattctacagaacgcgtttcgcataaattacatcccagtgcttttttatcaaagtcgctgttgctagaaaggagtaaaggggctggatcaccttagctggtttcatcaggcagaattctgctcttaatttttattttagataatggataaaaatccggcctctatatccacaagtggatatacagagccaaactgctcttaaatttctatctagtgcatttcagttcaactgaattacacggcatgtattcaaactaaatctcaaggatgttctttcatatgcagctctcaggtcttctgactattacatctgggtttctccccacaataatggacatcataacagcagtcatcaacatgagtcacaaccagaagagctcctcgcacccgcctcgacatcgtcccccgcttcatcctcaaagcttcaggaaccaggcgcagcaacagtctcaggctcaggtgcagtatcaggctccaagttcactgtcatcatcctcttcggtgggctccaacagcgatgacgaatcctgaagcctcataaaacatccctgtagaagacacgttccagtctccaggaaggactttgtataaaagaaaaaggaaaaaaaaaagaagaaaacttgatgtgtaatgtactacatacactgtgtgcatagctgtgagcagagttggtgatagctgattagctgagcagcataagttcctggataaaccaactgtatgtcagtatgtgtagagatgatggatggaaatgaactagatgtcgaactaaataccggagtaatagtaaatttcttcttactggttacttaattacagccttgggtttgtctctgagttcatgcattctctttctgaaaataaaaatgtctgtccatgccatgacctgcatatacatcacaatgactccatagaaccaaactaactcgattcacaggagcatcttcttccaccacacgcaatgccgcatccctacatcattcagtcagttcagtttgataggagaaaacttcactactgttatactgaattactgatgcatgcaaggatctttactggtgtgttaaacggattgatacagtaacagaactggatagagttataaacttgctcgcttgtgcctgcagctatgcaccagcagcacaaattctgctgcagctgctgcagaagtcaacccttccaagcacccctctaattaatatagatacattggctaaatatgttcaatgaaatgtctcactttacccaaagttactgtaatttaatttctttgcattaagcagtaagaaactaccgcatcatatggcctgaaactgacactgacaaacctttcaaatgtattgttctgttctatgttaacattaacagaggcatagagctttcccaagataaattgctgacttgagatgccttctagttagcagacgagttaattagtactctaatactactaattatctacctgtacaatttcgttttcctggttacatggacatgtgtgccgttgcagttactgtaaaattgccgtcagtttcagcatgttgcagccttgcaggacaggaaattatcagaatcaacagagatcatgcaacatcttatgtctgctgctagccccaattaataatactgtacagtgatgttgtcacgctagcttgatctggacttctggaatgatcataattcaggattaacaggaacttggcggagaacaaagcaatgcattttctcaagcagagtaaaagtaatttctcacaacattggaaattccagattcattccgtcatctctccagcgctagcttacacatagccctatcatttttatacagcttatctaccattttcttaaaacaaattatttgctttacacggtataaaaaaagtacatattagggtggcatgattccaacaaacccttttttaaaactactttattccaccgcatcacttagaccactcttttttagctatatgttattttcaaaatatgtaataatttacgaaaataattcgctcaataatctaaagggaaactattttaatccctcgagaggatatcccctcgttcaaatttaacttctacatttcgtaatgaaaaaaaaacaaattgaaccgcagctagttaacgtatattcagagtcaaatttgtttttttcgttgcgagatgtgaaagttgaatttttacttgcatgtttatggagtgatatgttacatgttaatacattttctcgaattttttcaattttttttcataaccatttaagtgacatacaaacaacgagagtatatccactcgagggatcaaaatccacttcctaatctaaatcaaacaaataccttactcaaagggctctcactttatttatctcttctttttcgcgaacgccactttatttatctcatacatacacctcttccaagcacaagtgtactgcaacaaccggatacatagacatagtagacactagctagtatatatagcttccaagtctcccccagatatatagaagctctcctatcggagagagccatggccatctatctcctgctcaatttattcctctcccctccctcgcgtacacattcgtgtgtgcacgcgcgcgagcagcacagcactagctctaggtcgatcgaccatggaaaccctagctagctataccctacacccggcgaagcagtatcttaattacgttacctttaattacactgcctggaggatggcttcggcggccaccgtggcccatccatggcggcgctcgtggcagtctcgcatgcaccgctgcctctcgtgccactcgcggtggtgctggcattgcctccggcagtggtcgccgccatggccgccgccgccgccgtggtggttgtcatcgtcgacgacgtcgtcttcctcctggcgcctgtacctgcagtcctgcatgcattgctgcctcttccattggtcgtggtggtgctggcatcgcttgcggcagtgttgctctctctcgccgccgtagttgtggtcttcttcctcgtcgacggcggcctcttcctcctcctggcgccgccactgcctgcagtcttgcatgcattgttgcttcttccattggtcatggtggtgttggcactgcttgcggcattgctgatcgccatggccgtcttcttcctcgacgacgtcgtcttcttggcggtgatggtacctgcaatcttggatgcactgctgcttcttccactggtcatggtggtgctggcactgcttgcggcagcgatcgccgccgtggttgtcgtcttcctcgtcgacgtcgacggcggcgtcttgttggcgctggtggtatctgcactcctccatgcattgttgcttcttccactggtcgtggtggtggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcgtcgtcgtcgtcgtcctcctgctgccgctggagacactgctcctcgcactccctcagctgccgctggtcctgcccggcctcccaccggcactgcttcttgcaccaccggagctcctccttcgggtcccgccgaccctcctcctccgccgccgccgccgccacggccaccaggagcagcccggcggcgagcaggaggagcgcgccaccacctttccacttcacacccatggctagctggaagaagctagcaacaaagcaccgagatagtagtcgtacgccgtcgacaggtggtggtggggaatggcgttggaggaggcggaagcgggggtgcatttaagctcggcggagggcggcggcgggggggaggtggcgaggcgacgtgtccgccatgggctcatgcagcgagcccacgtcgcgcgcgggggaggggggagggtggtaggtgtgagttggcgggtagcggcggcgcgcggtgcaactgctacgcggcgggcgcgacgccgatcgggtcgttttttggggggggggagtaggtggagctcgtcggtttcttggccatgccatccatggcgaggggatggcgtgtacgaggatttggatgccggggaagggacgagctggcaagcatatatgcacgtggatatgggtgtggtggcagccatgggtctacgtggaagctgggggtgcatgcatgggccgggcaaaattgggctttatttcttgggtcaaaatgggccttatttgttggctggtaactgatctggtgtgctgcgctgggcttcgacgtgctccgttggatcagggctggtaacttgaagtggacacgccgtcttctacttcacctctcctcttttcttctcttccgttccctcatcttcgccatgtgggagatagccggcgacattgtcataggctcggtcgattcgagataggaggaggggggaaggggggggaggggggcagagcccacggggacccaaccggttgccgtggtcagcatgcactctggcacaatacctccatcgtccgattgctccttaaacgcgcaagcgcaaccccctcccttactggtttccacctctcttgcacggaggccaaggtagcacgagctcagacgagcttgctgaccgccttcccctccctggactaccctctatggcagcctagcgtggtagtagctcgcgcctagagtacctctcacgctcctccgtccacctccctcgcatggaggccgggcgagcttgagcttggatgggctcgccgaccacctctccattcctctcccgcctcggactccttcagccacccctcagggcgacagcccgcaccttgaccgcctcatctgtcgccgccttcgtgaatgcgctctccctacgtcttgcgcttcttcccgaccgcctccccatcaccagggtccaggagagaagaatgaagcaggcattgccacgtgggccccatggttttttatttatttttgctaactaggatgccacgtcagtaaaaccaaccacctatagtgtcataggacctaatttagtccagtttcgtaagttggggttaggattttagtattgtgtgtagggatatgatatttaaacttgatgaaagatgaggaaccttaagtatacttattacgattatcaacgatgagtcggcccttggattaggtgttctattttttggtttttgtgttgagaataatatggttgggttttcacgttggacacatctgggctttgaggttaaggttgcaatttcgagtaggaagttgaagcattttctgagttgaaaagtcaagtttgcaattttgagtagaaacgcgaatcatttgattcatttccgagttgaaaagttgagattgacaatctcaaagttcaaagtgaattcttttttttacacagttcaaagtgaattttggttaaaaccctcaggttgtatttggataatgggaaatatgtggtggaattgggattgggaaatgaacgaagggttaggattaaatggaagaaggagaataaatggttaaaatttaaagatgtcttttagtgggtgggaaatgatttccctttcccattagccaaacggggcctcagtatattttcaattaacagaagtttaatacttaataatttaaatgacagttcaatattttagccatgacacatggcatccaatgaaagggtcgtccactagaaataaaggtgacagacgatcactgaataggtacacccataccagccacctttctattgtctttgcacttggattgaaaagtggtcacaagggttaaaaccctgaatcattcggaaatgtttttgccacacaaatgagttccaaatacactgagtgacactacgggtcagtcactaaaatttctgaaatgttgttacctactcgtctctttgtccaaaaataaaccaaactcgtacggtgtgaatatatcttcaatgttacctacactgtacaaggttagcttattttgtaacggagggaacatacatctttcgataacattataattgttgtgccgccttggttcagttcaaatttctttttacaaaattccgcttgcatctttgtcccggcgcggcaaaaaaaaaatccacaataaaggtatcatataaaaacaatgatggcagttaatcagtttaggttggtcactatcttaatagatgcaaattaagttgggttgtagcgaaaccaacgaacggcatttgttttgtgctcccacgatacaatcccttaaatcagcacacacgcacaatgcatgcaccacattttagatcgatttcgtagagaatatttcgatcacatagccacaattaatctacattctagaagctccaacaaacttatttaattagttcctgcaaattaacatttacaaatatctcaaactgaagaaataactttaattgcaatgccggcagccaacccggcgtgtatgcttccatttgttcgatgtaaagtgctgtttatccataggaagagatgtaatattaataactactccatccgtttctaaatatttgacgtcattgactttttttaaatatgtttgaatgttcgtcttatttaaaaaaatttaagtaattattaattatttttctatcatttgatttattgttaaatatacttatatgtatacatatagttttacatatttcacaaaagtttttgaatatgacgaaaggttaaacatgtgctaaaaagtcaatggtatcaaatatttagaaacggagggagtatgtttgttgaaaatgttttaccttctctcaatcttaataaatttggtcagggcaggcacagaaaaaaaaaaacaggaagacataacagcaaaacaaaaacagtggaaattaagcattgctaattacaaacttttctgatcattcacaccattttcatgtttgatccagctcaaacttcactacaacagcttagaacactcttagctagcaaaagtcctaatcacagccattataaatagacacaagcaattagcctcatctacacacactcccatcactccaattaaccaaagctaattaagctagctcaagctctaatccacatttagctagaatggcgccgtccaagtccacagccgccgccggcgtcctcctcgtcctgctcgtcgcggcggcgggcggcggcgcaaatgcggcggcgacgacgtgcgtggcgtcgctgctggagctgagcccgtgcctgccgttcttcaaggacaaggcggcgacggcggcgccggaggggtgctgcgcggggctgtcgtccatcgtgaagggggaggcggtgtgcctgtgccacatcgtgaaccacaccctggagcgcgccatcggcgtcgacatccccgtcgaccgcgccttcgccctcctccgcgacgtctgccgcctctcgccgccggcggacatcatctccacctgcgccaacgagaaaggtaaaatcaatcaacgcgccgcnnccgtggcgtggcgtggcgtgtgcagaagtccaatgcagacggttttcgaatcatctaagttgactctacgtctgtaataatataacactcgtctccgtaaattaaattctcaatttctgaatttttgttttgccgcgcgctgggctccctctcttgtttaaaatccaagagataggcataggcccaatacaggggttaaaatttccgtccaaaacttccgaaaattccaaaatttgggaatttaggatcctcccctctcatgcaactatttcatacaaaattgttagatttttaaaaatatttatgaatctggttaaaattagttgaattcagtcaaaatgtgtttaaatttcaaaatgtttcgttcgaaatttctgaattttgatacacccgattttttttgtccattttggaagtacaaagcccggggccaaacgaatgtccaaatgatcaagtttaaaatctcagttctaactaggactttgtttatttatagatttatatgttttaaaagtgcaacgttgagtagtgctaattaactaatgtacatatcatgattgacttgtgtgtaggtggtgtgccgcctctctactcttgcccggctccatctgcctgaggtaaaccgtcgtcaaccacaaaattatttccacaaaagagcctataaccatgctaaatttctacagtaactactcatataattcagctgttttgtttatattttttttaggggagctgttttgtttataatgacaagtgctttttaattcatgcagtatatatgagaaaagaataaatgttaccaaaggagggatttcaacatatctaaaagtcaagatggagtaactttggtatacaagaccaacatatatatcacgttgttaaaggacaagtagatattggattattggcatatactgatatatccatgctaatattagtatatgtatattctgcaacatgcatggacatacacattgtcaaatgaagtactaagtaacacggaacgtgtactagctcgtgctactgtcgtgctatgcgctgtcaatagaaataaaatattttacattgtggtattaagcattaaagccatattgtattctaatattatcgggcggagattgcggattattcctaccacacttttaaataattacaatttctctaaaaaaaagttgctatgtcagtattttttacagcacttgtttatctctactattataaaaatttaagatgtttttgtcgaggcttttcgtacgtcaccgcgagatcgtgtcggacacaaaaaatcgcaaacttgccgatatagtttaatttttttccatctatcggaataaatcacgtcagaccctaagcccacttggtcgcgttctcccctttctttcaacagcctgtataggtgaggcttacagccgatacgagcagcggttcccgatttcccgcgagccacgcgctctcacacatcgattgtgattctaggacgagcctgacacagatcgttttttcttccaactccacctccaccaacaatatctcctttgtatgtacgtacgtatgcacccgctgccacgaatagatctatatagatcgagaagcagagagaattaaggtcttgatgggtgtggtaagaaggcaacggcagcgatggctggttgatggtgatggtgttcatgtcggtgaaggcgtggtaggatgtacgctgacgctctgcggttgcgatcgcatatattaacagggcggagctagaacgaaatggatggtggtgccacttacttaaattattctactctagatcgaatttaagctgatgcgggtgcctaagtttgtattgagaggatacatacatggtgaaaatagatgatctatagctaaaaaattttcttgaccgggttcctggacaccccctagtatactctagctccgcccctatatatatatatatatatatgaaggctagcatctggtgggtagagacaatggctgtgggctagcggcatcgatcaaaattaagatagtcgagcgcgtcatcacagccagtgccggcgcgacgcgacgcgaccgatcgacacgcctcatacgtcatcatcgccgtccgtcctcgatcgatgtcacccaggccacatcgtacgacggccactatacggtggcgggggccggcgaacacgacggagatgctttccatgcagtacggcttcgacgacccgctggagcggtttgatgatcgacctctctccttcacgtccgcgcgcgctgcttcaactcccgctgtcccgcaggccgcatatactccctctgttttaaaatatttgacaccattaaatttttaagtatgtgtttagctattcgtcttattcaaaaaatttaagaaattatttattcttttcatatcatttgattctcatgtacatatatagttttacatatttcataatttttttaataagacgaacggtcaaacatgtgctagaaagtcaacggtgtcaaacattttaaaacggagggagtaggatatatctacgtccgcgcgcttgtttcctgctcaacttccgcatgttatgttaggaccaggcctcgatcgccaagctccggctgcaggtccagcatggggccgcgtgcgttagtgtacaaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggtcctgttttatcatgtgtttactagctgtttaattctttgacgggcacaaaactttaaaaacggaccatttaatatgcacaattaaaattgttttcacccgttgcaacgcacgagcatttatgctagtaatatataaaaatttaattcttccttataaactaaacgtcgggattttattttattatctaacaaactgatcgatccattcatcaagttttatctgtatttcatataagaagcaatccataattatcatattagattcccttctatcaactcagcatattgaagatctaatgtgaccatgcctacgacggatataaccattgatcatatcatatacccacaggtggtctcgtttcataacaagtgccaaattaatctaatcaagaatacgacactacctcataatgtatgcgtttatatgttcatgaccaatccacttatttggggctacatatggaagataaacacgatggccatggtgcatgcagagatggagatgaattgttgtttaattggaattattagaaatgattttaaaagcctagaagagaagatctaattttaaataataaattccaatataaaatggggccagataaaatttcattaaatactttgcttgattctatagttcctagagttttctgggatttatttgagccaaggaagtatttttaataaatggaattgcatttcatgaataatttaaattggaaaatattttaaaagtcctcttttggctttgggccgaaagtcggcccaaaaccttccctctctctcctctttggcctagtcagcccgcagccgcccgcgcgcgcgcgctcggtcgctgacaggtgggtcccacctgtcggactcgtcgtcctcctcgcaccgaaaccctagccgcgccgcgccgccgccacctttccaattcggccgcatctttcccgatccggtgaaatcgtttgaggggaaatgctccccggaatctcctctaccttttttccttttggaatcgatcgccaattcggtttggaaatccgtggattcgagttcgattcggatcgatctctctcctccgaaccctaaaccttccatcgcgtcgccggtcgccgtgggccttcgccgccgcctcctagcccctataaaaggacccccggtgtctccgttatccgtcgccaccctcgccattgcctgccgccgtctgtagcgccctagcaccgtgcagccgtgcgccgccgtcgccgccgtcgccgccgcagctccagccatgcgccgccgtcgctctggtcgtcgtcgctgctcgaggaggtcaccgtcgtggtcaccaagccgtcgtcgatctcgtccacccctccgtcgtcgccgtaggttgccggagcactgccgtcgtcgtcaagccgaaggtcgccgccgcttcttcctcgacgccgtcgccgtccgttgatcttccgccgctgttttggtcaccggtgagttcgccgcgtcgccctctacgtgttggtgtcctccgttcgtgtcgtcgcgccgtcgttcgccggcgagcttgtgcgcccgagccgccgccggtgatgacgtcatcgttgccgtccgtcgtagaccggtcgtagaccgttagatcttggccgtccgttgtggataggatcgatctcggccgttcgtttccgtgagccaccgccgtgcacccgatccaccgcgaaccctagccgctgacgcaataatacccttttccttttcaaaaataatgcattattgcgtcataattcaattaaaatccatataaatgatttaatctgatttaatcattgaaaattcataactaattcatcttagctcggatttagttggttcaagtctctaaatttttctaaaattgagatctacatgttaaaaatatccacatgtactgttcatgcttgtttatgtgctgttttggtgatttagctcttttctctttagattccgacgttcctggagagtctgagtttgcaggagaagattttgaagagttccaaggccagcaaggcaagtcacacagatcccaaacaaccttttgagcatgttgatcccatttaaagctattgtttctattcaactattgcatttattttcgaatgtcatggggtggaattaacctattgtttgttatagcctttttgttcttgattactttattccttgataccttgggttattataacttgactagttgggctttatatattggttcagctagatattagatatgattgcttagccatgcttagaaacattagcacactattgggataacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcatgagtttcggttgtgagatattaaccgtgccaaccacaagccagcgtgggcaacagctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctgaccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatagttgttcagaatggttgggcctatgcaacagggtatgttgtatagcgttggattaatattgtttaattactacttaactattttattaaattctgaaatgtttattaaatgctgtttatgcaaatgaaaccctactatgccatcctttgttatcctgtgcacttgcatatttgctgcatggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctaaacgagggttcacacacatgtaagcgtttagaattttggatagaaattccgggcgtgacagcgttctggaatccaattcggcctcctaagatagtgctgaattcaaacggtcgccaaatctccatatggcctacgttttgggcccacgagtactttatggaaagctctcggaatcctctttccaacgaatccaacctcattgtcaaattccatccgagtcatcggcattgaaaaaacaaggggctgcattgtctgtaatgggcctataggtctgtaacttcgtctgggaccctggtccaaggggggctgtgccctaaacagagggaggacgcccttatgacctcctctatcctttaaatagctagtaaccccttcagggttagttgggttttgattaattgtaagtttagctattgctacttcgcttgtagcacgcgtgtcggctagaccgtccgtctgcttgttcggaaccccactttatcgtatatcaattcatctttgtgcgtcttgtctatctagcaattcagttgctttctatcttgttcttacttgttctcgattgcttgcaggaatagggttgatctgcaccagcaagatcaacaaactctcggagatgtgtattgatcgctaaggcacaacataacaacgtctcgtacggttgtagtcggatcgtcaatatttctcctaaatcgtagttatctcaactcaccgaaagatcaagccaccccatacatatcaagatcttaggccccctataatttttccgattcatttttggaaacaaatgcatttggatgccaccgaagagccgtgtttgtacttgaaaaaaactgatcaaacaactttgaattattctcgattctggaccgttcaaaactgattggacggcttagatcgctcaactacaccatacatacaaccactcgacctgtttggctaggaaacattcaagagtgccttctccagccaactcgacgagctccccgtccacctctttcgcgaatcgcgatggccacccctaactatacatcactctttctgttctaatataagtgtaacctagaccctttttagatcccatttcaaaatttttcaccctgtcacatcgaatgtttgaatacatgcatgaagtattaaatataggctaaaaaataactaattgcacagattgcgactaatttacgagacgaatcttttaagcataattgctcctgatttaacaatatggtgctacagtaaatatttgctaatgatggattaattagacttaataaatttttctcacggtttactaacggattctgtaatttttttttattagcgtcctaacaccccatatgtaatacaagtacctgagaagacagactaactacgattcggcaaggaaacctatgccgaattgcatctgaatacacacattttaacagaaggcaaaatgtggagcaatgcaagcccacgggttaacgggcctgccaaaatacaaccaagttaccagaatgtgcatccaccagccaagcaaatccaacggctgacaaaatcgactgatggattaaaatttgggatcacctgtatattttatcgacaaattttcttctaaaaatttaatagatataattataatataatcgtagtgtaattatattataacttaaatgtgaataccgtgtaacttgtatataagtttcacgtaattttgaatcgttagatcttttacaagatttgttctggtaagaaagaaaaaaaattacagtagagatatgtgagaggatttgttctcatgacctttattttaccgaaataacatgttacggagattacgaagagatatttaaaagttacatacaagttatattataattacactacgattatactttaatttacatatgtcaatttttttgagaaaatttatcgcaaaatatatagcaaaattgttaaaattttgcaggcgcttgcaaaatagaaaacctgagaaaaaaagaaagaaggaaacactcgcgtggctgcccacccgccgccgtcgccgacaacggcggcgcgaagccgcatcctctccgccgacgagcacgctggcccggagtcgtcgccgcttcaaccgccggccgtcctgtcctcggagatacggcagcgcgtggcggcccccggtggctgtgctacggcggccaaaatcgaccgccggatttcctgtgctccaccgcacggcggcctgacggtggctgcttctcctccgcgcacaaatccactcccgccccccaccatgcacggcggcagcgcttgacggtgagttctccacatgttttccttgctgacctcgattcggaatatggatccgtgtgagccagtatgattcagagtggattcccgggaacaagtctgatccggagtcggatttctcttttgaggacaacaaattccgtttcagttttccttgggtaacttcaggtatataccttgcgtctcttgcttcatcacatgttccaactctgcaagtattcaagcaggcgacgaatttcaccttgcaagaggggctcgatctgctccaattatccaatggcgccctgtagtactatagccaggattatgaacttaggggatctagcgagatgtcccaagaatttgtgcaacctactcttcagagtagtacaatccaagctcctagcgccccttcacagtagtttactgaaggaagtgcaaaaagatgatggtgatcagccatcaatggcagagagtgttgtggcaaatttaccagagctgtctcaggacatcttaatggagatatttgcctcctgagatccctgacctcgtgcgtgcaggatcggtctgtaactcctggctctcggcctacaacgaattgcgcagcctaggtatctataaactgtcccagacgccgtgcctgctatacacctctgaatctgctggcgatagcgtcgtgtgtctatatagtcttgcgaaaaagagggaggtcaagatttctctcccggagccacccatacgcagtaggtttctcattgggtcctcacttggttgtttaattacagctgatgacttatccgagatgcacctggccaatccgatcacagggaaacaaatagctctcccttctgttaccacaatggagcatgtgaatcccatcttcaatgagtctggtgctctccacaagtatgagttctcactgcacactgcaacgagggttagttatgcagagccatcaatttttgcccttggcgagctgcgggattacatatatagtaaggcttttgtgtttactgatactttcacagggggatgcattgtggttctgatccacgagccagctggtcaaatttcatttgcaagggttggggatgataagtggacatggcatccatcacactctcactattctgactgcatctacattgatggtctactgtatgcactgactgcacagggagaaatccatacacttgatctcagtggccccacgatcacgatgaagatgataattggaagtttgtcttacagtaggtacattgtgcaagctccatggggtggtcttctgctagtttggaggtcagttagcacattgaggaggattacgaggctgacttgcatgctgaccatgcaacatttgtgcggtatactagggaaattaaaatatatagtgttgatactatggggaaaaaacatgtagagatcaataacctggatggtcatgtgttgtttataggtaataaccaatcactttgtctcagcacggaacaatatccacatctcaagggaaaattatacctattttactgatgatgacgaagcttggttatttggattcaagaataagcgtcgtgatattggattatttgatttgaaacataacagcagagaggaactcgtgtctcctcagctttggtccaactttcccgctcctgtttggattacacctagtttcacaaagttgaacttcgcctagaagaagcacttttaagttttcttgtttatggatataatagttgtgtatatttcttcttgttctgtacaatttatatgtaaaattatgattggagaactgaaaggtgaatgagaaggttaggttgctccatatttgtttatttgtaccgacctttcttatgtttatttaaatttctaccgtcttaagggcaaacagcaggtcttgtgtgatagccactttctagggaattagtggaatatacaaggctaatgtgaccaatgttattagaaaatggcaaagctgtaagtgcttcttagagtctaaaataacttaactctgagactctgactgcaatcggcaggatgcctgggctaatttggagaagccttgtggaagcatgttttttagtatcttgaaggacaccatgtacttcatattttacaactacagggatagaagattgagaggtatggactgtgttctagctgccatctatttttattttgaattatgagagaccaagccttctgttccaacgtacttaattcattctagataacaatcgcagggtctgtctaggaaggattatgagaaggaattggagcttgcggacagtgagaaaacaaaaaagcttgaacagaagttgtttcgtggtctttaagattcactagtcctcaaggaggtaggttctcatagtctttccacgtcaagatccagtttgtgttcttttcaccatttgatcttgactaaattacgttttaactttacatgctgctaacgggcaaaaatctgtaatggggctagttttgattcctagcactaatacacttccgatttacttgcaatgatgttcaggtgcaaacactaactcatctcatgtacacatatgcaatcgatgtattagtttagtgctacgcatcatatctgcttgtgctagtgtgtgcccttgctaactgtagatggacccattccttaactgagaattagggcctgcataagatattatccattggctaaaccttatgctcaagcttcagttttcataggtaattttctaaacttctaaacaagttttatgcacattacactgtattggctaaaatcgaaccagcaacagcttataacttcagttattgtgcacccattgttccatgtttatcagtttaaataacacatcccagattattctcctgttctctgagcgaaagtccttttttgcagaaaggagttaaggatggaccatcttagcttgtttcatcaagcatgattttgctcttgtttcatcgtggcagagcgcatgtgctcttatcaaatatggcaactagaattatgttaaggtcttaaggaggtgaggagagtaatgtaagtccaggggacgttgaaggagaaaggatgcagttggatggagctgaatggcagtgttcaccattttgcagctggagctggaaaacattcaggaaatgatagcatccttctgaagcttgatgagataattgcaaaaataaaggtgtttgactatgctcctaaggttaccaatgcttcggctgatttgttttgtgtaaggaaaatatcagagaagctgtctggcgtctgctgttcattgggaagcttgcccctttcatttagactggtcagttgagaaagttttgcttcaactgcaaagactagaagggtgtttgagggctgagattcttccgtgaagtctatggaatttgtacaaaatacaggttaattgccttgccaattgaaacccaccatgctgaaaaatgatcaacacagtcgattcatgacgagtgctacttgcgtgcatttgatgcgatggtcgtccaaaagaaaaaagatcttgtgtgccagggcagaacagaacaagctgggcgggtgtgccctatcatctccaactccaaaattctgaacaagcagaacaagcagggcgtggcgggggtactcaaactcaaataaattctgatggtgtgtaatatacacattgtgtatattctatattctgttctgtgacttccattcagccatgttgctacaatcttggttgttgccaaatgatgcttagttggtgctttatttctcatacagatggaggcggttcctcaaacgtgaactgccacgtgacatggtcactaacaggtgggcccgtgagcagtggggcccacatgttagtcaccacgtccctctgacttcacgtcagaggatcccattcccatacagatattaaggctactactggaatgtgcaaacatatttatgctgagatactaatcagtaatcactttagtcacacgcgcatgtcattcaacacatttagagtacgcaatcaaatcaaattatgatattatgattaaggggttacagatatcggtgttaacataagaatagtaagcaaggaactaatccaatagttagcaaggaaccaatccaaaaacatgccgaactttcagttgatcactctacccaccaacccgcaggctggacgtgggagaagtggacgtgtagctctaactcacggggagagcttactatcaccccgcaattcctctgattacatgggatccgatctgctttagggtgcttcctatgccagtggagcaacatctgaaatgcaaatcagcaagcataattagttcttccgaaaacaaatgcagcaatgtaatgttaaaggaaaattaaagcaccgccattcctctctagcagacagattttttgtgacataattttgaaagtagcagtagtggcaa

SEQ ID NO: 60843 - DNA, 5086 bp, Oryza sativa
ggttgatccctcacgaaaatttcatcgaaacatagaggagataaactaaagaagggagaagtcaacagcaatgttgttgtcagacactgatgaatacaatcctggactcgaatgattgatacgtcgtgtaatctggggttgaaaaattttcaaaattgatgataacacaaacttttggcgaaatgggtttttgattttttttttcatgagcagcagtatatgtatcagtaagcaagacaaacattgggcctggcttgtgctaattattctaaatttgcgaaaagctgatattaagaaactgatcatatcagagtgaggataaatgcataaatcgtgtgctaaaatgatcagatgaaaagtgtggcaagaagttgatagattgctgtggttccaagcctaagtttgccggattttggttgctaattacacgataatgttgactggacttgactactattcggttcactgccaaaattttggcgagattccatccactttggaaacatatcgagttctcgatttcttccaaaatttcaaccacattttggcacaaatcaaccgtttgacattgctgcgtgctgtagctgtcttgggttcttggctatggcgtgaaaagaatgcatgcagtttagctggtaggtaagatcggtgtgatgaggccagtcgatctcaaactgatctatctgctgttttgtcagtcgtcacactaccaaactgtttcttttaatgaagtttttgcacatgaaaagctaagctcaaagctctacgaggtcaaacggaaaggaagacaaacaattatccacatataattgtcgccaaattgagcatattggctatttatcttcttttgatccaatgtataagatgatgtatcaccactggcgtcactagaatttagagcaaaatgtggtttatccagatataaggagccaaataaaaaagataattcatatacaaatatttatgatgttaatcagtaattatattgtgtcaagttctagggtggtccatgatttacggtgtcacctaactagctcctatttatattaccatgaaggagctgaccttcaccttgagagtgaaacagctaatatattgtcttgccaaaaactggatagtttatgccgtataaaattgcctatggttatttagtaacgtcaattaatttatatattctttggaacaaagctttttttttgaaaagaaaatgtgtgaattgaattcgtgttaaaattcttgcttccgaaagggcccttaaagaacaaagaaatttcggattactattcattttgagttactgaaatgaaacacatttcaatatttttgccgcagcgtgttacacatgctggcacagagtcgtttccaggtcaaaactgaaaataaacgctgttggagagcttagagattctagtgcagctgtgcaggcgatttcagaggagtactacatttgatttcagtggcctaatatgacttttggtttagaaaagtgcggtcttttccattggcctaatatatactccgtactacagagtcagaagtttggaaatgataacgagttagtaaaattccacggttcaaaagttgttggagtacaacatgacaacaattgcatcatttggatcttcaagtcaagtcagacctgttgcagatatagtgataaaaatccttaccgtatattactcttaggttgtgtttagttcctgaaaaaagttgaaagttttaaaaaaagttaaaagtttatgtgtgtaggaaagttttggatgtgatgtgatgtgatgaaaatttggaagttttgggtagttagggggtgaactaaacacggccactatttcggcgagataaattttatgatggtcttaattggtaatcatccaatggatcatatcaatttttactacacgaactattggtaatagaatcaaggagattagttattttattattagtagaatttataaatcaatacagtagcttattttgtttctattgataataatattggtaatactcccaatagatcgtttaattacctgccttttggtgttgcaaaagttaaacggttgatagaattcatggtcaattcttcaggagttcaggtgatgtattgtcaagttaacacacgcataattggagttttataatacttccttcgtattctaatgtatggcgccgttgcctttttttaatcaacgtttgaccatttattttattcaaaatttttgtgcaaatataaaaatatttatatcatacttaaagaatattggatgataaatcaagtcacaataaaataaataataattatatatttttttaataagacgaatggtggttaaaaagtcaacaacgcctagttggagaattgtcaagggaagaaaaaaacagaattcgtttgatgggctgctgctacatcgggctgggctgggctgccatggctcccaagctctcagcgcaaatcgatctacgagtagctttgggcccacttcacagggcccaaactggaggatgcatcgtctctccggacacgattcaccacgctaaaacccattctcgttcccgtgcatcactatcttggtgtgtctcacggttggaattgctggacactcgtcgactccgtttttgccccctttttgccgggcttttatttcctgttgcgtttgggtctttggtatcgaggaatcactcagcgtgctccagagttgagttgagacccaaagtgtgagacgagtatcatcattgcgtcttttgcaccgtaatggctaatgatcagatcataacactccttccccaccgttttcctttttttaatttaatttgtaatctcgcaagactgatatgactacctccgtcccaaaataagtttagtcttatattgtttatgtctaacgtttgaccgttcgttttatttaaaattcttttatgattaatatttttattgttattaaataataaaatataaatagtactttatgtgtgactaatttttttataaatttttctaataagatggatggtcaacgttgaacacggatacccatggatgcacttaattttaggatgaagagtaatatttggatgcctttgcctccttgtacagtagggttgaaagtgattaggatagtttctgtccgaccggaccttttttcagattcggatagtttcagtcgaatatatctaaaaaatttcaactacggaaatgaattcagatttttttttgttagaaataaaaacgaatatgaaagtaaacacaacattttctatctcccccttgcccttacaaatagagataaaatttgaaaatgttgatgttttgtttttaaaactaatggctacatctcttcctcgatttaagaagcttactttgaggggtcttgatatttcgataattattttataccgtattcgtttcgattcgagttcgctccatatctatattcgataatattcgattccgttttcgtatccgggtttccgattccgaattcgattccgagaaaaaaaaatataaaaacaaatatgatagagctagtttccgatcgtattttatccgttttcatctctaatgtacatttgcgtggcataccaggtgggtggatgcaaaataacgtgccctgttttgacaatgttttcccaaaacaaaaactttttttacccatcacatcgaatatttggatacatgcatatagtattaaatatggaaaaaaaaccaattacacaatttacgtgtaaattgcgagacaaatattttaagcctaattgcgccatgatttgacaatatggtgctacagtaaatattttctaatgatggattaattaggcttaataaattcgtctcgcagttttcaggcggaatctgtaatttgttttgttattagacaacgtttaatacttcaaatatgtgtctgtatatccgatgtgacatcaaaaacaaaaatttttgccatctaaaccgggccatagtgttcgctttgccccacgggcaattttcggctacaccatgcatgtaggtcattttcaaccataccattttttttttggcaaagttactaagaatgtgcctacgtttagtttgttgccaaattttgataaatacataagaaatcatgccaaaattttaacaatattatcaacttgctaaatttttggcattgctataatttggtaagatcctctgtaaaatatagtgaaacaatccttgtactgacaattgtgtcgtggtgtgttttccgaacaaaccctcgttcctttaataaagggactgtctatatatctgttgatagaaaatctcacatcccgtctgtcgacgggggatacccgtagaccgaatatagagggtattggggcacgctggtacgaggatctacgtagtacgacatcaagcaaacaggaaacagagattatactggttcaggccccttggtaggtaatagccctaatccagttgatatgggattatataatggaaaccacagattacaaagggattagtggaccttgacgataacgacaagatcgtagtcgagttgatccgactagatctcccggcgacttggctccgataagctccggcttcgtaggctgtggtggatatgttggctctgagattcgatgccttatgtcctcccgtgaggtcccttttatatcgcaggtcacctgtctcccagtaggactcggagggaccggaccgaacacgacacaatgacgacccatttctgaccgagtaggactccttccatctgtgaactctgtgataaatttccttaacgtatgccgaaagcgtccgtatacgcgtgaacataccatatcgatatgtgacgtatatcgaaggatagagggtataccttacccgtaaccctgacaccgtctttcaaattttggaccattgaatgtgcttttaagattcatgcaaaggcattaaccctagctctcctcctcccgttcccctcccgtcgcgcgtccgcacccctcctcccatcgctattcctccgcccgatcccccgccgccaccgtcccaccgcaccgccgcccgccttgccggttggccggaggatgtcaacggcaccggcgagaccaccctagccagcctcct

SEQ ID NO: 60844 - DNA, 587 bp, Oryza sativa
ccccagcgcttgcggcactgcatgggcccgcgctcgacgccgtgcggcgggcagtaggtcgacaccgccgcccacttgagcctcaccggctgcggcgaccgccgcccgcggtgctccatggcgcgcctcgcctggagcagcaccagcgtctcgtgccgcgtccaccgcggcagccgcgaccgcggcgtgccggcgcccgccgccggcgaggtcgcgttggcggcgcccgacattgctgctgctgctgctgcctcccggaactcgatcgatcgagagggatccaccaagctgggatttatctgcggccatcgccgccattaaatcgggaatcaaagcttgcaattttggcatccagcagaaacaggcaagaaattaatctcatcatactcatctctttttatctcatccaactaagaggccatagaaaatcagtgtcatttacggcgaatcataactacggcaaagaaaattagcaagaagttaatctagtacagctaatgtcgtctcataacaagcatgttcattaggccaaataatcatgtcataccactaaccatgtcaatcaataggacataaatagcattgca

SEQ ID NO: 60845 - DNA, 667 bp, Oryza sativa
ataaacataatgacagctgagcacaccgaagaaaaggttgatggctgactgcccaaggaagatgtgctttctctctttcacacattcaaatgttgggttccaaagaaaaaaaaattgcgttttcactaatattattttcacatatggaagtcctaatttttaataattaattaatggtttaagagttcgatgtttggcaccacatgttttaggagatctagatgttattctttgaagaccacataagtactcgctccgtcctaaaataagtacagttttacactgttcatgtctaatgtttgaccgtttatcttatttgaaatttttatgattaatatttttattgttattagatgataaaacatgaatagtactttacgtgtgactatttttttttcaattttttcataatttttttaaataatacggacggttaaacgttgtatacagatacctacaactgtaattattttgggacggaggtagtaatcacttttacgtactcaatgaactcaatgattgtccggaagatagttttcatgattaggctccaatctatcacatctggataacttgcgatcgtaggtgcagttcatatgagaaagttatgacattcgtagttcaaccttttctcagaagcccggaataagttatacaatacttgtct

SEQ ID NO: 60846 - DNA, 559 bp, Oryza sativa
agtcgaccggagatgctgccatgctaacaactcttgatcgatggatgatgcatgctttgggagataaacaacgcactgatcaatccgcctaagcacccctcaacaacccccccaaataccacacgctgatcctgtcctgcactgatcttcttggtcttctcttctctcaagggcacctaactgacctaaccatcactctttctgcgcggctctgcctctgctcctcattgattggactagcagctggaaaggccaaacgttacaacatgcccctcacgtgtgagcggaaagctaattgagagaggccaaccggttggctaatcacatcatttatgtactactccaaggccctgtacttcatgaggatggttgctccctcacaatgttcaccaaaccgttaatcaatgctttcataaaatattccgtacaaactgttgagacattcagtaaaacccctatataacctataaaataaacccatatgatcctgcattactattggtaccttctaaactttaaccgagttggaaaaagattgagtagggactgacgatgacgc

SEQ ID NO: 60847 - DNA, 565 bp, Oryza sativa
ctatccaaaaagaaaagaaaaggaagaaaagtgcggctcacaagtaggacctacataattttttattttttattttgcttactagaatgtcatgtcagcgaaaccagatatccatactgttgtagcatccagattgcacggttttagtacagtttaggggttaagatttctggtattggggataagggatgtcaaaccaactcggtgtaaagttgagggacaacaggtgaacttattcttgcgcattttcggctatcacatgtgggccgtgtgtagctttgggctccgtatttagacgggagtttcactcgacgatgctccctggggcgcgagaatgctaaagcgtaaccgatcagtgaaatttccactttaatcccacaagctttttcgttttcggcacggaatttttattgttggattttgtgcaatggaaataagttcactttcagctcctcatttttgccactgagtctgaaatttgtccctcactgcatgtaacgcttcgcttttcgtgaggcgttaaaaactaattcggcaaaattctaatttcaaaaattttgttctt

SEQ ID NO: 60848 - DNA, 1209 bp, Oryza sativa
atgccttatattatggaacatctaaaaaaaaagtggttgtgccttatattatggaatggagggagtaatgattagcaagatacaattgaagacatgggagaatgaagacgtgtggtgtctaggaaactgaacttttgaaagaacgacacgagttaaagccaaaaatatttaactttttatggtaccatgtcaacgattagacctattttctttattttcgtctattcggattttagttaccgcttgaagcactgaacatcttcaattcaccacatatagatcttgcacaccttccttttgatctaacttgatataactcacctacaatcacgcacaatcactatgtaaataaatttctatgggtaatgcacttgtgcagcactccagctttacggcattctaattaacttgatagctggcaaaacctgacagaaatttactcatcacttcaacataatgatgtttgatatctagtaagctgaattgtaaaaacttaagtgaacagaaaaaaaaaactgctgatagccattgctaaataagtctcaacataacgtattgaagttaagtttatcctgaaaggtttcctttaaaaaaaaaaaacttggacaccaaaccttgattttcattattttaagaagcaacagtattccatcccacgactgcccctgccaactgcgctagcactgttctcatcctgaaagcttcattgtaacgtaacatctgatgatcccaggcaagcaagttgcagaattagcaacttggaattgatactagtcaaatcagtactgtaaagataagtgcatcttacaaagtttcaccagatgcacatgcccagatatgaagtgtctgaactaatgccctcgtcactttttgtgcaactataatctattgcatcacaccatgtaatgagagaaatgaagatgaaaaacttacctgaagagttcttatgggaaccatgtccacagcatggctagggtaagcagcagctatgacaagagaaatttcataatcacaattaattgagatccactgtaaaaccaacagtaagtatgcgtagattcaaattggataacatgctgaaatagtattgcagtaagacaatcattggattctattacaggcttagagctacaatatctcaagtcagaagagcgagaaatcgtaaggatgcacagaaagaacaaaaaaacagatacctgtatcgaacaa

SEQ ID NO: 60849 - DNA, 1812 bp, Oryza sativa
gtggtggttatggaagtggtggcggtggcggtggcggtggaggccaaggtggaggctccggctctggctctggctctggatatggctctggctctggcggaggcaacggacaccactaagctcattcctctatcagctagctacaatatagcctgttgttataagtgaaccgtgatcagtgatgagtctctctcgctgctttacaaagagcttgtcggattgtatcgatatagcactgtgtactggcttgccgtttcatcacataaagttggcaaagcctagtaaataaaacgaccttttgtactcagatcatacttctgttattcacggagctgatgttcactaagattgatatgcaagaacatagatttaacccttgtcctagctagttgtttacatagtaagcatgcagaatggacttgttaactctcggtgatcttgagttgtaaactggacttgttctcagtagggctgctagctagcatttctagattccaacatgttcgcttacacggtgttaaaaaaatattgctgcagattgtaatgaaactacccagataaagtttcaattggtcagcaccattttgaaaaacttggtgattagctatgcatactctggttttggggaaagaccgcttgagtaataactttgatcagtgatatttgtagtacaaagtacaaacgagtttggtagaaacaaactcaaaactaactactcctctagctagtagaagtatatcgatctctaactctacgtacgttcagttagtcgtttaaatatctgtaacacgtacgttcaacacaagatccagagcatgaagggtatcgatcggctgatttctcggaacttcgtttctgcatgtttatttggtacatcgggtgtgtcatgaaatttgcatattttctcctctggctatgatctctattagtgtggcatcaccattgtgaactgatctcctccagattccaatttaggtgtgtaataataatctgctctgctacacgcctacacagtgtgatcgaggttaactaatggtaaaaatgagtgtataaacatctagatctagttcatccctacgttatagattaaagtaattaatttctaaccgtgtggtttgcagtcgcaagagaacggtcaaatgcatatagcgtcatagcgagtcacaccttatttcaggtccagttctttcagtcgcaagatatgcgggtaatgcaggtcaccagtgctgcgttccactgtcattcttggcagcttccttcgttttctcttatgcgttttctcctgtacaactgtaattttttttttcattgttacttgtaccgccggtcactcaaaagacaaaactgatatttgtaacaatcagacaacacagcagtcagtccatggctatcagctagtagatgcacgtgttctttgtctaagacttatcttctctttctttacaaattatcgttgctcgaccactctcccaatccaattctgaatttgtttcctgggaggcatgtaacgcaatttgtcagacgatgtaacatgcagtttgtctggcggcttgacgactgctattactgatctctttgtttctaaatatttgacatcgttgactttttttaaacatgtttgatcgttcgtcttattaaaaaaataagtaattgttaattatttttctatcatttgatttattgttaaatatacttttatgtatacatatagttttacatatttcacaaatttttttaaaaaagacgaatggttaaagatgtgttaaaaagtcaacggtgttaaatatttagaaacgaaggaagtacttagta

SEQ ID NO: 60850 - DNA, 3148 bp, Oryza sativa
tctaatgaaatcgaaatctcatgtcccctctccttcgctgcctcgctgatcttcattgttccttttaaagtggtttgtctacctgacctaagctaagcaagctattagagcaagttcaataatatagtccgctacttactccaaaatttaaaacatcatatatagtcaatctaatagctcacttatataatatatagctatagaaatatactgcattattaaatacataattcatctatcttttttacatagtttattagagctcatgctgtaactggctacaaatttataagcacatttttgttctctctcctctcatctctcctctacataagtacaaatctgatgtggtagcttgtatagcccgcttatgtcaccttattgtacttgctcttagtagtacacaccatttggagcagcacatcttaaatactcctaaaccaacatacaggggcggatccaaagtgggtgcagggggactcaagtcctccctacacccacaagacccatagatattccccggagcacctccttcaattttttcaccatgttcctatatggctggaggttgaagaaactgtgtaattgcctacacccacaagacccatagatattccccggagcacctccttcaattttttcaccatgttcctatatggctggaggttgaagaaactgtgtaattgagttcccctaaattttttttttcctagatctgcccctaccaacatagtacgtggatcggttataagctaaaagttgtttaactctatctaccaacatatagagattaagggcttgtttagttggtgaaaaattttggattcgttgtcacatcggatatacgggcatatatttgaagtattacacgtagtctaataacaaaacaaattacaaattctgctagaaaataaattaagactaatttaatacttcatgcatgtgtccaaatattcgatgtgataggtaaaaagtttttgttttaggaactaaacaaggcctaagagcaaggtacaatagcatactattagtcagctataaatatattttaatgagataaaagatgagagagaagcagcgggctacagatttatagccagctgcagcacaaactccaagacgcgatgtgtgtatgacatgtgagaccacatattaattgtaaagtaagtaactattgtatgaattggttattagattggctataaataaattggagctagtagtgggttgtactctaaggccccctttgattcaaaggaaatttataggaattttaaaggatttcattcctatatgaatttttcctatatcgccctttgaataaaaggaatggatcctatgaaatcctataaaatttctatggaatgcctcttcccatataagttttagaggaaatttaacataaggtagaacctcttgataactcttttttgagtctatctctctcatccaattcctgtattttttctgcggttaaatcaaacggtcatttctgtgtttttcctgcgttttgcaatcatctgttttacacttacatttctatcaaaattctacgttttttttattcctatattttctcaatcctacgatttaaaaggcctaacagttcgaccagcagctgggaaaatggagtactactaggactcgtctcgtgaagtgaaactgcagcgcccaaatgactatagtccccaccgtacgaacgtaggccctcctccatgactccatccatgtgcccgttgcccatccatcaacccaacccaacccaacccaaggatttatcagttttcctactactactactcctgtcctggagtataataggtactagtactcttcactcaccctagtgtagtagtatatcactgcaatttcaatctcggtcatttttactcgctgccatgcgttgcacgcccacagcatcaacacgctgatggcctgatgctgatatgcatgcacatgctgtcttgtcagcgaccaaaaaactttgggcttgagcacgcacatcgcaaaactctactactattccagatagattcgtcagcaatcaagtaaactaaactaaattaacccaacccctggttgctttgcttcgcttggttcaaggttaatttgagtcagctctcagtcagtcggtcggtagcagccagtatggccttgcgcaaatcgagcaacctgttgccattaacctactacaccaattgtcaatcaaaccacttgcgtgattcgtgccaagatttcatcaccattttaaatagcaaaggcgtttttctatcgcatgctacagttatagataatccaacaaatatactgtccgtagatctgcgctacacatgcacacgtgttcacgtacatgtaaaatacttcaatactcccctctggctgggttggcgtgggctgtgttggattactcagacgatcacaaatgtatataatcagcatgtaaattcaaacaaaatacaactccaacctcaaaaaacaatctacatatgctctctcagctcttcactaaagactaaagactaagtactccctccgtgaactcatgaatgacatactctttccgtcctagaatatattatattattacgaatctagaaactcgtactccttccatcccataatgttacaacctagtcccatcctaggacatgtccagattcgtagtcctaggatgggtctcatcccatcctaggttgcaacattatgggacagagggagtatgtcacaacctaaaaatcccaaatatataaattgttgtctaaattggaattattagaatttatttcaaaagcctagaagagaagatctaattttaaataataaattccaatataaaatggggccagataaaattccattaaatactttgcttgattctatagttcctagagttttctgggatttatttgagccaaggaagtatttttaataaatggaattgcatttcatgaataatttaaattggaaaaggttttaaaagttctcttttggctttgggccgaaagtcggcccaaaacctctctctctctccctcggcccagtcggcccaagtcagcccgcagccgcccgcgcgagcgccctcggccgctgacaggtgggtcccacctgtcggactcgtcgtccacctccagccgccgcgctgaaaccc

SEQ ID NO: 60851 - DNA, 3179 bp, Oryza sativa
gagtccagccatatgctgccgccgctccggtcatcgtcgtcactcgggaaggccgccgtcgggatcgccaagtcgtcgccgtcctcgtcccgtcctctgtttccaccgaagaccgccggggcattgccgtcatcgtcgacccgaacgcctccaccgtttcgacctcgccgccgttgccatccgttgccgtccgtcgtcgtccgagccctcggtgagttcgccgcgtcgccgtctatgtgtagatgccctccgtttgcggcgctgcaccgtcgttcgccggcgagcgcgaggtgctgagccgccgccggtgatgacgtcatcgtcgacgtcagcgccgcgtcatccgtagaccgcggtggatcgaatcgatctcagccgtttattccgtagaccgttcccgtgcaccaagtccaccgtgaacccgagcccgctgacacaataaatcctttttccttttcaaaaatgattctttattgctcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttttttgtgtgctgttttggtgattttgctcctttctgtttagattccgacgtttccggagagtccgtttttacaggagaagaatttgaagagttccaaggccagcaaggcaagtcacacagatcccaaacaaccctttgagcatgttgatcccgtttaaagctattgtttctattcaactattgcatttattttcgaatgtcattgggtgtaattaacctattgtttgttatagccctttttgttcttgattactttattccttgataccttgggttattataacttgactagttgggctttatatattggttcagctagatattagataggattgcttagccatacttagaaacattagcacactattgggataacttatgactcactattatttattatttaatgatggcttaatgatagctcatgatggttaatcatgattggttaattaattaatttgccaactaaaacctgataatggtgggttgtgagcacatgattttgatggtcgtgctcatgacaattaaggaccagttcacgagtttcggttgtgaaacattaccgtgccaaccacaagccagcgtgggcaacggctttaccttttgtatagtatggttcattgcggggcaccagactgagaagtggcggagataagcccacgggggtcgctggggagtccatgccttgtttataagggggtgattatgatccaggaacggtgcactgtggtgagctgtgttgtgcgaggggtattgtcacagttcctttccaaggtaccgtggtggtattgaggcgcatggtgacatgttgtggagctgtgtcttgtgggtacagtggtacacctctggccagagtaaaactattcgaatagccgtgcccgcggttatgggtgggtctaacaatgtctttcgtgattagtttcacatttctcaccataataaaagatgctataactggtaataatttgattagctcctggtttggaatggttaattcctggtttggagatagaactgtgcagccgggatggttgttcagaatggttgggcctatgcaacagggtatgttgtatagcgttggattaatattgtttaattactacttaactattttattaaattctgaaatgtttattaaatgttgtttatgcaaatgaaaccctactatgccatcctttgttatcctgtgcacttgtatatttgctgcgtggcttgctgagtatgtcatatactcaccttgcaatcattcatcagaggaggagttctacagtgatgctgatggtgtggaggattaggtgtagccctggtcaagctgcctgtggagtgggtcgtctgcgccgtttatcttttttttttccgctgcttagatatttattgattgagaggaactatctacctctgtaatgacattttattcgcttattaattagagtaataattgtactctattatcaatttgttattgtgtgcctcggctgattcctggacgagggttcacacatatgtaagcgtttggaattttggatagaaattccaggcttgacagagtattatattaagttacatctcgtaatagactaatttattttgggctgaaactaggaataactagtgattttcttttttgccgctacaactaattaagtactccatgctggtagtactatactattgtcgggtgcaaaataaactatcaaattaatgttggcccttcttcggacgcacaagaatcacatatagaaagaaatgcgcgatcatgtcgctactaggacagtctcatttggaccagaccagctaattaacctctcctttactcctgctcttctggatttcgttgcgctttaatttcgtaccaatagagagatcaaagagactagcatttgttttgatcatggccatgacatattccttgcgtttaaacaattctccttccattacataatatactccatccattccaaattgatccacatatttcatagatacactaagaacaagaaaagctaataactctcttatactatatttactctagcaacaaactcaatgcatgcaccatccccactattttctagccaatagcaaatcaagatattgcatgtgggttataaatacatgtgtgcatggatgcatgcatcaatgtccatttactccaatgcacaaataacgaatagacctaataaataaacacaaatatgtagatcatttagaaataaacttaaaaaaactatatgcagatcaatttggaatggagggagtaaggcataaccacttttcttatatgttacataatagtactactagtataaggcatgcatgcaagcatccaatttactatgacatcttctctattaaattactacttttttaaatcctctactctcatattatctaattctattggatgcatgcattatatttattaggatgatccaaactacaagataataataattatttcttggtctttgggttaatggaggttgtgctttatattttgaaatggagggagtacactgcactgataaatcttaattaatc

SEQ ID NO: 60852 - DNA, 674 bp, Oryza sativa
taccataccagttagtataaaatttagaccaaacaaaagcatgccagtgattgcgttatcatgtataggatgatcccagcatgcttggtcatttttatgtttctcaaaatcaagtgaaggttctaagttgaattgctcatcgccaccctcactttgaatggaatactttgcgcatgaaaaaaaagaaaaaacaggctgcaattccacccaataagttggaacaaatatataattccgtacataattgcaatgcagaagaagatgtgtgcaaggaagaagaaagaaaaatctatacctgcaactcccattgcaaaaggagatgagctgccgccgggaatcatccgcgacgacggccccgggaacccgccgctgccgctgctgctgccaacctcgaaaagtggcatgtaggcgagaactccccgaagtcggtcaccggcggcgacggcgacggcgcgggtaggcggaagaacggcgagagcataggtggtccagttccgccgccgccgccgccgccgctgcggacgggggaggcggcgtcccacgcggcgagcggcgcgccacgcagcgggcgcgggctccagcggaagggaccgaatccgggggcgcccatcgggggaggcggcggcggcggcgtgcgggactcgtcggtggagacggcgtcgtggtggtgctgc

SEQ ID NO: 60853 - DNA, 7940 bp, Oryza sativa
cctgcagccctttaacaacgccgacgagctcctgctcctgtgcggccacgcactccgccgtgcgacgcttaaggcggccctcgccgtcgccctctccgcctccaacggcggcgccgcgccgccctagcgccgctcctctcttcgtcgccctctccgcctccaactgcggcgccgcgcccctcttcgttgccggagacaactcgatctagggttcgcactgagagaggaccagaacacgcgcctttttttcccctcgctgctgactgtaaaaccgaaccccccacggacgctgactcagcgacgcgctgaccgtggtcaaagcgccacgtcggactaaaccgctagccatactgccttaggacgaaatttgcaccggttttgtaagttaagggacccgttgtatctggttttgcggatggaggacgaaaatcggattcgttgacaagttaagggacctaaagtgaacttattccctatttatatagatgcagcccacaacctcgtaaccattctgtccccccgtttccaccaaaccggcccaaggcatcaccgctgcctcgcccagcgcccgcggcatatggaagcccacggttccacggcccgcggccgcgacgactgtttctcggcggcggagttaggccgatcgatcgggacaaccggtgggcagcaggtcgtcgcacgccccccatcaaatctgcgtgggtttctgtcccccgaaaccaaaaaacgacgccccatgcaacgacgacgacgacgagacgttcgagcgacggtggtgccggtgtggtggtcgctagctagcgcgcgcgtagcttatcccgccggttggtacatactctcttcatcgatgccgttgacatttttaaaaatatatgaccgttcgtcttattaaaaaatttaagttattattaattcttttcttatcatttgatttatttttaaatatacttttatgtatacatatagttttacatatctcacaaaagtttttgaataagacgaacgataaaatatgtttaaaaaagtcaacgacatcaaacattagagagtactagatactactcctcctatacttggttggttgacgtgccaccaccgcacccaaccaacaccgccccgccctgacccaacctaacgcccgcactagctccagagaccgcgcgcgatcgatcgatcgtcctagctactccctccgtctcgaaaaaaaaaagtcaatccctgggtttgcgtgttcaactttaactgtccgtcttatatgaaatttttttataatttatatttttattattgttagatgataaaacatgattaatattttatgcgtgacttgtctttttaatttttttcataatttttttaaataagacggacggtcaaacgttgggcacgaaaaccaaggtttgtcttttttttttgggacggagggagtaagctactagtcggcaccacacacacatagcacgtactacacgcacgcgcgcgcgtctcaaggtacgcagctacagcttagctagcgcgagctggagcgcacaatttggttatcgccatctcttcgatcgcggcaggtcgcggggcgtcacgtaccgcgtgcgactggttcaattctattaattctcgcatgcatgcagtagtagtagtacgtactggggatatgatagtgcaggtgcggtgatgtgcatgtgtcgtcgatcggttaggcctcagctttcgtgggccttaatatatatagtacatcaatggtcgtcctcccttaattcagtgtttagtttctatcattattatcccttagtttctaagggcagtcccaaccctccatctagaatggtgtctatggcattaactatattgccatgtaggacttttagcttatgtggcactatattaattaagagagagtgaagagaggaataaactgagtctcatgcaagacacagtttcaacacgagaacctatgtactagacactatcaagttttgcattgggagataatagtgtctttataatagatgaagactaaatatgattggtagagaagagagatgatgtatttattaatggcccactttaaaaaaccatgggttgtagagtatagtttctattatgatgtcttattgacatggcaccatagacactgtttatggatattatgggttgggactgccccaaacactgagttgatcgatcgattatcgaccagcagcatcgatcgatcgatcgatctccggtgtgttttgtcaactgtcaaataaagcggggatagagttgattgggggtgtctgcggttcagctggccatattaattggttggttattagtacccttctgtcacccgcacaaatcatatcgttgaatcagtgtacgtacgtacgttcatgcatactatgccttgtaacttggagtagattgcctaccagccctttttgttgactcggtacgaccgtagactgttgtactgcatgttgttttcaggacataaaaatgatggcctgactcgatcagtccagcccagcctcagacaagttcggttggcccagcacgaatctcagtacatatgatctgacgtactgtgcacacagtgctcctgtgggtgccatcgtatcacttattcgcgaaataaacgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatcttttacatattacatagatataagttatcccctataactagtcggataaccatgccgtgtgggtatggggtacccataatctccacagtagcccctgagaccttcacagtcggaaagataaccttctctcgaactagatactccaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttaataattatagtcaaccaagtgacttgataccaatatatagcatatgcggtgtgaatccccgaataatatgatccaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttaaaaacccaaacagcaccatggctatattaaaaaagccagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaatatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggttagccagcaatgaatatgaaggcgctcagcgataaagttgtgtagctatggcagcgaaataatcagtcggtggtgacaaaagcaaaccgacgatgaagacgtagatgcgcatcaacgatgatggcgaaatcaaccaatcatgaagatgaagaaaataatcggcggcgacaaacgcatccaacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcaatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacaaaagacgatgatgtccatcagtagtggtagctgtataaaccagacgtagaggtgagggcactagtcagcagcagacgagacgaccggcggtgaagaagataaggccaatcaacgctggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagctgtgcaggcagtgacaccagtcagcggcggatgcggcggccggtcggtgaagacgtagacgcccaacaacggcagcataaaggccagccgtgcaggcggaaacaccagtcggcagcggtcgaggcggccggtcggtgaagacgtagacgcccaacaacggcggcataataagtcggccgtgcaggcggaagcaccagtcggcggcagacgaggcggccggtcggtgaagatgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcagcataaaggccagccgtgcaggcggaagcaccagtcggcggcagacgaggcggccggtcggtgaagacgtagacgcccaacaacagcggcatgaaggccagccgtgcaggcggaaacaccagtcggcagcggcgaaggcaagccggtcggtgaagacgtagacgcccaacaacggcggcataaaggccagccgtgcaggcggaaacaccagtcggcggcggtcgaggcgagccgggggtgatgttctgactgatccattcctggagcgtaagagataagcttaaagccatgaatcccttttatgcatatctggatctggatcctgcagaacaaacatataggatgagtagtatctgatataaatataatactcgagaaaaattcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaagaaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaggcccattaacagcggcggagtccgccaaccgtataggcaaaaacaccagtcagtggtggcgaaggctagccggtcggcgaagacgtggacgcccatgaacggtggtgtgaccaaccaaccgtataggcgaggacaccaatcggcggcgacggaggcaggccggcggtgaagtcgtggacgcccaacagcggcggcataataggccagccgtgtaggcggaggcaccactcggcggcaacggaggcaggccggcggtgaagtcgtggacgcccaacagcggcggcataataggccagccgtgtaggcggaggcaccactcggcggcaacggaggcaggccggcggtgaagtcgtggacgcccaacagcggcggcataatagaccagccgtgtaggcggaggcaccactcggcggcaacggaggcaggccggcggtgaagtcgtggacgcccaacagcggcggcataataggccagccgtgtaggcggtggcaccactcggcggcaacggaggcgggccggcggtgaagtcgtagacgcccaacagcggcggcataataggccagccgtgtaggcggaggcaccactcggcggcgacggaggcaggcggcggtgaagtcgtagacgcccaacag

SEQ ID NO: 60854 - DNA, 2138 bp, Oryza sativa
atataatttggacaaattcaatttagaaaaaaaatgtttttttgaaaaacaacgtatgagtagtatataatatctagtgctagttgcttaaaaaaagtttgtaaaaaaatgaagctaacatcatattttgcaaccaaaccgaaatcgaaactaaaaatagaaaaataggctagggcaacagtgagcactatccataaaacccatttaggcttgcttgaggggaaaatggatttggcaaaatttgttaaacgacatccaaaaaacatgtaattagcatatggacaccgcaagaacgtgaatttgctgtcagataccaccaaaaactggtaattagctggcagataatcgtggtcttattttattatttccggaggaattatacataaagcatttcatagtttgatagaactggatgtaatgtagatttgatctgtcctaattctgcttctcttcgacctgctgatattctttgctactaattttctcgtatcgtctaccaatttgttttctctcccttgtcacccattgtcacacacgtagaggaactgaggaatgttggaaacaaaatgtcatgattcagctagctatttctcaatcttttacgcgaaatcctgatgggtatagagccttgctttgtctattttccaccactcacggctctgtttgataagcctgaaagggtatacgaaaataaacatgttacaagatcagatgtacacaaatgaagtagagtaagtaatccgctaatttgactgactaaagaactcggtatggtgcacatagagtttcttacaatgaggttccagatttctgtgcttcttttccctgatgcttcccatcctcacgatcactccaaaattcggacggattctccaaaattcataaacgttctcgcgttcttgacttctttccaccctactgttttggatgtttgtataatgaagatggtgatgagaaactgggagagagatgaggtagatgctgcaacgactgattcccaatgattcccatccttacgcataggggcggagctagagcgaaacagagggtggtgccacttacttaatttactctactatagatcaaatttaagctgatacgggtgcctaaatttgtattgaggggtgtatacatggtgaaaatagatgaggtatagctaaaaaaaaatttttttgaccgggttcctaggcatccccctaacatatactagccccgccccttacacacacatatttagaaacgaacatagcctatggcaccagatagactctacagcgctagttgaaatattcagacggattctccgaagtcacaaatgttctctcctttgctttgtgctatgttcttaatttcttctgttttgatttggaagtttatataaggaagatggtgaggcactgcaactctgtaagggagatgatgtaggtgttgcattgatcaggttgttaattagtacgtagcagctaccgttgcagattataggacaagaagaaatcaggcaaacgaattagatatggaaataataaggctcttccttgctagataatagttgggagaatagctactgtagtccataaagtttctatgtaaaattagtttagtccctaacctttttaatagtctaaacaaattcttaaactttgtcataaggcttagaataattcttgggtccaccaaaatcgtcatatggatatgccatgtaatcattcatgcaaaatctatgatgaaaatgtaagagtgaattagacataaccataggaaaaaatacttttcctttttttcaccctttgatgtatatttttgctcttacatataccatacttttttttaacttttttcattttgccttttatttttctatgatatatgtaagggtaaattggacaaattatatagattttacataggagggtgacatgacttgtccatggagcgattttggtgggaccaaggacaatattagcccatgtgacaaatttaaagaatttgtttggataatatgaaagattaagaactaaaatgatccaggagtgaaactttagggaccattttggctattctcccataatagttggtgcatgcaattaataagttattgatttttgggtaatatggctaattgatgcagttcaatgtag

SEQ ID NO: 60855 - DNA, 659 bp, Oryza sativa
cctactccggcgtgttcagcaagctccgtggtaggggggtcctcccgacagagaaagggtgttctgtggatggatctcgatccgggcttggtatcacttgtttttctttcctaaatcactgcgggcatcgtacatagtactgtgacacaaataaaactcttcccgaaccttcaccatgccatatgagcttagttggaggctaggaaccacagttttaagatcacgcgtagggcatgggctaacagtacttaagccctgctccaacaaaattaaaggtcaacacggcacgttgggtgggtgatgatggtccgctccatgtacggcaccctttggatcctctcggctgcacgcatgcggccacccgcagtgcttgtgcatgattctcccagttcatgaattcccactcccacaacgatgcccgtgcaccgcgcggacagacaagccggccggccacatgcgcgcaggatcggcaggtggctgctccacgcctcagcgagctactgctacgagctagagttgcagactgccattcttctgttccccgcccatgcgtgcatcatcacctaaccgccaagtcgccggccatcatgcatcccctcgctctcgtgaccgcgtcgacgctggcctctcctgcgtggccgcgtgtgcactagtctaat

SEQ ID NO: 60856 - DNA, 726 bp, Oryza sativa
aaattaaaaatatttaatcacacagaaagaaattagaaaaaacaaaagtcataaatagacaaaatggtacgatcgagatcgaaaatggtatcccttttacataaacgacttttgatcgatcgggaattttcgtgatagttttcaccctatcggtgagtgtccggttaaaaaaaaaatcgaagaacttattcaacaaaagtctagcccccacctccatctgcatcgtgggccagatgttaggcccaccaggtttgccccacccttaaaccccaccaaggcccaaaacaacccttccgtcacgcgccgccgccgccgccgccgcctctctcctccgtcgagcgccgccgacggccgacccactctgtccgaaggcctcaccgtccgcaggtccggctgcggctggaagtgggggtggctctccggtgacatcaaacagttgcggcgcctcactccatttcgagggttctgcttttgcagagtccgagattttcgttccagatccacgtgagttttcttcggtcatggaggcgtcggattagtccactccgggcacgggattgacgcctcctcttcacaaaagtcggaagctcccttcaaattgggcatctcgtactcaggtggtaatggtattctagttcacttctgaattatgattcgttcaagaaactttgtatgacgtcccttgtatttttagtgcaaatcctttctgaaattctttgaaaatcg

SEQ ID NO: 60857 - DNA, 6969 bp, Oryza sativa
caccactcggcggcaacggaggcaggccggcggtgaagtcgtggacgcccaacagcggcggcataataggccagccgtgtaggcggtggcaccactcggcggcaacggaggcgggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcgaggacaccagtcggcggcgacggaggcccaacagcggcggcataataggccagccgtgtaggcggaggcaccaatcggcggcgacggaggcaggccggcggtgaagtggtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccaatcggcggcgatggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaacggggtagcgcacgagacctaaaagtggatggatgtggagacaaaggatttagacagtttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcttaaatcaggactttaggccgttccgtaatatacaaggaaacgtaacacccaagtcatgatcttttacatattacatagatataagttatcccctataactagtcggataaccatgccgtgtgggtatggggtacccataatctccacaaaacgaaacgacatatttgcaaacgaaaattaatttgtaataaaactttatatacgtgttcttaacaatttaaaagcaaaggttaaaaaataaacttcgataaaaaaaaccctcaaaatcagttctaaatttaaggttgaaaatttaatttttggctgataagtataagcataagcaaacatatggtaaaatttgctcggatacacacttgtttgctacatatgacacccttttatggttttggcttaggacatttttgtggttgttggctaaaatgtgctccctccatccctaaatgtttgacgctgttgatttttttaaacatgttgaccgttcgtcttattcaaaaaatttaagtaattattaattcttttcctaccatttgattcattgttaaatatacttttatgtatacatatagttttacatatttcacaaaattttttgaattagacgaacggtcaaacatgtttaaaaaagtcaacggcgtcaaacatttagggaaggagggagtactacacttcaaccattattgtagtatatatattttccaatgaagagataaactttacaaacaacggttctatccttgggcatcatgtaagatttggatataaacaaatcaatatacatttgctgaatttaaacttattttcaaaattcaaaaaccgcctccaaatgtggaaattagacaaggtacaaaaatttaaatttcacgaatatttgttcaatttgtttcattttttcctcaattctcatttcgtaatttggcacaagttttaaatttcatggaatatgttttaatttagtcaaaatttattcgaatttaaatattgcagggtggcctaagggcgagatcgttttgtataaagtaatatctctccattagaaatgaatacattaaaataattaacggtccgtgtgtatttcagaagacagcaaaaaaaaaaaactgaagtaaatcccacagatcctaattagatctagcccttgtccatgtgacacgtggtacatatatactccggattttacctcgtgctagttaagggaaaaaagaaaaaataattaactaaacggcacgaaaagcatgggagagaaaaaaagtagcctacacattgcagagtgatttgagatcaaggtgttgatgtactagtggcgctgatgaagaactttgattaaccgttgcaatcatgcttggccaacagaattaacaaaaaaagtaccatcgttaattgtaactttacaccaaaactatcacactgtcaattaattaattattagtctgcagatatatccatcttaattaattagctagctagtgaaatctgtcactagcacccagatattaatttagcgtcatgtagcattatatccttgctggattgcattctatttggtttttcatttttacatccatgtgatcctcgtagttcgttgcaaatgacgattattttcagtgatgtaatcccgcatggacgcatttgtaggtaaattctaaataaataattcggcgtccgtatctaaaagctatcgctcagtgcatcaatcggataattgttccacgcccgtttctcagttcatcaacttgagcatgttgcgatttaaaaaaaaaattaaagagccaagtcaggagcatgcataagtgccttatcccatttcaacaggattcagataattaatccatgtcaattggttccattccattttcataatatcttaaaccaacctattacattttaaggtggattaattcacgaatgttccatgggaatcaacaccgtaaacactgtttaaaacaagtttcaagattaataatttcaatgaaagtcctgtgatttgatgaaggtaattgtgagttttttttttctgtttcgacaccttaaaattctgagaaacgtttaaactacatatgaaaaatctgggtttcctagcttctagatcctatagcgatagaaatttaaagtatatatgagaatcttgactatttaggatagctgaaaattctaagaaaatctactgcacggctaaaaactttcgaaataggaccttaatttattactttatcatctcttctgatggccttctcggtgcttccaaaaggttaatttcactgtagcacgttagttggcacagcatcgacacccagcgagtccatcctgtcaagaacgccaatgacttgcacagatagcgtcaaattatttggtggagacgggcgacgtacgcgtggaaatcgcatccatctgctcgcggcgacttggaagtaagcgatcgagacgagcgctcacagacacagtacacatccagctgtagtcggcacaagcgatcgatcgaggctgtgtctagttcagcgcaaaatttaaattttggttgaaattaaaaatgatgtgactgaaaaattgtgtgtgtatgataggttgacgtgatgaaaaaggactgaagtttagatttaaactttggatctaaacacagcccgagtagcagtgtactagtgttcttctcaggacatgatggccagcgattgtcttggcatccagaaataaaaaggttctctccttgatgatatatctctgtgtagactaagggtctgttcactttaataccattttcaaccttaccaaattttggtaaagttgccaaaaaagtggctacatttagtgtgctaccaaattttggtaactatataagaaatcctatcaaaattttggcaagtttgctaaaattttggcaactataccaaaatttggcaatgccaaaatttggtaaggttttttttggcatcaaagtgaacatgccctaattcaaggtagcctagccatagctgtgtgatgtcgacgctgactttctttgcctcttcttatctgcaaattaaaaccgttaggtcatgatcattttttagctatttttattttcgtattaaaatgaaaattccttacgctcctaagctttctttctttctttataaaggcaatacaaatgcaagtgcttacataaaaacgcgtgtatacttacccgtatgaacacgcacacacaccctactttatgagtactttcgaatacggaaccggcttatcttgagattaacctattgcctaccactgaaaaaaaaaactaggcataaaatgctacatccatatatactaattaagtctaggacttttagccaagttgaaaagttccaccatcagaaacttgactagttaccattagggtttgaagtttcagaatttgttttcttgccgatggggaccggtaatttcataatttttttggctgaaattatttgaaaatttgactgattttgaatgaatttgaataaaatttaaccaaattcacaaaaaattacaaaaaaaagaagaaaatttcgggtgagatgtgagcttgccggtggggttcgaaatttcggaaatttcgaaccgaaatttcaaaccctagttatgatacgctcacttcgtgactctcttgtgttcatttgatttatgttccccgaaatgactatattaccattctctcgtatttatacattgtgaaaatttcatactttattataaaatcaaacaggatagatatattaggtccttataataaaatcaaataggatacaaattcataaatgttagtgtttttttataaacttaaagttaaagaattttgacttaagaaaaaactaaaacactaaaacaacttacgatacggaacaaagggaacaataattgttgttctagatacagatatttgggtggcatgcttaaaataaatttcagtaattacgccccccttttgaatgggcaatttgtgaacttcatgaaaaaaggcgggtaccttaggagcataagtactgaattttatattctaattgatcaaatgaatatcccctcgtttattacttgacattcaaatgattataaaaaaaataatatgatagattaatctatatatgatatatcatttcacaaacatgtaactaaataacaaattaaactaactattatgcatactcatatttatatttgttttttttataatttatagaagttaaatttggtgttgaatgttaatttctagagtgatatatcatataataatctatttcattaattttatttattttttctaattatttgaatgacatgtaaaaaataaaagaacattccctcaagggattagatagtttgctggttcaatgatgcatttttatttgactagtatatatattattccctccgtttcataatgtaagactttctagcattgctcatatttatatagatgttaatgaatctagatgcacatatatgtctagatttattaatatctgtatgaatatgggtaatatgctaaaaaagacttgcattatgaaacggaggaagtatgtcgccaggctcacttaacatgtaggtctagatcggtttaaaatgctgcatttaagtcggaatcagatcatgtatacatgtaacacaatactggtaagtagtaagaaatgccgatctagggatgaaaaagaataactgagataataacttaccatgcaattttattattgcacaaatttaattaactgtttagtttgatacttggcctcatatatagtacgtagtaattaattaaaccatctcactaggctccaactagaaatcagatccacgtctactagtacagatatgtgatgagcagatataagtgcatctgccacacatcactgaaccagcacatggatcacattaagcacgtcaatgtatgctaattaattgattaactataccatgcctaattgcttaattagcagccaacggattcgattgatcccattcgccaaaaccggccggagtcgctctcatgaaaacagcctcagatgaccttgaagtatggacagaatacaatagcaaaccgatcgaataattctatctctgcttacataaaagcaaaagcaaaagtaaacacacacacacaaagcaaaaacaataaatcagtattctaaaaataaatcagtaacatcaccacaccgctctccaagtgtcaaaaagaattaaaggacaacagctactggcactctccatgaactctcctggtcatcatttcacacccatatactgtgtccaaagtccaaaagctctaacgtctctagttttggaccatgcagactgatgaacatctgatgagatagccatacacgagatgcaccctataaataccccagctccccttcactccaaccacactacccagctcactgaagtagcaacgcagctcatcagtgtcaagatggctactactaagcatttggctcttgccatccttgtcctccttagcattggtatgaccaccagtgcaagaaccctcctaggttatggcccc

SEQ ID NO: 60858 - DNA, 934 bp, Oryza sativa
ctgcagccctagcaaaccaaatgaatgagataatgaaatgaacaccgaagctgcaagtcgcattgtttcattccagagcaaccagcatcacctggcattgatcctaaaagtcgctggcaatggtttccgcagcacactgatgaagtcatcccactcctcctcgcgaacaattcgttgctcctgcaaaggcacagccatgaacatgcatgatgcaccaacatttccacccacatactttctgtaagcagcattacagcaaaaaacacagcatatcgcctacaaagcagcacaccgaagaacagcactgaaactaaacaattaggcaaccaccgccatgtttcaatcaaaaatcgcgcgcagagtccggttcacctcaaatctccccaaaccgataggcacgggccaacctatggctaaagcgagcaatcattctcaccttgtaatactcctcaaaggcagggttctcgaggggtggcggctgccacgagcggttggcctcgccgcgggcagcggcggcgggaggagcggggcggggagcgtgcctccagaagctctcgagcgcctgcgtgaggtggcggcgctgcacccggccgcgcttcctgccgccggcgccggcgacgcatcgctttccgtggccgccggcgacgaggaggctgtggagcgagacgggcgtcctcgacgctatcatgttctggttgtggggtatgggccgtgtggccgcgggccgcgtgggtttaagccgtcgggtttcaatttggcgaatttcaatcagattcaaatttgtacattatggcattaccaaattggcttaagtctccttatatttatacaaagttacacacagagactttgccgtcattaacacttggaaaaactagtcgaaacggaagaactcaaaagggaaaaaaaatagaagcaaattgttcaaatgggg

SEQ ID NO: 60859 - DNA, 1117 bp, Oryza sativa
ctattacagtatttaacatcaagtaaaggacgcttgtgaaagatttattgtgccaacctaattaagaacatgcactaaatatactcatctaatcgtgtacacaaaccgataaatcctttgtgtgaactgtgtagtgcaaactgatcagaaaaacaaaattgatttggctttcagttcttggtacaacaaaacaagagaacaacaatgtaaacatttgtgattgaacaagtaagttctttcacaaatgcataaaaattataagtacttgtcaaataattcgaggtgcagtaaattagactgcaattcttcctattacattgtgatgctgaatacaaaaatctacagtttttgtagcgagacataattattattattactaggtgaaaccccgcgcattgctgtgggaatttagtatgataacagtaaaaaaaataacatgtaagatagctagataacataagattaagtaaattaatgtggtttatgataatttaaatttaaatagtatgtagaatggtgattcaaacgtaaaaagtaaggtggtatgactttatggaagaagaaaagtagggagatagtttggaccatagattaatcatctaaaggctaaaaacaattgatgtgatatgacttaattagaggaaaaaatgagaaagataatttggaccatagattaatcatttaagcactaactaagtgaggatgaactatataaatatataggatatcataaaacataataaagatatatattaaaacattttgtgaattattttggatgataatttaacatgtttgtatttgaaaagctcttaaattataaaaactatattgcatgatgtttaaatgtgatgattgttagtggatgataatgtggcatcttgttaattagtggatgatgatgtggcatcttgttagtggacgatgatgtggcatctttgcatgataagcttaaggagtttgtggggataactttatagtaagatatgattaaaaaggggaataaataagatattcgggggtaattttataccttgatgataggcatctggcctccaaacatgagcaccacggacatctggaagagcacacggaaggtgtcccggatgttgttcgc

SEQ ID NO: 60860 - DNA, 1142 bp, Oryza sativa
  unsure (1)..(1142): unsure at all n locations
ttcgccgtcgtcctgctgcttccgccgcatccatcccggtgagcagtcacatcctccgccaccgccgcntgcgccgatcnccatccatccctccagcgagcagggcgggcgccgtcgttcctcctgctgcttccgcccgcatccatcctggtcactggtgagcacatcctccgccaccgccgcntgcgcttgcgccgatcctcatccatagcgcgagcgagcgttcctcctgctgcttccaccgcatccgttacgcacatcctcactttttttctcgaatttgcgttaaccctagcttctgttctagaaatttgcctcaaccttaatactaaaacagtttgatggttcccaaaaagtttcccatgttaagaaagcttggttacgcactaggatttcatgatttgtctatctctttgcaccaccaaaggcaccaagctgatatcctggttgcagcagcaccatgggtggagaagatgagtttcgcagtgttaaaaatgatctagtgatgggggttctgatggcaaaaggatgacttggggcattttggggtgaaggaaggctaggcacaaaccctcttgagaggacagtggtgggttatagctcatgtttaggtttgttctaagggatggtatttatcacacctggacaatacgattttggtaaacctttctagctagatttttggttctagaaagggaataagttgaatgttgtgaggatcattgatgatttggaccacttgtgccgttaactctcctagcgcataaagcttatgtttccctaaatgcaaccgaccagttagatgaagggttgttactatgaattgatatacataacttgtatttgaggtgaacatgttaactcgaacaattacatattgcatggtttctgtgacaaactgtatacatcatcctagtataatgaacaagcttagcacaacttgaatcttgggtcatgttttgccttggttcaaaggtttgcatcatgtcatcaatatgtcatataaagtgtaaaattgtttgtggaatgctagaccttagctattttcttttatattgccagtgaaaatggaaggaaatgctagaggcggtgggcattctgaggcactgaagaactacaatctaggaagaactttaggtatt

SEQ ID NO: 60861 - DNA, 7212 bp, Oryza sativa
gggagaggaggaggtggaggggaaggtggcggacaaaatggatatggagatggctatggatctggggttggatttggtcaatttaacggcggctggccatataataattgatactataaggctggtggtcgagggagtggaggtggtggtgggtacggtggacctaatagatttggacatggatttggttccggcgttggtataggtgaggctggtaatcaatacggtgatgagtatgcgaagagtaaaggtgacggtggaggtgccggtgatagcgctagaggtggatatggtgaaggtttaggtcatggatcgggatatggagacaccggtcctcaacagccatgaaattaacctttgtataatttgaataagatagaataagtgaaagcccaacaccaatataatgtagcacatagttttcatagtcagtatattaaaaggcttcttgtgttttggttatatatactccgtaagttgcaaccttgtacactctaatcgtacatcggatattttcctggtaacagttttaacactgtttgcactagtaacctatcgctcatgaataccacgtccatgtgagtacgctttgaatatgatattaatgattgaggtcaggaatttgttgtcgatcttcattctttagacatgcgttagaggacatatttatagatgtgtgcacgtggtatacgtacatatataatgccctttttttgagcaaaggatcttggcactccatttctacgtacataatgcgtatgcacacatgtatatctatctattatattatcaaaacagctttgaaaggaggcaccacgttcgctgtgggggctaaaaattcccacattaatcagagaaaaagaaaaaaaagaaaaagagagtccaagtaggaatacaatttaaaaatagctgaaattcggaattaaaagtaagcaatattgaaagaaatttccatataggaacccaatacgagattaatcaaaattcgaaataaaaataaaataaaatccgaaattagcaaaaaaagagtctaagtaggaatacaatttaaaaatagctgaaattaggaattaaaataaggaatattaaaagaagagtccatacaataacccaatacgagattaattaaaattcggaataaaaaaaataaatatcgaaattagaaaaaggaaaagaaaagaatagttcaagtaagaatataatttaaaattaactaaaattcgaaattaaatataagcaatattgaaataagagtacatataagaacccaatagtagattaactaaaattcggaataaaaaataaaatataatctgaaattaggaaaattaaaaagagagttaaagtagaaatacaattttaaaacaactgaaattcaaagtaaaaataaaaaaaatctaaagaacacaatacgaaaaataaaataaattctgaaattagaaaaagaaaaataagatatcagctaggaatacaatttataaataactaaaattggtgataaaaaaataaagattactaaaagaaaagaccatctgaaacacatgacgagattaattaagtaacatgcagtagagtggtggcggttgatggaacatctaaaaactattaataaaacatcaaatagaatattaatgacgactaaaaagaagtacaacgggcaggtcgtgaagcaatcggtcaaggcgtttggcgggtcttctaaaaagtaaaaaaaaataaacccaatgataattatatttgatttttacgttcactgtgggggctagaaatttccacattaatcgaagaaaaagaaaagaagagtccaagtagaaatacaatctaaaaatagcttaaattcgaaattaaaagtaagcaatattgaaagaagagtccataaaggaacgcaatacgagattaatctaaattcggaataaaaataaaataaaatccgaaattagcaaaaaaaaaatctaagtaagaatataatctaaaaatagctgaaattcggaattcaaaataagaaatattgaaagaagattccatataggaacccaatacgagattaatcaaaattcggaataaaaataaaataaaatctgaaattagcaaaaaaaaaagagtccaagtaggattacaatttaaaaatagcagaaattgggaattaaaaataaggaatattgaaagaagagtccatataagaatccaatacgagattaattaaatttcggaataaaaaataaaaaaaatcaaaattagaaaaaagaaaagaaaagaagagttcaagtaggaatataatttaaaattaacttaaaatttaaaatttcagaaaatttgaaggtaggtggcaggacttctagaaagtaaaaaaataaacccaatgataatcatatttgatttttaaaatctcaataataataaaaatgagaggcagcggtcgagtcgtataggagtacaatggcaaagtcgccgatggttggtgagtcttctataaagtaaaaataaataaattccaatgatagttatgtttgacttttacaatcctaataaagagtatgcggcggacgggtcatagaggagtatagtggcagcgtttaatgggatttctagaaattataaaagaaaaatgaaatccaacaagacaataaactccaatttttaaaggttcgggtttctaaaaagtaaaaaaaaataaaccccaatgataatcctgtttgattttaaaatctcaatgacaatgaagaagggcggcagcgggtgagtcgtagaggagtacagtgacaaagtcgctgacgttttggcggaacttatagaaagtaaaaaaataaacctaaacgataattatgttcgatttttaaaatagcaatgacaatagagagaagatgcagtggacgatcatagatgagtataatggtagtgtttgacgggacttctagaaattataaaaaagatgcccaacaggacaataaactctaaaacctataagtttttagatccaatttttaaagattccaaggagaatgaatagaaaactgtgatagatcgagcaaacaaataaagaataatatgacagaagtaaggggtagcaactgttgtgactttagaaactaaagaaattagaaacgcgaggataataaggtttagtctttaaaaatcttaagacaacgagataactatttaataaatttgaagtaaagtcatattaaaaatatataattttatatgggtgctagccgcgcaattgcgcgggccatccagctagttccttgtaatgtgaaaaaaaaatgatcaacatcatattgatatgtagtattatatccattctaaaatatagttatttttagcacggtaactatttcttcacctactatctcctctcaaccaatcgcaaccattctcttcatctactttatcttattcaccaatcgcaatattctccaatcttctctactcactctcttaatatcgatatctaccttaaaaatacttacgctctgcaacgaagaaagtagataaacaacactacacatttccattgaacagtttcctctctaataaaataatagtaacacataccagctcagacttctgtttggtcatctcgccgtcacatacacggacacgctcggctgccccgtccgcatgtagcggcagcgcagtccccaacgatcctcgcgcgtggtctcggctgataatagatacaactacctttctagcatcaccgatatttataggaataagttcactttaggtcccttaacttgtcaacgaatccgattttcgtcctccatccgcaaaaccagatacaacgggtcccttaacttacaaaaccggtgcaaatttcgtcctaaggcagtatggctagcggtttagtccgacgtggcgctttgacttgtcgtacgtggcgctttgaccgctgagtcagcacggccgttggggaataaaggcttctcgcgcattcggcgccaatcctctcacatttcagaaaccctagcttttcggcgtgtaggttgcagcgattcagacggcggcggcgtcgtgattcggacggcggaggagcggcgatgggaagctcaaggagtgaggggtcgtcgtcgtcttcggccaggcaaccgtatggctcgcctattccctatcgcgttggtccgttcgagtacgaaccagcggtgctgtgtcggtgcgaactgaaggcggcgaggtggatatcttggagcgtcgacaaccctggtcgtcggtatttcaagtgccgcaatgctcgggtgagtgaatttgccgtgttaattttggattggttttatttcggattgggggcctaaatattagggtttttgacgcacagaaagggggctgcgatttttatgcttggcatgatggcccgacaagcagctttctgagggaggtgttgaatgatttgcgaggtgctgtgcattctctaaggagggagaaggcagatgcagtgaaggaggttgaggaacttcgtgtgaagtctgaagagcaatgcagggagtttgcttcagttgggagggagttggcttcagtgagggagttggttagtgagttggatgtgaaaaatgctgttttaattgatagcaaatgtaggttagagaaggagcgaactgtgctcatttggtgcatcctgtcatgtatgtgtgttgttattctattagtgctgggcaagaactgatattgtgtgggcatggcctcaatgtttgatggaaaaaaaatgtgtggcagaactgtgaggtgcaaaaatttatcaatgaaatgtgaagttctgaatgtcttgccaaaattgctgaatgcaatgtcatgtatgtgtgttgtgtacaaatatgcagcaattatgttttgtatgatagaaaaacaaatctcagcataaatgtagccaatataaattaggaaacatcacaggaaccaaatgtcagtcaacagagctgcttcaaatgtggcattgcatcaaaaattgatttgcatcacattgtcagtcaccaaatctggtttgcatctggagtaacaaatgtcatcaaatattctttctcagcagacatgcattcactaaacaagtgttatgttttgagcacacatgcatataatgaaaatctggaagacaaacattagcagtgcaaataacatatcacagtattggcttaaaggttgccattacatcacataggtcttagtttgcgcaaaacacataatagatggcctaaagtttggcattacatcacagaggtctcagtttgcacaaaatacatcatagctggctcaaagtttgccattacatcacagagctgctatacacagcattcctaaaagcttggcattacaaatgacaatgcatcatagtttgtcagattcccatggagggagaagaagcagtggtactttagctttgttctttgtagttgtcctggcaggttcttgagctgaaactatagttggccatgtgggccgcccggctcggcacggcccaggcccggccgtgcctgggccgaggcttgtcgggccggcacggcccgaccaacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcctaggcacggcccgacggtcgggccgggccagcacgggcccgacccaagtcgggccgtgccgtgcttgggccgggccaaaaaggcgtgccgtgggccgggccttcgggcctcgggccttatggccaactatagctgaaacagatacagatgctttccctgaagtaacagtgacaactgcacttgtagagctgttggagcctgcaacattggcctgcaaatcaaccctagctgagccaccagaaggtgtagaaatttttgcccttgcattcactctgacaatttggaggggctccatttgtgcctgtagaatcagatgaagcacacattagtttaaatcaaaatatgcacaatgaaatggcatggctgatttagcttacctttttttgtcggcttggttgcctttgactgagaggctgaagtagtggtagtcaaggtgccagttgccttcctttttctactttgtgcacaactctggggggtgttggacagtacaagattgtggctgggtgttgcaacctgctgtgaactgccacctgcagtttgagctggattgtgtttgtgacagcttgatttgttgtggccaacctgcttgcaagtcctgcatctgaccttggtgccaaattttgatgccttagaaggcttagctggctcatgagcctctctccttctttcagttctgggcctgcctggcatctttatatacccaggtgcagtcagtggctccctatcatcttctggccatgcattcatgccctccactggtagtaggcaatgcttatatgtgctcttgaaagcatccactttgtagcaatcagcagtgaactcatccagtgtgttagttctgtaaaatatacatgcaattgcatgggggcatggaagaccagagagttgccaatacctgcaagaacactccttcttgtccagctgcacagtgaacctattggtgtggtgttttacctcaaagctgtcagctccattgcatatagcatgacagtatgctgactcagtgatatacacattcaatttctttaggatccctggacagaccacagtgttccatctagcagaaacctttctctgctctgaaatcctaaccatcaccttcctccttattgtctctagcatggttataattggaaaaaatcttgcttctaggatccatttattgaatgactcacacatattattatcaactgaatcgcagtttgagcctaacttgaaccatgcacggctccaatgttctggatgggtattaagtatggcctgtgctccagcaggtgtcacctgtgctagctttgcccttgccaggttgaagagcatcctacatggag

SEQ ID NO: 60862 - DNA, 1286 bp, Oryza sativa
ttgttttgtgtcagaaatgttactatttttttaataaacttggtaaaatttttaaaagtttgacaaaatcagtttagatagttttcggtatccgatcttattttcggaaaatgatatctcaaacgaataatttttatttagtaccagatacggaaatgaatacatattgcttttctcagaaatgaaaattaatatggaagacaagtatcagacggaaatccgaaacggtcggaaactatctgtatttgttttcgaatatccgcaggtagtaattagtttttagagaaaacatgtatatatacataactctatcatataaagtcagatgaagacgaactttgtatcaaaattgtagtgctcgatgagatctataattttgttgttgacaatgttatcatttgaaatcatttagagggttaaatattcattacataatctcatatccatttttataaattcgcacaccaacaattcaaacgactttttgatggagccgtgctgcttgataggatttactcctttgtagtttatgaattctttatttgatattatttgaagtgcaaaacagatagtacaagttttggggaggtgaaataaaacaaatagtattttcaatctagacaacatgagcttaataagtaagttggtaagtaaacaatgcatggagaagagatcctgggtttgatcaaaggactgaaaatcagttctcacatgtggatttcttaaagaaataaccatgaaaatcaaatttcacaaacagttgtgagaccaccttaaaaaaaattgacgatatggaatttagaaatgtaacaaactatatctcttccttggttcaggaaactcaatttgacttgtttttataattccaataaatattcgtcaccatatttgttccatttcatatttgcttcgtatatatagtcgattccatttctgttccgggggtcttcgatttcaattttatctctgaagaaaataatacaaacaaatatggtagagctgttcctgtccgtttctaatccgttttcatccggattgaggaggacgtgaattaaattcggtccatagttgaggaacttatgttgaacttctttactaagaaatgtcggcctttcgagaagctgggcctcacggcctatgaagtattcgaaccgggatagaattgggccgtgccagcaacaactcgctgggcccattaacggggttcaccgtatgctccgtatgttcgaagatccctttccgaccgcgccaccgccaccggcatcgcccattgccatcgccatcgc

SEQ ID NO: 60863 - DNA, 654 bp, Oryza sativa
ccaaattcctgtgctgtttaattctctagcattgcagatctgccttatatatttttggggttacattttgttgttttacaactttatagatattttaaatacaatattaaatatgttatttttttattaatattggttccattcaatttgagactaaatgttagtttcatgcagaaaatgcaaacactgctagaagatgttgaaagatccagaatgaagacttaatactgatgaatcccctaatgatttttatcaaaatcattaagttaaggtagatacacatcttgtcatatgatcaaatggtttcgccaaaaatcataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggctgctagctttatctgttcgggcaatacgatgcccattgtacttgttgactggtctgatatccgtgagcaaaaacggctta

SEQ ID NO: 60864 - DNA, 1400 bp, Oryza sativa
ctatagctcctgacctcctccacgtcgtgcctccacgcttccggggatcgcacacagttgctgctgggttagcgaacaactcctgggttggtgacatacgtggcgccctcactgtcccggtcatctctcagttcctgttagtctgggacgcggtggttcctacccagctctcgccgggtgttgaggatcacctcgtctggtgttggacgggtgaccagtgctactcagcgcaatcggcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagtgtggtatcgatagccactctgcttgccccttttgcgctcaggagcttgagacagcgaaccacatcctcatcgattgcgtgttcgctcggcaggtctggctccgtgtgttgtcccctcctggctgggctgccctctctccccctcatggcagctggctccaggattggtggtcatcctccagggtatgtttacctgagcaccttcgcagcagcttcgactccttggtactcctagtctcctggcagctgtggaaggaacgaaactccagggttttcgactctgcgctcgcttcggtcgcagtggttctagagtccttccgctcggagggccagctgtggtctttagccggtgttgcttgttttggggatttcttgggagtgtagcgtggctctgccccctcccgctgtttggagttgcgtttttaaccgtcgtagtagttcctagcttcaagtccccccccccctttaggcataagccagtctagctgattgctttgtgtaacaaaaactcttttcctgctaatatattgacgtgcaatccttttgcgcgttcgcaaaaaacttttgccggatatcttttctgtttattcaagatgtgtgccactgcacattactgcatgcatgacaattgctttgcttggttattttatttcgcgactattttcagagtcaattgatgtatgtctctttaaatcatattatttcttctttacttcgatttgtgcctccaataattagacctcgtctcgtgtagagtactaatccaagcagtatgttatctccaattgagaaattggttggtgaaaagtgaaatttttgtttgttcctttcgatacttttttggatcatgagtacgggagacatagctaaacaagttccatgttgcgaaacagaaattgtatgcctcagatcttcattcctcggattattgtgaggatttcaagttatttcttatttcacaattagcataggaatctctagcatttacatcttattaaggtaaaagcttcaagataaacagca

SEQ ID NO: 60865 - DNA, 580 bp, Oryza sativa
  unsure (1)..(580): unsure at all n locations
cgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccggttcctcatgccggcctcctacgtgcaaagggtacgtctnctgccgacccatctagggctcacttcgcccaagaccgcattgatgatcttgtagaattatcaacaattcaagctataaataaaataaattctcatgtggatagggcgaccaggcgttcataattgcggagccatcaactacgtcaaggagatggagcagcttcttcaatccctg

SEQ ID NO: 60866 - DNA, 625 bp, Oryza sativa
ccagagacttactccaaaacaaaagttacaattggagggggatacaggaatatttattaccagggagtgcctttacagcacgttgaaatattttaattgcagaatccacagaaccattcttggcatgccacatggcataatcataccatatatcaggatgatggtatagatacatcaaacactgaaaataaaaacaaagcaaccaaacagtttcatctccaaaacatagtggcacttacacggaatatcataaacttagtacacaatcacaaaggataggagtgtgcaactagaattataaataatattgtgcaaagcatagttacaaagccaaaaatcactgtggatctaagcatacaggaagaaaatggcttacttgttcaaatgtaaaggtaacacgcctattagcagttgtagcatcaatcctctgagggttccccctgcaatggaacatattttgaatttgaagggatagtttcggtctttctgagctataggcaagttagaaattaagcaggaaacaagaattcctagggcctgaaggtggtgaaaaactcatatgcttaattgcaccaggtagtgcccagtgaggctcaagttattgaataaattcaagaagcataca

SEQ ID NO: 60867 - DNA, 2840 bp, Oryza sativa
tcgtatgcctccaccatgcgcgccaagtgcacgatggtagcgtcatcctccgagctagcgtcccggaaggtggcgtggtcgcgggctcctccgcgacgagggtggtagcagtagggcgagtgctgcaactcgtccgggtagcgctggtgaagagtgccgatggcgaggagagcggcgctctggcaggcggcggggaaggagtctccacccgcggtgactgtcagcgaagtccgctcgggagagccagcgaggatcactgcagtgacctcccaagcagcgtggggctccgcatcgtcaccctcctgctccggaagcggcctggcctggtagtccactccatgtggataccccaggaccacgcacatgccccgcagctccaagacgaaaccagtcatgtccaaaccacgacgggtgacgctgccggccatctacaaacaaaaacaaaaagaaaagcaacattttaaaggtcagattttggcgataaatgaagcagcaagacagagagagactagagggttttcacaaataagaaggggtttttatttcgaaaatattgctaaggcttgggatctacggctcgtcctagggtcaagggggctttgataccaacttgtcacgaccggaaataacccaacgggcattccttacgtgcgtgcattaatccttgtcccaggaggcaaggtacaccaaaagttgatacaattcagagtttaacaagcggaagcgtaaatagataattattacatgggcagcgaaggcccagcacacacacaaagaccaacgagaaacagcggaagactagggcgacgaccacaggcacttgacggcaggcacgagctagacaccgaagccttcatcttccaggaactcctcttctggggttgggaaaaattgagcaagactgagtacaaccaccgtactcaacaagacacacccacaagtgcagaattaatgcaaggtagtacatagaggttatactgtgagggttagggttgcaggaatcagcatttaaagacatttagttgctcagggctattttgcatacacgattctagaactaaacaatattatttatcaaggccgtgaacccacacgaacctgccttaacccaaggcctacgatgagtcagaccgaactggcaacccgaccctgggtcccagctcgtcccaagccaacccaggccaacaattccacatttagttgttaagcaggttttaagattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaaaagaggggaggtgtgaatccaattccacagaaatccaacaattccagtgtgtccaggtgatgagaatattcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgatagcgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggattttactctaataaactccatataaccagtaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaatggatttattgcgtcagccgaggagaggggcgcgcggaccgggtccacgggggtggggcccacgcggcagccccacggtccacggtggaccgggcgcacccgggctcacaccggccggcgccgtgggtcccacgcgtcagccgcacctaagggcgcgggcggctgacagccgggccccacgcggcagccgctcggtgcgcccgaaggcgaccacgccggtgcggccggcgggaggcggcgcgcccgcgcccctatggtcgccggcggcggccataggcacggcggagcggcggccgggagaggggtgtcgcgtcccaaatcgactctaaaatacatcctcaaaattatgccgagaataattaaaatccatgtgaaagcctccaacaattaaatatgcaaatttaaagtcaa

SEQ ID NO: 60868 - DNA, 836 bp, Oryza sativa
tcagaaactattttagtttcagttttcttcttctttttctggttacagatcaagtctaataactgttcctacttttggtcaggggttgtagctttcatgtattcatacagtagctgtactagtatactcctactgatgagaaaggcacacaatgcaagcacggtggtttgtttttttgttttgtttcttccctgcgtttttttttactggccaagaaatgaagaaacgaacagagaggcaaaggcaggcatgcaggtagaggcagaggctgccatgacaagacgcaacggacgcatgcaggatgcagatgcagatgcatgtccacaccaccatttccagaatctctcctctgattgattgatctcccgccacctttgcccccattcaatcagtttttttgccccccccccccccccaatcggatgccctaatcagccacaaaaagagttaaaagttaaattttaaacttaattttaagattgatttaaagatattttcaacgtaatttctttttagcattgacttttaaatcaccaagaacataaatataaaagttttacctataaatttatttttatttactattaagccgttttgatatattagaggatatgagcaaacgatgagactctttctttatttctctctcaaaagaaaaaggcttatttattattcccctcacttttaaaacgtaaagatttttaggattcaaattttatattaaatgtaagcattccaaaactgattctcatgattacaatcattttaatgattccaaagccaatcagatgattgaaagtgaaattgcaacaattcaaaatttaaaaattgataac

SEQ ID NO: 60869 - DNA, 698 bp, Oryza sativa
attagatccacaacagctcctccatcaaccatcatcttggacatcggcttcccattgacaaacccattgatgtacaacggcttgagatgtcgattctctgtcccttctggcttctcaaaaactgcttgctctcgagacaaaccaatttagccgaagcttcttcaacatcatcaacatcggcttgcctagcctcgaattctgcaggtaacatgaaaaccatatttattgaggcagatgtaccagctttgcccttaagcaacctttttgtcttgtcaccttcgatctcatcagctgttgcaaccgtgctcttaacacgtcactcttgcttggtctttgttttcctcagccgatgattaatctcctgttgcacctcctgaaaatgctccctgttcctcatcctttgcatccttctcttctgattcttggtgaaaatgcctgtaggacaccactgtgtattcctattttcatcttcatcatggcgataatcttgattcacagggcccaacctctgatgaacagctaccctcttctgactcagccgattacctctattgctggatcggcttgaactccctgaatcattgttgcatccaagacaatcctcaattgatggcagcctcataccttcattccaacaaaatctgaagaactcacattcccaatgaggatcaaaaccaccatcatcttcttcataatat

SEQ ID NO: 60870 - DNA, 2151 bp, Oryza sativa
attcgctagtgcatagcgtagtaattgtaatattgggtgagaacgagagggagggctgtcagtggtggttgaggagatgaggtcaaatccaccagccccccgagctcggcgcgctggagatggctaggcgggtgccaatgttgggaggttgacaggatccagatggaggtggcgggagggtgttggtcttcgagctgccgagcatgataaggtcgaatgaagatcagattattgagccaagtggacgaccttgttagcctgctctcctgttggagtttttttttctcatgcgggagaagtagaactataggtggacgaccgggcctgggccgaggtcagttggctcggcacggtctgacctatacgtcggatcgggccgtacctacacacgggctgcacacacggcccatgcacggcccaataagactcgggccatgctggcccggcccgaagacacgatagcccatcgtgcttctccatagaataagtatatttcccctcttacctctttgggttgtgtcttatatggttggaataagtctattttgcatccttctttgggttgtgtcttatatggctaagataagataagtccattttagatccctaactattttctttgatcgtgccgtgtcgggccgggccggcatgggcctaacactagtcgtgtcatgccgtgcttgggtctcgggccttatggccatctataaggcccggtttagttccccaaatttttttcccaaaaacaccacatcgaatctttggacacatgcatggaattttaaatataaactaaaaaaactaattgcacagttagagccttagaggtatgggggaaatcgcaagacaaatcttttgagcataattaggctgtgttcagattcaaggatgaaaagttttggcgtgtcacatcggatattcggacacacatttgaagtattaaacaacagactaataacaaaacaaattacagattttgcacgtaaactgcgtgatgaatttattaagcctaattaatctgtcattagcaaatatttattgtatcaccacattgtcaaatcatggagcaattaggcttaaaagattcgtctcgcaattacacacaatatgtgtaattagttattttttgtttatatttaatattctatgcatgtgtccaaacattcgatgtgacagggtgaaaatttttgccaggggatctaaacatgcccttagtctatgattagccataagtgctatagcaactcacatgtgctaatgccgaattaattaggatcaaaagattcgtcctgcggtttccaggcaagttatgaaattagttttttcattcgtatccgaaaaccccttctgacattccgtcaaatatctgatgtgaaatccaaagattttcttttattttagtgttaaacaatacgcccagcacattgattttttcaagcagcaacacgcagtcgaccatttccatcgtacagtgaaatgattgaccaaattacaggggaaatatgcttcagcctattggccaaagctggcgagcaagggccacgcttgtaaggctgagttacaattaaggcttgtaattaattaagtccttgtatagttcgctaaatgtcacatcgaatgtttgatcggatgttagaagaggttttcggatacggaatgaaaaaaataatttcattactcacctgaaaaacgcgagacgaatcttttgagcctaattaagctgtcattagcacatgtaaattactgtagcacttatgactaatcatggactaattaggctcagaagattcgtttcgcgatttccatgcaaactgtatgattagtttttatttttatttgtatttaatactccatgcatgtgtctaaagattcgatgtaacatttttgggaaaaatgtttgggaactaaatcaggcctaagtattaacttaaaaaaaacttgaaaatgtacaaatatgatttttttaaagcaactttcttatatagaatttttgaaaaaacatagtagtaccatttaattatttgaaaagcaaatgaacatgaaaagagagagagagagatgagttgagaaaaagaaaggattaacacagtgcgtgccatgatcgtgactcatgagccttttgccattcggtgagtgcaccgtgtgccacac

SEQ ID NO: 60871 - DNA, 1663 bp, Oryza sativa
tgtataaagtattatttatgttttatcattaacaacaataaaaatactaatcataaaaaaaattcatataagacggacagtcaaacatagaacacggaaacccaggaattgagtcttttttttggacggagggagtatgtcactattactagcttgtagtaaccgtagcccgtgcaactacaacaaaaggacagtcgaataggacctatatacgattcatacacaaagtattgtctccattttaaaatataagacacaaccacccttaactcaaagaccaagaaataattattatcacatcatagtttggattaccgtaataaatagaatgcatgcacccaacaaaattagagatcttgataatgggggatttaaataataatattttagtgaaaaagatgtgttagttaatggcatgtatgcatgcacgcttatattatgaaacaactttaaaaagtaattgtgccttatattttggaatggagggagtagtataaaaggtagtgggtgggggaataaaatagtactccctccattccaaattgatctacatatagttttttgaggttattcctaaatgatctacatatttgtgtttattattaagtatattcgttatttgtgtattggagtaaatgggcattgatgcatgcatccatgcacacaagtatttataacccacatgcactatcttgatttgctattggctagaaaatattagggatgatgcatgcatcgagtttgttgctagaataaatatagtatgagagagttattagcttttcttggtcttggtgtgcctataaaatatgtagatcaatttagaatggagggagtataaaagttggtaggtagagaataaagtaccgtctcagtattccaaaacaccttataattcatgataaatttagaagaactcccttatattatgggatggaggatgtatttgccaccacgatgactatacatgaatagtgtttgcttatgtcacctattggcatccttcaatatccaactgtatccgacacatttttgtccctattgatccgattcatcaccgagctagctagagtggttgcatgcttatttatgccaattctattctacacccttctagttcgagaatacacgtatttatgacactagacatgaatatcaaattaagcattaaggttgtagtccacatataggactatacaatgaatagagatgtattgcgtagctgaaaattaagtagcctagtctgagaggcttggccaattgctagttccacccttgcttaattccaaacaaatttgcaggagatataccatatatatagctgctacaactaaattttccctctttacttaggtgtatatgcaaatgcatgtgcaaatgcacagtagtaaatcgagtcatcggcatcccatttgatcacgtacgacatcaatctgataggtcatgcctaccgtactatcagaaggctagcgaccagatcgatcggtctgctgatatctaccccctccgtctcttatattgattttgacattttgcttctgatgtatgaccactcatcttattcaaagaaaatttgtataaatataaaaagaagtactttagataataaagtaagtcacaaataaaataaataataattttaatttttttaaataagacgaat

SEQ ID NO: 60872 - DNA, 11468 bp, Oryza sativa
  unsure (1)..(11468): unsure at all n locations
actgcatgatttcatctattgcaattggtcagatgacccaaaatagcatgtttcagtacaattaaattagaacttaaggccacacaatctaatgcaaaaaggacctgccgacaaatcatcacgacgagcgggacttggctaatttcaccatgagatgctccaggaatcatacatgtgtaaagagaaggtgcctaaatcaaatcaaggtaaattaggaggtggggatttgcaacaaatcttcttatagggggcatctaaaacctagagtgatatttggggtggtttttgcaattttcaatggcaataaaacggagaggcaacgagcgagccgtagaggagtacattaattatgttcaagaaagtagaaaatgaactcagacaataattatgttcaagttttaaaattccaatgacaataaagagaagactcatcaggcgggccgtagaggagtatagtgacaacgtttgacatgattttttctttaaaaaatataaaaacgaaacccaatgagacaataaactccaaaaactacaagatccaatttttaaaggttttaatgacaatgaatagaagcagtggtagatcgacaaaaaaaaaataagagtaaattccctgtgtacccctaaaaactcactcaatccctttcgtacccctgaaatttacccgatctcttctatacccctgaaatttcaacttgatcccttccatgcccctaccgttacattttccattatttcactattacatttggttgcaaatgtcttttttgcccttgatgctataggtttgaatataagcttaaaagcgattgaaaattttgtttgagtgcacagtacgtgcattttatgaaaaaaatgagactaaataattagtgcagaaaattttgacataaattttggaaataaaaaaggtaataaattaaaatttttatttgaaattttaataggacaatgatttttttttgatcgggagcattcataaaaaaattattatgaaaattggttgtcctatctttgtatgaatgatcctcttttttttttacttattttaaaaataaatacacaattttttatttcattatctaaaaatattttttgggataaataatgcatcgcacaacaaactcatagctataatagtttcgtgtgagaagcttttacatttttaacaatgtaattcatccaaagggtaaaatggtcatttttatagaaattagacggtcaactaacaatcaactgacgggaggggtatggaagggatcaaaatcaaattttaggggtatataaggaagtaagcaaaattcaggggcatagaagggattagttaaaatttcaagggtatacaagggattttctataaaattaaatgaggggtgacaaaaaagaaagtaagaggtaacaaccgatgtgacttttaaaaattataaaattagaaacatggggatgataaggctttgtttttcaaaatctttagattacgagatagctatttaacaatatttaagtaaaatcatattaataaatagatatttcctccgtttcacaatataagtcattctagcatttcccatattcatattgatgttaatgaatctaaatagatatatctatttagattcattatatctatctaaattcattaacatcaatatggacgtgggaaatgctaaaatgacttacattatgaaacagagggagtaattttgtatgggtgctagcagcgcaattgcgcgagccacccatctagtttttcttatataaagttagatgcagaatttaattatcttgtaaaaaggtaattatcttgtattatatattactgtaaagaatataatttaattccactacctctatttctaaaaaaaaatcattgtatcttaaaaaagatctgttggtgttcggtctcagcgtctatagcgtgaacaatcgcgcagtgggcttttttcgacttttgggctagcaagatcacacacaacacgcacatcacgaaccggaccaaacctccgccgccgcccgccgccgccgccgccgcctacacaaccccccctcgccccccgccgcgccctcctctccgtacgtggagcgcatgcaaatcccctcgcgctcgattcttcgcctcctccgacgccccatcgtcgcgccttattctgccctgcggcaccgcatctcgatcccctcccgcgatctctcctctcctccatggctacctctggtccggctcgcgggtggctaccggcgcttgcgcgaagaatcgcttcagtcacggggacgcttaaccctcctgccagtcgtgtttctcggtgtgttctcctgctctgatcctaaagtttgggcctttcgtctcttgctaaagttctcgatatagattctgttgaatttagttttttttttgttagaactatttgttcttatatcatgttggtgttttgagtataactagggaaattatttcaatcccgactgatggcacttgaatcggacgcaaagatttacccttttatgctctttgttcatagatttcctggatctcggaacatggccagcggcagtggagtggaaggcgagggattgggtataccatacaggcgccgcttcatcccatttgccaacgatcctatccacacaaccaaagataatatcatttctatggacaagcaccttcccatcacccaaggcaaggacagtgctgcaactaaggagttcatctcttgttatggccattgccgtcctaccacgtatggcgatgaagatgcttctaggacagctgtggaggtcaccggtggtaaacaagatccaaggggggcagttcagaacctaatagatggtgaagtggcagttcaggagctaatagatggtgaagaaattgcaaggaaccaaagggccagtgaggttagtgacaacgatggatatgaagagttcaatgatcgtgctgttaactaccactgtgactgtcatgtttggacgccacttattgcaagcagccaccgtgacggttctatatacgataccaggggcacctttggatctgggtggaaatgggattatcgtattgcagatcgtaacgagagtaagtgatatatatctattttcctgttgttatctattttataattaggacatttgtcaagctataggttcagctaatatattctatgttgaaaggttagtgtgcattatattttgtacttaaaatgataaattaaactactaaaaccgggtcacttcacccctgctttaaattgagattttgtaccataatatgacactccactctatgtcatgaatactttcgcaatttctcatgattatctgcatacattatcacatcccaagggtttgtgtccaggaggaaggtggcagcaatgctgccacttatgcaaccctagggtgccaaccagtcctatggctgctggggcccaccatgtggccatctgacctacatgccctgaacaacaaacaagacgagaaattctgtctattattaagagtctggagtctagtagactaggaagttatcaattaaatagaaatatatctcccatttaagttaagggtggcataatagatgatatttatatcaaaccacagctctaagtatcggaagaactttttatttgccactacagagtgtcctattctgggatacgccattggaaaatatcttatacggtctatggcatccacctcacaaatttcacccttatttgcaattgttgaccagtcaagacatgggaaaggtgtaaaattaggatgcctcatccacctcctaggtgatcattcccatgatggccatgatctaactggtgatgcctcctcgatggcactattgaacagaggcagcattctaccatgaccacaatcgatgaagtgtcacagaataaattgcagactttgtgcttgagggggacaattgtggaccagtggaacagagccccctcaactccaaaccatggtggtttgttcccttgtttgggacctgatgttcttttctttttcccctttttttttattttcttctgtcagtctgaattggttactagaaattacattggacagaaggtgttttttttttttgccttatattgtcccacatgaagtgatctggttttagtaattaggtgggggagtgaaatgagacgggaattatctagacaaccaaaaagctttagtcattagaatggactttctacctttatttttattgtaccatgcatgtattttatctactctttaagtttccgttacaatttggcatgtcatctttgttgtagctcggttggaggcaatgatgttatcacatcccacgaaagattgctacatgagggatggaacttgcatatggcatcctgcaaatagcatgttgcaaattttctcagtaaagttggctaaaactcctgtagttgatggctcaattgaattgtatggatacattgctgtgcgggaccttcaggatccattacttaattatatagtcaaaattggcagggatgatcccatcattgtggagcaggtatgcttccatgctctctacaattatttcaaattactttatttgtttcacattataagatcaaacttacagcatgcatggaacaaatgtgattagagcttacccaacattaaccttaacactaaaccgtccttcacccatggttagccaattttgtgctaaatggtcatttaaacagaaacggctaaccaccatgtggcgtttaaacaggctaaatgaccattcaggtgaacaatgaggttaccttttgttgttactccctccgatttcattttaattgacgttttggacaatgacacggtctacaaaatatatctttgaccttatttttctattataatatatgcaataaataaatgcatgtttacttttattatagtgctttgaaagataaatctatatatgttgtcctagttttctttaaactagatattttaaaagttattgatggtcaaagttataaaagttcgatctcaaccttgtccaacacgtcaattattttatagagccggagggagtattttacagccacaaaatatcttttacattactgaatttaggatagagtggaaatggtgtattaggctcagtttgatagtgtaggctcagtttgcaatctttttttcttaaaaagaaatgaaatagtagtagtctatggtttccgccatatttctcatgtgaatgttttcttttcttaacagaaacaggctgctactatgattttcattgtcccaccatgatctaacggcttagtttttttttctttgataatgtggtaattttttttctgaacagaaacatgccgctactatgattttcattgtcccaccatgatctaacagcttagtttttttttctttgataatgtggtaatttgtaggtcttcaaagtgaacatagtgcctctttttcaagctttctttatagtataatagatacataacatacgtgcccgaaaaggcagctaaaatattatagtgttatagctgcaaaaaatttgcttccataaacacatgtctggacagtgaggaaggtgagttgggatgcgattagtgtgtccaaaagtaacaaaataatattatggattgataagacctttatcaagtactatattgtggaatgataattatgatcagacctgtattaatcatgaactaggtgcaagtgagtgtacgtgttgcaaacagaatcaaatagaatagtttcgaaccctttggttcctgcctagtaccacataaaattgttctttttttggttgtctacagacatatgaatgacccttcacaacaaagtccttttttgtttacatttcacacaagcttatatgattaatattttggaattcaaaattaactcaaataaatagcgtgggacaaaccttctctaacattcttgcacacattgtaaccgttctgtttgacacatgacgaatatcttgggcatcaactgtaaaatgatccgtttagctaggcattattgtgactaaaacgttaatattttcttagttacttactttgctatgaagagctactaaatattaatatttttttagggttccctcatcgaaatgactggccctaagcgagggatcgacttttcttgtgctgttctagttgaatatgacatgagaatcaagacaggagaacgagaggaagatgatctacaactgattgatggtgcaacagatcttgaccatatattgacatcacatgtaccagtgagaaatcgcatttatggagattgcggcgcagttgacataactcaagcgaatcttttgtatgcatttgaggcgactgtagaagtcgtcatatcagaagtgcagactagttttgatttgtgtctcagctgttttaccagtgggttacatgaggaaattcggctctttgatggtgcgatcagtgagtcacgtgacttgaggaggtatgtgattgctgtcatggaacatgagtgtatggatttgaagttcaaggtaggtttagggtctgggtgtttcgctgaacattgtcgatccttcaaagcaactaatcatggatgtgccagtgaacaaataaagattgagttcgcctcaatctcggtgaaggtcacttggtcggctatggagttctagaagggtacttagcgtttggacattttttttttatttgttactccctcagttctatattgtaagactttctagcatgttcatattcatctagatagatagatagtgtgaagctagtgttgctagtgttgagtgtaggcatgtgtgtgtttcagcccaacagggcccattacaccaatgcatatgtatagtagaagagagaggaaatagtgtgaagcttctggagaaaaacaatcacctagcaacatggtatcagagggcgaccgcgtcgaggctaaaccctagctagcggcgcgccggtttgtggtgctgcagcttggagcaacggagtggtggcgttgacagcggagacggcgacagctgctacagaggatctcgacgcagccggcgtgaaggagggagcagggtgtgcgctcgctggttgagccgcgcaaggggaggacgcacggcgggtgagaggcgcactgtacgagctgcgtctagacttggctgtggtagtgttcccgaccattatgggtctagacttggctatggatacaaaagcacaagctaccgtcatctcggaaatgcatgccaactgtttagagttgagccatggagccatggtgtccatactagcaatcctgatgtcttgtcaataccaatatctaaaatggccagtgtcaaggctgctaacaacatcaccatcgaaccagtggttcagtatgttgataaagagctggacaaggcatccaatagggataaaggggccaaaggaacagaggtatggtggtggctgatcatttccaactgtggccatctctcttatcagcttannattngtgaatggtttctcaacactgcacgcagcaaaccaaatgngcncactcgccttactcaagcaggagacattggttgtcaagttgcgctgcgacgagtgctagggtcatcatccaaatgcagccaaggtgacttaatgccggtgacaccaccaaggccactgacaataggaaaattgcataactcgaggagccgttctgctggaaacacaactgaagccgtacaatcaattattgagtctcatgcaatatctttacactgtagaatttccaagtcaatgtgcattgcacttaattttgttgagagctggctacaaaacacagccaagaaattatgcaatggccagttgcttaacctttcagttgggatacattttgacgacagaaagatttctactacattgttttttgctgagttgcttgagcacccaataatatattttcaggtttacttaactgcttttcactgtgttcattcgaacaaaatcctgagaccatggattattgctagagctgctaatgagaagcagaacaggaaggtcaagagatgtggttatgattccattgttggttttgatggaaacaatcctattgatgccagtattgcagtaaaggtttccattgatgtgattggtacttggacagattcagagacgctatatgcataagttgcaaacaaggattatttgtctgttaaattacttgagctggtaagaaaggggtccaatacatactggttattagaactcataactaatgagctgaatccttggtgtttactcagatatcagagatggctagaaattctggggctcccacctttgactagggctgcgtggacaggacaagggaagatagaacaggacattagtgtggacataatttcagcatctcaagttatcaagtctctctgtctgaacaagtcatctattaggagctactcaagttattttctcctgatacatgctttggtcagtaaattgagagcttgggaagcattggtggaaaagcatgtgcatcgtatgcactccaaagataacaaaagtactccctccgtctcaaaaaagacaaaccctggtttccgtgtccaacgtttaaccattcgtcttatttagaaaaattatgaaaaaaatttaaaaagataagtcatgcataaagtattaatcatattttatcatctaacaacaataaaaatactaattataaaaaaaatttatataagacggacagtcaaacgttgacacgggaacccacggtttgccttttttttttttaaggacggagggagtattgttgatgccttgggatccaggaggtttccatcagcttggggacaagctgaattttatgggggagggaatgttaggatcctgcctccttccatgggcctgtcaggtcaaatgcatatgggcctagccaaccatccacccccgccaaagcacaagcaagcaggtagaaggtataaaaagaaacagatacttcacattggaggcatggtgggatcaattggcgagctgaggctcacgacggcgacctaggcggccggtggcacccttgtcgatctcttctctttctcctcttcttccttgagttactagcaacttgtatcccctattttcttcctttgtttcaccaaatacttgcaagtggtaacaatctggttgctaattgaattggagcaaagggtgctaacaccacgtcagcgggccccacgaccacccgaacgccgccgagaagacacacgtcagcgccagcaccgccacggagtagcgcctcgccatcgccgactcgccgtcccgcccgatctgcgaccccatgatccacgccaccgcgacctggcaggcgatcatcacgtacgaggccgctggtcaagaacagtacccggcggccgtaccggtccaccgtggcgatggagacgagggtggagccgaggttgacggcgcccatctcagcgacgcgttgtttcggtgcacgtgtgctgcaaagtcggatggtcacgcccggtagtggtgggccggttcatgcgatgtattgcgtgaatttgggatcggtttgatcgatctgctgcccggaaaagagctatttcgggaggatttttagtggttttgctacggacctgcaggttggtgaagccaatgccgaagccgagcagcatgctgtcgacgatgagcatggcgatgttgaccgcagcggcgttgacggcggcgccggcgaagaaaagcgccgcacccgcgagcatgacggcctgcctcccgaccgccctggtgacgcggccagcccggccaggtacagcgacgacgtgaacgccgtcagcacgtggctgtcgtagacgcagtactcgtcccgccgtgccgccgccatccgccggagcacccccgggatgaaggccccactccatcgccgtcactccccctgaccacatcatctccctcacagacgacggtatatataatacaagtgatgaatgtcgtttgcagccacgtgtaagtgtaacgacgtatcgattttgctatttatttgtcgacaaattttttcccaaaaatttgacagatataattacagtataatcgtagtataattacactgaaacttgcatgtaattacagtgtaacttgtatgtaactttcaaaaatctctccgtaacatgttatttcggtaaaatggaggtcgcgggaacaaattctttcacatatgtgtgtgctatgatttgttttcttcctcaccaaaacaaatcttgtaatagatctaacgatttaaaattatgtgaaacttatatataagttacatgcaagttacagtgtaattacatataagttacagtgtaattacactatgattgtactataattacatctgtcacatttttgagaaaaaatttgtcgacaaatgtataggtagtcccacgacgtatacgtaccggagatgccgatgtcgtagccgaagatgaggccgccggccggaggcggccatgaggcaggtgaccacgacggagaaggttatgccgccgcccatggggaacccacctccagccatatcgcgcaacggccggccttgtttggcacgcaatagccgcgcgctcactcgcgcactagttggttgggctggtagctagctatacgatagcaaaggccgatcgatcggggtgtctggtttttgtatatatccaaatccacggccacgtgcgggaggacttgtgttagttaattattaagcgcacggagcaatcgcgtgccaaaccatatattggaaattaactcgttcggctgctcttgctttatcaactcgttttgttttctttttcgttttgttggggcggaattattcagtcgtattcttgaagaggccctacgtacaaactaaacgtactccagattccagaagatcctcagtcctcactggcagactggcaggcacgctgctactcagattgcgatgggtttcacgggtggggtggttgttgaggatcgaatggttcaactgcaccgctgcatgcctgtggtgcagagtgccgttttgcatgccggcgcggcgtggcttcgtttagttctgaatctgagagatatgcgcgagttaatggcctaatgtgtaatgccatgtaccaaggcatacatacatacattgtacgtgtttgtgtctgtcagccaaaagttggctgatgacagacgcccatctagctcttgtcagggggcttggttttgctctcccttgatcagcctgtcatcacaccggcgggctgacgcatcacgcacgtaacaatttattgcactatctcgcggttagccgaaacaccacagcggtacaggcttgccacgacagctaccacagtttgttgtgcgtgaaggctgatgttcagtaaaaaaagttggtccgtcttgtactcttgtatcatgtatatgggcatgttgaattgtgtgtgatgtatcactgtaccttgcacagtgcgcaccaacctcccgagaagaaggggagtgccggaacaaagctgaaagagaaagcatggtaggaggaatgtcatagtgggccatcagaaaagcgtg

SEQ ID NO: 60873 - DNA, 2005 bp, Oryza sativa
acgttagggggcaatgaattgttgacaggcacgcacgcatcattgcgaacttccctgtgcgaagctgtgagagagtccatgaaagccatgagtgtgtgacgctgtgtaccatgaggccatgaatttgccttgaatagtggctgggtaatagcagggcagcagtagccaattcatctcaacgtagagtaccagttgaattaattcaactttttttttcttatgaataaaccttcagtcatcagtactagtacaatcttagagcatcctaagtttgccgttgttcgtgcattgtaacagtaataattaatggctatgtaagaccagaaatacaacgctctttcagatttatcctaggacgccgtacaaaacctaagaaaataccagtactatgtactgatagtgctttcattttcttgtttgagattagtagtagtgctagtgctagtacaagtcgtatacagtttgcaacattttagtgcttgtgtatacggaagagggtggcgaggagtgatgcgtgagacttgacgagaaaagggttctgaattctgaaactgaaagaactggaactgaaaagcttggccacacttggttaaagttgcatacatcacatgatgaaagaagccaaagactgggcatcttaaaagcgtgtatgacgaactggcaaagtggcactcgcttcttttctttcggcttactgttcacaggcgctgttccagtctttgtttttagctcgatgatttaatgacaatgtcggtctactcatcttggatgcaatcacgtaattagttctcagcaaccattgatagaattcctaccttgtggtgagtaaccaaccaagtatcatccatttattagtggtctcagtttaatagaaaccggataaatattggtagtactgtcacacagtcaccaactcaccaaccaaacgaaatggaaatatctctatactagtactaaggcaatagcattatagcattaacaaaagaagtctaccattgttcgcaccaaaaaagaagtccatttcatgactccaggacaggcgtacagcactagatcgtgtgaagctaggaagcaagaggacaaccacccatgtcgcactttactcttctacagaattacaggaacatgtcgaccagcggacaccataaattatagcatacaccaggctcctagatatacggatagatttccaccagacattcatctagacatttgcttgaccggcatgtacatgtcgaacacatttaaaaggtcaatgtaattacagcttacgaagttacaagccaatgagaaattcgttctttaccaggcaggtaccatacagaaatcttatggaacccaccagcttgccctgtacaagtcatgtgttacagtgttaggacgcagttgctctggccagtgtttatgaacagcacattgaaatgttaccaacgatcccatttgaagccacgaatatattcatcatgatggcgcattggcacttcaaccattcattcccacccaatattggatggaacaaaaccaaaagatacctcctggtttgttggagaggattttgaagttcctactttctgtttttagttcatgaaatcagggtctgttattgcctcctgtaattgtttcgacttttatatctgtctgttcattctctttctccataatcgtgctggaagtatcgttgcctggcaaatcctctttatcatctaatatcctgcttgcctccccgattgcaaggattagttcaagttgcttctgttgttgttcctgcagaatagattaatgggttccattggtcaaaggcaaaaattgcataaggctaagctccataaggaaacgattatttactggggtgtattggctagtcattagtatttcggagggcaacatcagctatgaaaaacaagtgagtcaccttgaaaagacaacaaaaacattgatgtaataattaaccaaatcatgatgttaagctctagtcggtacatgatggttactaaatttgtggtga

SEQ ID NO: 60874 - DNA, 623 bp, Oryza sativa
ttaaatttaaaaactttaaaatttggtttttctttggcttattaggccatccgatgggagcctaatttcctctagccccactgcggtgttttcatttcttgtcaggtaaaacagcaccagtacaaagtttaatttcctctagccccactgcggtgttttcattttcttgtcaggtaaaacagcatcagtacaagtttaatttcctcgagccccactgcggcacgatcattccttgcacgaacacgtatgatccaccaagtccgcgatccgttgaaaacttgaaacggcctcacgggcagtgtcaacaagagcgaacgtaccaggttttggtaaatgattcttcttcttctcatattcagttctggtgcgcatatcctgtacaaatccgggaatcgcgtactctcacaatttattttctactaataataagaaactccagtatacccgctgaacttcacgatccgttcaatctaccgagatcagtgtaaggtggtgtttggatcaagtgactcttatatcggatgaatttgaagtattaaacatagactacttaggctgcgttcgccaccgtgagattgggagatagtttgttccgttttccgcgcgcacgcttcccaaactat

SEQ ID NO: 60875 - DNA, 2862 bp, Oryza sativa
cctgcacccctgcagtctgcaaaaacagaacactgtaaacttatatcaaaagtgcaaggcttaatattcacttgcagaaaaaacattaaggttcctgaagttgtgaatggaggatgcattcaggatggcagtatggacgatatgttgtgattgtaggaagaactacagcatgaatgcaatgatatactggcactttaggaggagtagtataggttggccttgtcttccaaagttccgatgcccattgcactatgatttgcagcttttaaaaaggtagggtgctttgtttcctccgaaatttatgtggaagttgaatggggtccgttctctgaaattcatgtctttgcttgaatggtgctcaaaaagagcgtactgactaaagataatgagattggaagaggtctaaaagaagagaaatgacagttttttaggattgatgagagtagttatcacctgtttttcagttgacaagcttactagatagttctgaaatgcaacaatgcaaacatttgttttcagtaataaagacaatgagattgggagaggtccaaaagaagagaaatgacagttttttaggattgataagagtagttatcacctgtttttcagttgacaagcttactagatatttctgaaatgcaactatgcaagcatttgttttcagtaataaaccttttagttctcctaggctgtttagatagctggttaagatgacttaggggaaagatgacaacccttttaggtgcacttgcttctggacaatttagtaggcacaaaaagctgcatgtttcagatataaaatgtatcattttatcattaattagttgaatttctagatagtaccacagatgctggagtatgatagaatctctagtgctgaggaccaagcttgtcgagcaagtggtatctgaagtttcagatgtgtgttggagtagcaactcaaagttccaaggattcagggctgacaagagtacaatactgtttttctgttactgtggaggactactgagcagttttagctggctgtgttttaattgtcctcctaatgttatgtcttgatccatgcagcagttgtttgctggatcaagacttggtatcctactgtttatttcgttatgctaaagatttctcaagtatataacttttgacggttcagattctaataagagatatcagaagagagtttcctttctgggctaaataaaactgtgtgttgaaatgtcagatttggagctcttacaaaagagttaagtgatatccagtcaatgatcaagaacatggatgaatttcaaacattgggcaaagtaactgtccatagccacaccaagattttcatgaccgattggaacgcactcgtagaaatttcatgtcactgacacgttaccaagtcccctttctaacaccatttttgacagttcaattctaactggttgtttctttaaacgaattctaattggttgctactaaaccaacagtgaagcaaagcttaaattcttaaatttctctaagtaggacgaggtaggtatcctggaagattaagcaatactcacctcattgataggatccctcagcgtcctccgcaacaccctaaacctgacgccgagcttctcgacggtcctcgacagcacaccgacggccgccaccacgcccctcacgctctcctccacctcgccaatcctccccgcgaaatccacacccctagccgcggcgccaccgccgccgtcgacacccacctggcaaagccgcccccactgcctccggcggatcaggcttccgatcgccaccgcgcccaccataagcacgtactgcacgacgaacatcctcccgcccacgagccccgacgcgggggcgcccgtcgtcgtcggcggcgggaagacaggcgggccgcgcataccaccgagcagatggcgggcggcgcgaggcagagcagctccgcggcggagaggagcgcgtcgagcgccgagctcgtcggcgcggcggcggcggaagcgcccccgcgacctgcgaaatgtgcaaaacgaactgtctcagctcgaatcaagaaggtcgtgggggggagcagaccgcggccgcggcgagcagccaccagcgcatgcgtttaccggaggcggaggcgcggagaggcggaggccatctgcgagagggagctcgcgagaggagaggcgatggcgagggcgagggcgagggagggaggcggcaatggaggcggaggtgcgcgcgggagcggagcggcgcgaggggagcggggggcggcatgagcgaggaaaggtgaggtgaggtgaggacgaacaaggtgagcagcgcgcggatgcgattggaagggagccacacccagacacgggccgttcttgttacctgggctcccggcccaccgccccggtagttgtccatgagggtaaaagaccgcgatagcaaggataacagtagactataagtcaactataaacttatataaaagaaaaattaaaaaataagtgagaagggttgactctcatgtaagagctaaaacattttcattattaattttatagtgagagaaagagagatgggagaaaaaaataatgccatccttatagttaacctattatacatgttatttataataaggattaatagccaatagtcacctatactattaaacttgctatgaacaaaaagaggctttttttaactagggatgaagacataatgaacctttccaaaatttaactgtgctaaaactttactccctctattgccaaaatataaagcacaaccacctttgacccaaagactaagaaacaattattatcacctcattgtttgaatcatcttaactaatacaatacattcacccaataaaattaaacacctccatttaaa

SEQ ID NO: 60876 - DNA, 4086 bp, Oryza sativa
  unsure (1)..(4086): unsure at all n locations
gtacttgttccggcgggccggcggcattcggcggaacacccccgggaaaaaaggccgccagaaccaattccttggccgtacttccccttgaccttcaatattaaccaagaccagactgggttaaaaaaatggatgcgtttttttgcagcgcgtgcaattgtaacggccggcgtacttccttcccgaaaatgccaatgtcgtacccaaagataaggccgccggaggcggccatgaggcaggtgacgacgacggaaaaggttatgccgccgccatagtcgcccggcgggcgccgccggccacggggaacccacctccagccatcgctcaacggcacgccgtggcacgcaatagccgcgcgctcactcgcgcagttgttggtgttggttggactggtagctagctactacaatagcaaaggccgatcgatcatggtgtccggtgtttgtatatccacggccacgtacgggaggacttgtgttaggtaagcgcgcggagcaatcgcgtattcgcgtgccaaactatattggaaattaactcgttcggctgctcttgctttatcaactcgtttcgttttcttttcgtttttgttggggcggaattattcagtcgtattcttgaagaggccctacgtacaaagtacaaactaaacgtactcgagaagatcctcactggcaggcgcgctgctactattgcgatgtgtttcatgggttggtagctatgttgttgtggatatcgaatggctcaactgcaccgctgcaggcctgtggcttcgtttagttctgaatctgagttaatggcctaatgtgtgatatcatatgtaccaaggcatacatacatacattgtgtttgtggttggctgatagccagactcccatctagctttcgtcagaaggcttggtttgctctcccccttcagcctgtcatcacagcggcggcctgacgcacgtaaacaatttgttgcactatctcgcggttagccgaaacaccacggccctcaggctcgccacgacagctaccacagtttgagtagtttgttgttgtgagtgaaggctgagatttttcacgtcaacttggtccgtcttgtactcctgtgtgggcatgttgagttgtgtgcgatgtccaccaactaccatgaacgcctgcacagtgcgcacaaacctcccgagaagaaggggagtaacgaaaacaactcgccggaacaaagctgaaagagaatgcatggtaggaggaatgtcatagtgggccatcagaaaatcgtgcatatgggctagtttcgctggacctacaaagaaagaagacgcaccaaccaacgggtttggcaaccggaataaggttatttcaaatcccttaactttaccaacgaannnncaggtggtctttgaccacaaaacttgaatcaacgggtctctcatatgttaaaaccggtacaatataagtcccaagatagtatggcaagaggttttattctacgtggtaatttgacccaagtcaacaacactgagtcagcgtaggctccacatgtccgtggctcttcatctctctctctctctctccaatctcaacggattgttggaggacggcgcccgtcgatttagagtgcgaagcaggaggcctagccgaacatatcggtgaagggctacgacatcatcaatgggatcaagacggagctatagaagatgtgcccagaggtggtgtcgtgcacggatatcgaggcgctcagcacgcgagacaccgtgcacctcgctggggtgcccaattacaccatgcgcctgtgcgcaccaatcgccgtctccaaccacgaggatgacgacggcctccctgggcggacatcgttgtgggccatggaggaaaggatggcggctgatgaggcgaagacggctgctacagtgtcacgccccggactagtaccgaccggaactagcccgtgacgctccaaattaacctgttaatcgataccagtcccaggaaatagtgctggtatcacaggaagacggattatcacagcaacagaggtctctttattatagagtagaggtacagtcatgttgggctacggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacggaagtactcagcaagccatgggaaataagtgtttaatgcaggcttcaaggaaaggctgttgtttttgcaattgattttatttgaactcttttctgaaaacaactaagtgagtgcttctcaaacgacacggttgagacagtgcatctcgtccggtcggagtatgtgcaatgtatcagtctttttgaattgattcaaggttggcacccggccaacaactttcaaacggccacccgggcctacaatttcaaacggccacccgggctagctgatcccgtcagctgcagattttccaaacatcgaacccctttccacaacagcaatttcacaagcagtagtcaaacaaaactacgctaggaatcacctcacatccgctcatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtatacccggtacgttccccggtccgcggttctggaaaatccatttagttcgcaagcaccgacccaggtgtcgggttttccaagtcttttgtaaaacccaagttttacccaagttgtttttcagattttaagtttgaaggcgaccgtcgatactcgtgcagagtgcacgatctccgaggcgcaactgggtggttacaagggaacatggtataacaattatcaagggaaggatcaaatgcaacaaactaggtaggtctgccaatctgccttgcagacgggacaaacagattaagtgcgatcctatcaatgcataatatttttcaggcaacataattaaattcaaatataggctcaagatgttcaaaggtggcttgccttgctcgagatcttgagcttgatcctcgaaatcctcgcactgcgggttttcgggctccgaaactacacgcgaaacaggacaactcaacaaactgcaaaaataaagccctattaaagacctctaagcgtgccattagatagatctcgagatttgaggaattttggaagttgaacggagtcaaacggatttacggttgggaagatattgaatttctaagattattggattttaggtctaaaggaaaaaggatttaattaaatcctttttgaaaaagaaaagaaaagaaaagaaaagagggagggaaaatagacttttcctcgggcggctagggcgcggcccgagagaaatggagcgttccggccgagctaaatgggccggccggcccaaggcgcgcgcgcgcggtaggggaggagagagagagccggtggaccgggctcaccacgcgtggtcccgggtgggacccgcttgtcggtgacacggttcaccgtgcggagcgagcacgcggcgcatgcgcgcgggcgggggagggacgcggtgcacgcgcgtggttcgcggaggaacggatgcggcgggcccacgcgcagcctcatggctcgcggtggaacgcgcgcacgggaggggctgaccggggtcggcccgacccgatctcggccgagctggc

SEQ ID NO: 60877 - DNA, 3633 bp, Oryza sativa
atggagggagtaataaggtgacagcattgtcaagttttaatatgaaaggataaatgtgatgttaccaaaatttcttagatattatcaatgtttggtacttcctctatttcatttcctctatttcatattataagttgttttaatttttttttctaatcaaatatttttaaatttgactaagtttacagaaaaatttaataacactttgacggagcgtggggctcctcaccgggagaccgcgcaggcccccctttgccggttcggccgggggccctgggtgagattctaagctcctagtctatgtgtggaaggttcgcgagaatggaaacacacaagacacgggcgatgtatacaggttcgggccgctgagaagcataataccctactcctgtgttttggtggatctatgtatgaagaagctacaaaagagctggagaaccagagagctcttactctctccctctctgatcgttctggatccgaaaaaatctcctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccgcaatctgaccggtctgtgaccagtcacagaccggataaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggttccatgtcaccgacacacttacaacatcaaattagtttcattaatagcaaaattgaatatatctggttagaatgttttatgttcaaaatatcactatatttttctaaaatttggtcaaaactaaaaaaagttttactaggaaaaaggtaaaaacaacttataatataaaacagaggtagtaacaaactaaatacatccatatcttcgtcaatttcaccaaacaatggcatagtttaaaataacaccaatctgaacaaacctgaaattgtatcatttatacggaaacaatttttggatggtttggtatttttatactttccaatttaactatttggtggagattgcattactgcactgaaagaaattagaattatcaaaatttcatgtggttagacttaggatcggaaactatcactttttatagttcagttgggtgcccgttgtaatccctatttgtagcgttagaattttgcaagattttcgcagggattagtttaattcctgtaaagtttgtctaaaattgatccattgcaaacaaggcctagagctgttttcactcaagaagagtagcagagctgaggtacaaggccactttggaatggagaaattttgtgagaattgaatttcttttttttaaaaaagatgtacgaaacttctgctctcaagcgcttggaagttggaacattaattacacaaattactgtactgtaccctacaaaacagacatgaacactacgatgtagtacttcaggattcataagcatgtgggagttcttatctaaactgacatcctatgtgaaaagaacgggttgtcaacagggtttcctaaaccgtcggggccggggttaccgcgccctggcggtaagcacggttaccgcgcgataagcgcggtaaccgtgaaaaaccgtacgaaaccgtacaaaatttatctaaaattcaaattatttttaaaatttatttaaatttaaggaggttaccgcggtttttctattaccgtaccccgcggtaaggccggtaaacacggtaaccgcgcggttaccgacggtaagtcaaaccctggttgtcaaaaggaagtgaactacttattggaggatttgcagaaacagatagagcacgttggcaaatactactctaccccagcaactgtccaagtgaaactttcatgtgcagagtaaaagaggtcgagcatgcttactctgtcagacaggaagatcctgccttcctgaggattgaagacaacaaaaaacctagagaaggcgcctaccgaaagacacaagatctgtcagaatcgaagttaaaaacaacaggaatcacataatacaagacagagagcatacaatagaagtaaataaatgcaataccagaaaaagactaaaaatgatagtggtttgatctcggccacacatctataaccaaaattattttgtgattccatggcctttcgagtacttatcatcaaagcacattccttgacccagactcttggcctcttgtgtttgctagtatatcattagtaagaatatgtcagacttcaggtcatttataaagatgttgatcacgtgacattttttttctagcctcaaggagtcttccatttatgaacaatttcgcctcaaggagagtcttccatttggattttggacatgacgaccaaagttgtcagttgtcacactagaacctcacatggcaatccaacatagaactgatagtcaacaggatggcatttattggaagttccataattttggctgtatttagattcaaacttccaactttttccatcacatcaacatgtcatacacacacaacttttcagttatatcgtaccaatttcaaccaaacttcctactctggaaggaactaaacacagcctttatcagaacatcactgctaatcaaccaagtcactatcacttaccccctgcaatactcatgccaaacatgtagtaactcccttctcaactctcacctgtcaccagttctcatcacagtgctatatataatagtactagtaaaagcaaaacatttgtacactagaagcaaaaacatggagaaaactgtgaaacacaagcacaagtgagatgtaaccaaattagcaaactaaatcagtactcctcaccatgcaaacacatcacctggacagagtgcataggcatcacagatattttttttgtcaactttgtaaggcaaattagcacatatactaacgataagtacagcctgataaatacatcctgctactgaatgcatcctgaacatactaggagacaccccctcactcaccatcacaccaccaaattaagctaagcagctgcaagtccgcaacaatcagctgcaacaatggg

SEQ ID NO: 60878 - DNA, 518 bp, Oryza sativa
agacgtgacatagtttccaacccatcctagccatagacaagagtaccgacccaaccccacctacggccggaaccccggggacaggtaggcaggattgagcccctagcagcaggacactggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccgatccttatatggccgaggtgctactatcaaaaccatgcaccccaagcccagcctaaaaccattttgagggttttgaatagagggggaggggtgaatccaattccacaataatccatccattccatagtgtccaggtgatatgaatattcccaaagtctagagttgtaaaccacctaatgttgcctaattaaccagcgaagc

SEQ ID NO: 60879 - DNA, 1823 bp, Oryza sativa
tcatctggactcacctagagtatggatcatctcccctgtccatgcatgcatgcatgctgcaagaaaatgcatatacaaacattcagaaaattatatttgatattgatattcatttgcctcccatctccctctccaacagtgccatctctgatcacacccacactgtgaagtgaagtcagtcatctccaagagaagcaaaagcaaatgcaaagccttcacctctcacctcacatccattgctgcatggaccatggcaccaatgcaccatgcacatctccagcatctccatctccatgagtccatgtgcattcaagcttagcagcagcagcagcagcagctgtatgtgtgggtgtggccatggtgctttctttgcattgcattgcattgcaatgcatgcactgtttgctgcagctgctgcagctgcagtgactagtctagctctctccatctctttctttctctgcttctttgtttctttctctgtctataaatacagaggcctctcctttccacccagcccttttcctctcctcctcccgtcttttccaccaccaccaccctcgcgtgccctaatttctcgtgctccttgtcccccacctcctttacttgagcttgctcaccactgcctccatatacagagagtcttctctgtatttctctctctcagtgggaggctcacaagaatctttcagctcacatctcactgtccttgcctttctctagctaggtactactactgctagtactaaccactgctcgtgttcttgggacttcttcttcttcttgttcttgttcttaaaatcatttggggttttgagctccagggaggtccaagaacagagcagcaggatggtgcagtggcgtttctgtaagtgaatcctactaccttcagtttcttgagcagtttcagtagtgtagagcttatgatgtaatgcagcaggtgccatgtgtgttgtgctctgaagaaagctgttctgtgggttgctttgttactatgttttttgtgttcatgtttcttggtctgtatggctctacatgttgggtgtttttggtcagattttgtctctcctatatctgctagtctgtttttctgcaatagatctttctgttagatttcttgtcttgtagggaagttggtagaggatgtgctctcagggtaaggattgattgtcagtttgcttagttctttcttttgattcaccagttgggatttagttagtatggatagataatctgctaggttggggttaaatgttgcctctgatatggtgagtgaaactacttttgtggattttgtatggattgtggttagtgggtgaaatttgtgttcttgattgaaacatctacctagttcttgaatcttcaatggcagcattattgtactgattgttgtatggtccaataatgtatttagggggattctacttactgctagtctgctcccagatatgaagatttgattctgttttttttcctcttcaaatgtttcttttttataattagttgaaatatgctattatccagagtacttttgggggtttatggattgtttcctcctactcaagagaggtaaacaaagtaacttcttcagtacagattttccagagatgccatttcttcttcatcattcctcctttgattacttcatgattgtttttacctgcttctcagcccatatcccttggaacattcacttccatgaaaattaccacctaaggaaaaaaaaacaaaatggtcagtaattgagaacttgctatattagttacctgaaagatagtaacacccagcaacacagatccatgtttcagtatacttgtggtata

SEQ ID NO: 60880 - DNA, 6578 bp, Oryza sativa
aatttcgcaatttaggttttttttaagagataattttcccgctaggcgccacgacgaacgggcgctacatacagccaccgaggggggaagccaaccaggacgccaccaccaacgatgcacccaacaacatgccacttatattgttcgatgaaaaccaagcggcagctagtggcgccgctggcaatgaggcggcggcggaggtgaccaaaacgtccaagaagaagaaggccagcggcgccgagcgagtgaccgcaaaagtacttgccggcaaggcggcgcgacaaagaaggcgaggggctgagggtgatgggcgaacaatcattcagcatggccggcgccggcgccggcagcgagcaggcaacaaagtcgatggtgatgaagagccaatgctttagcatggcgggccagccgtaacattagacgaagaagatgatgatgatgctgttgtgaggaggacagtgtcaggctgaggagaagacccctcctcgcatctccaggtcggcgtactctgcccttttccccgctagccactactcgtcgtgctgcccttccggccgccgctgcatggatctaaccgccaggtcgccgcattggggaggaggagatagggagactggggaggaggagaaggaggagacgtagcgtcccactgtaaatagtttatttttaatataacagtcacttatatgtgggttctaggtttttcttttgactttaattgctacgtcaacgccaagtaagccaaaaccatcatccaaaccgtcttgggtgaaaagaaactaatctaggttaacgtcgttgatacgacgatccgtgttaattagcgcactcaaacgtgcggcagtaatatatatagctgtgcgcacaggtagaggaaaaccgaatccctatttgcatgtaacaacaacaaccttatctctatctagttcggttttcctcttatcctgtttacacgtgattacattatctctaacactccccctcaatctaaactagtgatgttgagattgctcttgaagtcttcaaacggtcgcacagccaaagctttagtgaaaccatctgctacttgatccttggaagaaatatattctatctcaagtaatcttctagatacacgttctcgaacaaaatgataatcaacttctatatgtttagtacgagcatgaaaaacaggattagctgataaatacttagctcctatgttgtcacaccacattttcgcagccttaggagcatttattgcaatctcacataggagagtatgtaaccacataatctctgctgttgcatcagctagtgccttgtattctgcttcagtacttgacctggatactgcggcttgctttctagcactccatgacacaaggttagagcctagaaaaacagcaaatccaccagttgaacgtctgtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatacgtaaataaattttagtggaattttcagagcacaaacaataattattaagaaataaacaaagttaaaatgattttataaaaagaaaagctctaaaaagtcttttttcccccctccccctcttgggccggttcggcccatctctctccctctctctcctcttccccgcggcccattcggtctcctccccgcgcgcgcgccgctgacgagcgggcccgcccgcctccctcgctgacgggtggggcccacccgtcatccccttcctcccgccgctcccgctgcctcgcccgcgccctagcgccgccgccgccgcgaatcccgccgcccccgtccgccccgcgtgcaatcaataggggggaattattccccgggatcccctccccctttccccccatttttccctctctctctccctcggattcgtttgtaaactcctcccctaacctcgccggcgccattaatggcggccgggactcccgcgcccgtttccccctcctgcggccaccccctttcactcccaaccctatataaaccctcaccgtgcctccctccaccgtttccgccactcgccgccctctctcctcgccggaatcgagctcgcgccgtcgctctctctctccgccgcgcccgccgagctccggctgccggcgtcgtcgccccggaccacccgcccccttggcgccgcctacttcggcttcgccgcatcctcgccgacctcgtccacccctccgttccgctcgccgaccgccggaagcaccgccgaccccgtccacccgagccggcccgccgcttcctccgctcaggtcgccgtttccgtcgtcgcccgcgacccggggtgagccgtggaccgccggttcgattccccccttccctccccttggcacgaccggaaataacccaacggtcattccttacgtgcgtgcattaatccttgtgccaggaggcaaggtacaccaaaaggtgatacaattcagaggttaacaagcggaagcggaaaaagataattattacatgggcagcgaaggcccagcacacacaaagacaaacgagaaacagcggaagactagggcgacgaccacaggcgcttgacggcaggcacgagctagacaccaaagccttcatcttcaaggaactcctcttctggggttgggaaaaattgagcaagactgagtacaaccaccgtacttaacaagacacacccgcaactgcagaataaatgcaagggagtacaagggaattatactataaagggttagggttgcagtaaacagcatttaaagacatttagttgctcaaagctattttgtaaacacgattctagaactatacactattattcatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacctcttcctcacgtgtaaccacgtgccacataccaccacggtatacagacggaagacgtgacatagtttccaacccatcctagctatagacaagagtaccgacccaatcccacctacggccggaacccccgagacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacagtagtgctttgcaacagaggcccgaagaccggtccttatatggccgaggtgctaccatcaaaaccatgcaccccgagcccagcctaaaaccattttaggggattttgaatagagggggcgatgtgaatccaattccacaatactccaacaattccacagtgtccaggtgatatgaatattcccaaagtctagagttgtaaaaccgcctaatgttacctaattaaaagcgaagcatctacctaaaatcattctagtggtaccatgagtagagtgtccactagttggggttttgtttattctagggtgaacaaggaaataataacaaaaacaataataataaggtcataacaaaggtaaataggcatggctaaataaaacagtgataacgcgggaatttaaataaagcggatatgcaataatttaaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttatgggaaaattagagacttgaacggtccaattccgagttcaaatggccaagttatggccatttgaagtttatatgctctttaaatggatatttgcgaatttcttcatttaaattttaattaaaaaacatatttattgcgtcagccgggggagagggcgcgcggaccgggtccacgggagtggggcccacgcggcagcctcacggtccacggtggaccgggtgcacgcggctgacgctggccggcgccgtgggtcccacgcgtcagccgcccccgaggcgtgggcggctgacggccgggccccacctggcagccgcgaggcgcgcccgaaggcggcctcgccggcacggccgacgggaggcggcgcacccgcgccccgatggtcgacgccggcgaccaccggcgcgcggagcggcgcccgagagagaggagagaagggggaagtgaaacggcggtcctcggctcaccccgggtcgacggtgacaacggaaacggcggccgaagcggaggaaggcggcggcgcggctcgggtcgacgaggacagcggcgttccggcggtcggcgggcgaaacggaggagtggacgaggtcgacgagaacacggcgaagccgaagtaggcgatgccgaagcgggaggaggtccggggcgacgacggcggcggaccggagctcggcggcgacggcggagagagagaacgacggcgcgggctcgaatccgacggggagagaaagcggcgagtggcggaaacggatgatgggaggacggggagcgtttaaatagggttgggagtgagaaagggcggcccgaagggaaggaaatcggcgcggcgatctcgggctccattgatgcgccgtcgaagttcgcgggggtaaatccgaacgaatccgagggagagagagagggaaaagtggggggaaagagggagggaatcacggggagtgatttccccctctttatggcgcgcggggacggcgggatgcggcagaatcggcggcggcggcggcgctagggcacgggcgggcggcgggagcggcggaaggtaggggatgacgggtgggccccacccgtcagcgagggtggcgggcgggcccgcccgtcagcggcgcgcgcgcaggggaaggccgatgggccgcgggggagaggagagagagggagggagctgggccgagccggcccaagaagggaagggggggggaaagaagacttttagggattttctttttataagacccttttaactttgtttatttcttcttaattattatttgtgctctgaaaattccactaaaatttatttacgcattttaggcttttaggaaatatacaaaaatcctccaagccttatttgacttttaaatttgcacattttaattgttggaggctttcacatggattttaattattctcggcataattttgaggatgtattttagagtcgttttgggacgcgacaaacctaccccccttaaacggaatctcgaccccgagattcggaagaactggcgaagagatcgggataggctgccttcagctcgtcttcacgctcccaagtagcttcttcctcggcgtggttgctccattggaccttgcaaaaacggattacccggttcctggtcctgcgctccatggtatccaggattttcactggcctctccacgtaggtcaagtcttcgcgaacttcaatttgctctgagtcggcctgctcggatggcactcgaagacatttcttgagttgcgacacatcgaacacatcatgcacgttgcccaaggaggcgggcagatccaactggtaagcgacttctccgcgccgagcaatgataacctgtgtacacctcgcaatggcgtgacccgaaggtacacaaaatcgtccactgcgaattccaagttacggcgacggttatctgcataacttttctgccgggactgtgccacctttagattatcccgaatggttcttaccttcgcttcagcttctctcagtatatcagtcccgaacacttggttttccccaactaggtcccacaggagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtatccatctcttcttggagcttcttccaaaagtgagaggtgaattggcttcccctatcagatacgattttcttaggaacgccatggagacttacgatcctagcgaagtagagttcggctagtttgttccctccataggtggtcttcacaggaatgaatcgagctaccttggttaatcgatccacaactacccatatgga

SEQ ID NO: 60881 - DNA, 3759 bp, Oryza sativa
ggtggtggcgcgggtcacgtgtaggagagcgcgcgtggtggcgggcgtggtggatgggagaggcggcggcgcccgttccgcccggccgcgtggtcccgtgcgccgctgcgggtttgcgccgccaaagggggcgtgggagtccgcggctggagtggatgaccgggggagccgggctccgggaggggggagggggccacctgtaagggcgtggtgagccggcgggaggggccgaggggggaggagagctcgcgacttggcgagtcgcgtcgcgggaaggcgtttcgatcggcacgctgtggctggctgtgggcgaagtcgcgaggttggtacgatgggccgatggccaaccggagtgccgaaccacacgtcaccaccacgatgatgatgagtttgagaaaacggacataacggggtttggctgtaatgccactcagagcaagtttaatagaatagccaactactagctctaatttatctataaacaatctaatagctcatctatacaatagttatatactacactattaatatctggtcccacctgtcatacacacactgcgtcttggaatccgtgctacagctggctataaatctgtagcccgctgctcttctctctccttatttatctccttaaaatatgtttacagctggcttatagcctgctattgtacctgctctcacaaaagtggttttgttaaaatatcaccctcaaatagaggcaacatgtttttttttacttgaagtgaggtaacatgttgtaatgccatttcatccatttcttctcagtttaatgatttttttaatgtttttttcttgctgagatgaccaaaatacccttggatcctatctcatctctccctctatttcttcctcttctttgttgtagatggtgggtggcgctggcgtggctggggacggcggcggcgccgacacggttggggtaggtgggcgtggtcgccctggcgctgctgttgtgacgaacttggcggtgagccccctcatgcctcatctcagccaggaactggggcgagctcggggcagtgtgaagatggtgttgtggctggagacgagttgttggacaagtcaatggtggtgagcgagatgaggtcgccgataaggtggggaagttctcctacgtcgacgcagatggcaccgccgcccctagccataggggcggagctagtgtatattagggggtgcccagaaacatggtcaagaaaattttttagctatacctcatatgtattcaccatgtaagcaccccctcaatacaaacttaggcacccacattagtttaaactcgatctaaagtagagtaaattaagcaaatgacaccaccctccatttcgctctagctccgcctctgcctagccacgccgccaagccgagcagccttcctcacccacgccaacgccgtccccgtccccgtccccatccccagtcgtgccgtcgagtcgggccggccggcgccacccaccatctgcaatggagaggaggaagagatagagggagagatgaataggatccaagggtattttggtcatctcaacaagaaaaaacattacaaaaattattaaactgagaagaaatggatctaatggcattgcaacatgttgcccctgtttgagggtggcattttaacgaaaacactttcgggagtgacattccgtgaaacctcattttgacaatggcaaaatgtcaattttctccttccatttcaatgaaaaatgaaaagctactcaataaattgcacaacatagaatattactcctttatattatctacatgttaaaaatattattttagtgggttttcatacaaaaatccctgactaacatgcagagtgagagagacggggggggggggggacagagagcggtgggtgcgagagcgagcggcaacgaacaacgtgtgggcgggtggtggcaagcaacacatgggtaggcggcgctagaggccgtgccctcgccgctcctccaagaagtcaaagagtgtagtcctccctatcccaagagcgcatgttgtcgcatcctcatattccctccaccctatcgttcctccttccaccaccgcctctagccctcgccctccaacgtggggggcactagaggcgatgtgcaatgagcgtgcgagctgtgtgcgacaagcgtgcgggacgggcaacgctggagactgtgccctcgccgctcctttgaggagccaaagagggcggtccacgtccccaccatcccgtaattcgccttgtcctccttcctccaccccatcatcccattatcaccgatggccaaccgtccagcgacatgcgcctactgcctccctctccctctcctcgcatgccaacctagggtttttttggcccgaaaaccctccaaagtggcattttaaccggtagacaatgtaactcgcccagcgccgtcatcaccttccttgcacacaggtccatcctagcgactatcgtcttgccgtcgtcaccgagccctccttgcgcacagattcattgtcgctggcttctcccctctcttcgccaccgctgtcgtcgccgccgtagtcttcattgtccctcgctgtcaccgtcgacacgcgcgcacggatctgccgtctcgtgcacgagcgcgcctcgcgcatgcacggatttgccgtcggcggcttctcacctctcgtcgccaccgcagctacatcgcgtgcacacagttctgtcgccgtcatcgacgtcgccaagagggcaacttggcgatggttgcgggagaaagaggaggaagaagtagaggttaatatgtaggtcccaacggcatatacttaaaatagagtgtgtagatggagagactgttggaacgaggaacatgtttggctctccaaatcagttggagaggtgactatgggtatttggagagtctaatttggccattctattggagatgctctaacaagtgaaagtaaaacaaagagtgaaatacatggccggtccttaaacttgtggtgtggtgtcacttagatccatgaacttgaaaattgcacgtttagatccgtgaacttggtttgatataccaccaccggtccaatcctcctttaaccacgtttgaccgccaacatggcattacaacatggcaatgccacgtaggcaacatttttgtgctcaacccctccacatataccttgcacataacttgcccttaccagtgtatttcaacccaaatcccctaaaatatccctaaatcggcaagggtttcaacggtgaggttagcggaagaagaccgagaggtagcggctgtgacagcctcagcggtgaaattagcggaaggaggcagtgtagtgcaacggggttaacggtggcacagtgcggccggattagcgacgggaggcagcgcaatgcgtcttgcacgccaggcatccccatggattccccaagctcttccccgtcttgaagtcgccggaagaagatgttgttgatcaagtgcccgttgcataaggataaggttattttggagcagggagcaaaggcaattgctaatcgggaccgcgttttctatacatacaaggagaagaatgagagggaagaatgatttgatgattgttttttttgggggattctggtgtcaccatatagctacaagaagatatatgcgtcatgttgtgatgtggaatgagctaagagcaaaaatgttgcctacgtggcatgccacattggcagtcaaacgcagtccaaggacgtttggaccgggtactacattaaaccaagttcacgggcctacacgtgcaagg

SEQ ID NO: 60882 - DNA, 972 bp, Oryza sativa
atatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagcgaattttccaggatttaacggcgttgtgcttttagtggtaggcgacgtacccgtcgacagcgagacgcctacggtgacttcatcaatctctccaggatttgccggcccagtcttcgaagatgctcataggagtagggtttgcgtgcgtgcgttcataggggtgagtgcgcgtgcgttgtgagtgtctgtgttgtactgtgtaattctcaaaaaaaaaaaatcctattcacatacaagagaaaatcgttgcgtacaattcatctggttaaaaaaaaatcctattcacatacaagagaaaatcgttgcgtacaattcatccgggaaaaaaaaaatcctattcacatacaagagaaaatcgttgcgtacaattcatccgggaaaaaaaggcaaaagctatacgtatgtacgaacgaaataaaaaccaaagatattgataactatgattgaaaaaaaatcactgccaagattaattataaaagcaccagcccaaacgatcagccaagataatcaccatcagctcacggcacaagcacgtatatgcattatctgctcttcttatttttaggttgttgagatatctacagcataataaaatctaaa

SEQ ID NO: 60883 - DNA, 666 bp, Oryza sativa
aaaatagaccattgcatactacaagaatagcatacacatgttgcaaacataaatgagacttcagatattgtttactagattttccatgcagctttgtttctttcctttctggtgaaaagattgcaaaatttgaagcggtgtatttggcatatacagactttgacatgtaggcagacagcaaaaaacattacatgccatagacaagaattcttataaacatgattagatgtaattacctctcaagagcttgatttttcctcagttgctttcgagagaagttcaaatgccatgcaagattccctggataccaaggcaagggcctgatagcatcttctccatactcatcactaacctttgcaagtaatttatttttataaaaaatacattagaatggcaggaactggtgtttaagtaaagtgtgtaaataaagagggtggcaacctcactctccaaatatctcttgaagtcattctctaactttgagcaaatatccttaaaaaactgggagctgaaaagattaaaagaatacaaactttcagctactccggaaaaagaccagaaggtgatcgagaataaatttagattctagactactattgtgccatactatcatatataagtaaaagcaaataactctttgtgaaaacagcacaacatttactaata

SEQ ID NO: 60884 - DNA, 607 bp, Oryza sativa
atatttgagttgaaagtttcaaattttgattaattatatttgaattttgagatcaaagttttaatttttttcatagaagtttttttatttaaaaaaatgagcttgacactttccgtttaaaaaagtcagataaaccgtatagatgaaacctatatatatatggtggttgcatcgcatactgcttcctacatcgacactcgaaatcagcacgtaccatgttccttgagtgggccttatatgggtcaaaaccatgtgttccaacacagctacgctaattagaccgaggacggcgacgatcaatggcgaggaggaagccattacgccatttgccaatagcgatggagatgcccttggcttcaaagggggtgttcagataaagtttgagcgtgacacatcgaatattatatagggtgtcacatagggtgtttgggcactaacaaaagaattaattacagaattcgttagtaaaccgcgagacgaatttattaagtcttaattcgtcattagcaaatgtttactgtagcataatattgtcaaatcatggagcaattaggcttaaaagattcgttttgcaaattagtcacaatctgtgcaattagttattttt

SEQ ID NO: 60885 - DNA, 7342 bp, Oryza sativa
agctgacttcgactggattgtggcacttgaagatgggacttcagttccagaacttctcataattcatatctttagcgtcaacctcatacaagttacccacttcacgttatgcgtcgatatcagcttgtcattactaggataccatgcttgttatcatgagaatatcatgcttgtcatttgcttcttacttgctaccaactgcctcatattaactttcctggtctccgggtgctagctacttctgttatttgacgcaagggtcgataactttgcctttaaattatgttcctcaacagaaccaacttatcccacttgacatgctttgacgtccccccaaatgactttactgctggacttgttatggtttgatcgttatccagccaactctgaagcttcgttgttagatgcgatttttaatctgacctctatcgactatcttcgaacatatcacttggttcataactgggaatagttcccacgaacagacaactcggattcactttctttatgttcagtttactttccactattctcttcatgttgtcatcatttagcattcaaagtattcctttacacattcaatcctgatgttttcttttcagatttctcttatcaatcacctttcgacctacttctttgcccggtaataaacaccttggctggtatcttctatcaatcaccttttgaacttggtcaaccaagtactcttcactccgagagttgtggatgcttctggtgacactgtggtacttgagcctgctgcctttcagagaaccttcaagtggttcgtcaaaagctagactgacggttgttgcctttgatccgaagaagtcacatctgaaacacttagtccaaacaaatgtctctttggttaatcacttgattttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattacaaatttctcccatatttcatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaatccttgctaacattggcatcagtggtaccatagttgctatcaccattggagtctttctcagtgtcgaaattgctaaggttgtcattctgggttccaacattgatactatcgttgacatcttggtgaatgctactgacattgcacgccttattcgagtggtcactaatggggcaagaaccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgaccattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggcacttgaacgttggttgcccctgctgggtggttccaattctgtaatagttgaaaggctgttgccaacatgttggtttggttaaccacaacttggattagctctggtgaggtttcgttggtgcttctctcattcccattggcttgggttcttgagtcatcggatccatcattcccatagcctttgttactagtattatccatctgtcacaaggtagaggttgagaggggaagcatacaaggaaagaatagaccagaactagggacaagaccttaaaggaactaactcttcttgctgatgtgttgtttgtttcacttattctgcaagttgattaagctaacaacctagcatggttacatcacaacccaccgatgcaaaccacgcgctacacacacaagcaagaaacacacgactaacgacactaccctagagggtggcttaggttctgcgacgggttctccaagatcttcactccttcacagctggcttcactgcttcctttgcttcgccagcggatcctgcagtcttccggagcttcggcaaacaactgacgatgtcttcttcttcactgacctgattatctagtactagttgaaatttgaagaaggaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaacgcttctcttactgaagagggggagaaagatagagcaagaatgagtacaaccacagtactcagcaggccacaccggcagatgcatgattaatgcaagggggtacaaggggataataatataggggttaagttttgcagtaaacagcatttaaaagtcacttagttgcccaaagccattttataaagacgatcctagagctatacagtattattaatcacggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccgacccatcctagccatagacaagagtaccgacccaatcccgcctacggccggaatacccgggacaggcaggcagaactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtttgtccaattccaacataagccaaccattccatagtgaccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataaaaacaatagcaataataatgtcttaacaaaggtaaataggcatggctaaataaaacagtgataacgcgggaatttaaataaagcggtaatgcattaatttaaatcaaaaataattttgtaaactgggattcaatatgctcaaggatgatgtgacttgccttgctcgttttcccaatcgacggctgcgacttccacgaagagcggatcttccgaagctgcagcgtctacacgaccaacggaaaagaaaaaggctttaacactaaataactccacataacagcagaaacaaagtacaaaaatgggttcttgacttcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcgggcgcgcggaccgggtccacgggaagtggggcccacgcgtcagccccacggtccacggtggaccgggtgcacgcggctggcgtcggtcggcgccgtgggtcccgcgcgtcagccgcacccgcgggcgcgggcggctaacggccgggcccacttggcagccgcgagggcgcgcccgagggcggcctcgccggcgcggccgaagggagggggacgcgcccgcgccccgatggtcaccgccggcgaccaccggcgcggcggagcggcacccgagagagaggagggaagggggaagcgagggggacggtcttcggctcaccccggtcgacggcgacgacgggaacggcggccgaagcggaagaaggcggcggcgcggttcgggatgccgagggcgacggtgctccggcagtcggcgggcgaagcggagcggcggacggagtcggcaaccactcggcgaagccgatggaggtggcgccgagtcgggaggaggtccggagcggcggcggcggcggaacggagttcggcggcgacggcggagagagaggagcacggcgcgagcacgaatccgacggcgagagcgagcggtgagcggcggaaacggaagagcggagcacgggcaacgtttttatagcgtcgggagggagagagggcggccgaggaggaaggaaaccggccgcggagatctcggccgctattgatgcgccggcgacgattgcgggcacgattcaaacggatccgagggagagagagaggggaaagagggggaaacgggagagggaatcacggggagtgattcccctctctttaatgcgcgcggggacggcgggatgcggcgcattccgcggcggcggcggcgctagggcacgggcgcggcggcggccccgccggaaggaaggcaatgacaggtgggccccaccgtcagcgagagtggcgggcgggcccgcctgtcagggcgcgcgcgcgcgggtagtccgatgggccgcgggggaggagagagagagagggagggagaagtgggccgagccggcccaagagggaaggggggggaaaagaacttcttttagggtttttctttttataaaaccttttcactttgtttatttcttctcaattattatttgtgctctgaaaattccactaaaatttgagggctccttttagaccaaggagaatttaacaaaaattctccgggccacatttgaatttttcttgtacgtattttagggtttgccaaattcttttcgaattttaattaattctatttttccttttagaagatgatttttatttcgggatgaatttatcaggacgtgacatccttggaggcgatcttttcgagcatgcgattgtgccgcacgccccccctgaacgcgtagatcaccgcgtgtgcggggatgcacggtatggtgttgcggacttgacagaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtgtaccgacgcgggtggcaagttcatcagccaaccccgcgcctgacctttcagggccatggggaagaaattcgccatgaccctgtcgtcacccccggcggcctcaatcccggtcgtatagatctggagaaactcggcggggttgacgcttccgtcgtatttttcagtgatggtgggccggaaccttgggggccaacggacgttccgaaggctcgccacaaaggctcgacagccggcaccgccaaccggggacatgggaggctggcccccgtgcccggaccgaagtggcgctccggacgaggaagcgccctccgttgcgtggcagcacgacgaccattgcgccggcgctcaatattgaggcgggcatccggccccccacgcacatcttcttgggtcggaggcgttgacgagggaatagcggacgaacggcgggtaacggccgccgctcgccgcgccctccgcctcgacgacacggagccggtggtagcaacgccagaggccttgggggcggaggaccgcccgccggcgactaggcgctgctgcgccgtcatgaccaagtcggccacatcatccagccaacgtcgagctggagtctctggatcggggacgacgggcgggtgacgcaggagcgcgcccgcagcccggagcgcgccctggggcgtgctgccatcgccgtagacgaggaggcgacgctccccatctcgccgtccttctccattacccgtgggtggcgaagtcgcggatctttcgaccccctcgagcgcctcctcccgcccaagacttcggcgagagggggacggtggagtacgagctcgacggcgcgggttctgctccctgtcgtcaccgctagcgctcggagagaaggttgtgcgccactgcccgttcggccattgggctgagcgggggaaact

SEQ ID NO: 60886 - DNA, 2490 bp, Oryza sativa
aggaggaggagcgggcgctggcgccgctcgccgacgcgctcgaggcggcgctcgcgctgctccggctcggccgcgaggggagcaggatctccttggtatgtgcgcgcgtgtgggtttcttgattttgttcgattcgtggtcctggctgcctttttgggaggaactattattattattatggattggtgatttgatattatgacctgttcttaggtaaaaataaagtgcagctttagttattaagtttattattgactttagtctcctaaaaaaaattaagattcttggatgcaaaaatatgattctgattcgtctactgtgtatccgtgcttaatttttgcttttataaatcgtgtggactaatattaatatatattgatgtgcagttgtttgaaacacaaaacaaattgtaggggtcgtgattgttaagtgagttttcttttgttttagcataggggctttaggatgatttagttgctgttgcttattaatcgcaaaaaagagagagagaaaggtttccataattttattctgcagctgtgttgtatttgttcagctagatttcttgttgagctgagattgcttcttgttcaatgcgaccaatatatgttcttcttttgtggtgcaattttggtagggtccataagttgtggtctttgggggcgtctgtaacttggttatttcagatcaaactccttgctatttttttttgtggatctactgcgaaacttgtcatctgtaaatgatccatgcattctcatttctcagggcatccatgagtttgtcatagatttgctgtagaataaatgcttggacggattcctccatcggtttctttacttgttgaaacattcaagaatctacttgcccttgccctacatccttcatggttgtactccacatgttattccccatggtaaaagcacggtttgttgtgtggattagttgggagaggcaacggatagacatatgatcatgtctttctccatggtaaaagcaagatttgttgtggattagttgggacaaccatatgatcatgtctttcactttcttgtgtgttgtttgtagtggatattgtctatagctttgaattgttcttttgaggagaggtatgatcttccagtcctgagcaattcaactgctccttttggatcataaatttcacctcttgaatcattatctagccagtttttctgcctaccagtatggtacatcaaatctgaccgattggagtactatgttcttttgtcaagtataactgtattattatctgtatggtatatctaatcataacagacattttcatttttctattttcactgggacaaagaacttgtactaattgtttgctttactttggtcaaatctggttgactgtatctgttgtaactatcaaggcctcaaacccttcatcgagtccgtgttatcaatgggatgctttatgagtgctatgacataatattggtaatcaatagtctttgaacattattttatatcttgatcgctcatacaacaatgatgactatcttgatcgctcatgcactatttttccggattaagaactaacttctggctgggtagttgttgaaattgttcaggagttgaataggccacgtgctttgtcagaaaattaaatagcagcaagtaaaaggttttctggaagctttcatgttaaattctttttataaactagcaaatgaaatggtctgagaagcatattttcattttggaagtgcaatattgcttagtagagagtaatcaaattgggttctatacctaccacttaatgctcgctgagtacattgacccaaaaatattatttctgagcacaataggtttcattaaacttttatactgaaatacaataagttgccgcaaccagagcagatcaacaaaatttgtcattagagaacttcagatgatcgacatcataactatattgtttgtaggctcaaacattaaggtccccaccagtggatttctgcacccgttgaaagtgtttttcttttttggcctgttggaatgcccatgtacctgatgataggactacctctatgactcaccgactatatcttttacggctgtgcatagggaagggatgaacctacaagttagaaatatggtagtcattgtctagttttctttatgtgactatcaaactcatgtattgattcaacgttttccttcttcaactccattttgatgttattgaaagtgcttgctcattttattcccaagctcagaagcaagggattttcttgattatattggtgtagtttaaatttcaggttggttttcttgctctttgcttcagtacttgaaccacaggcctctgactgtccatcctgtagcttgtaatgtttttatatggtgctcttaatgttggtgttactctatctcttttttcccctgctttacctgtattcttattgacctttgattaccattttgttcttattataaatcattttttataaacatgcttttcga

SEQ ID NO: 60887 - DNA, 9403 bp, Oryza sativa
tgtgataaatgaagatattaaatctgtagttttgtgaaacaagttcttaaatatgtagctttgggatatattgtacaaagtacatataattttgtgataaacgaagactttgaatatgtagttttgtgaaacaagttcttaaatatgtagttttgtgatagattgtgctaagtatatgtagttttatgaaatttactcaaaatttaaccaaataaaacatgtgcacaatcaattagttgcctttgacccaaactagcacatttactatttaggttggcaaaaaaatgataaggcatatttagtatagtggtatcaatccaaaattaccctatatataaaaattttacttatataagtcacgggttaaattggccattaaaaaaccgccaagctgcatgaagaacagtaaccaaggaaacgttcactcattgcagaggtgttgccgctggcatagcaaagctctgttgcttctatttcctaataaggtaaaatggtttattggaagataaaaaatattttatagctgaaatttttatatacgtgttattagcaatttaaatatcaatgctaaaatatatgttgaaaatatcttaaaaccaaattcaaaattaagtttaaaaattcaaattttaagacacctttgaatcacatcaataaaaaatagaggaataggacaaacatagaattataatataaatataagtacaaaatagaggattgcaaaatagaggaaaaacacgagaatacgatgatagagatagacttaaaggaaaatttacaagagattaaaattattgctaaatttcctccaaaatctctacagtatggtttatttcatagaaatttcaaaggatactctaggatccaatcctttgttttaaatgtcttcacagaaaatttttcaatagaattaaaacccttcaaaaattttaacgttttctgtccaaatcaaagataggagtacacatgttagggcaaccaatagagctactcagtgggtgtttaggctgtgtatagttcagcgtaaagtttggattttgattaaaattagagataatgtgactgaaaaaattatgtgtatatgtcaggttaatgtaatgaaaaaatactgaagtttaaagtttggatccatacacagattgtgtatgatttagatcagtatcaccaggccctcataggctgtgacctcaaatttacgagctctgctccagcagccgcattcacatttcacactcacggcgccaccccgccattgtgcgtgcagcacgacatgctgtgctgctccactgctcacacctctgtcaacctgcatcccatcacattcaaatccccatcccttctcacgcaaggaaaacccccctacttcttcctcctctgaccagcatggccccaccccacacactctccacacccgggcccacccccacccgcttccccagaaatattgctacgcctcctcacgacacctcctcaaaagtcgcgcccccgctccggcccactggaccaagctcaccgcgctcggcccatggctggacccctccctcccggctatataaacctctccaccaccccgcccctaccaccacggtgtggcgaaggtgtcactgacagccatggcccacaagcgcggccgtcttgttggttgggtgcttctcctcctcctcgccgtggctatcgccggcgccgccgcggccacgccgaggcagctgttcctggtgacccaggcgccggtcacgctcacgaaccaccacggccagctgctcacggggaactactccgtcaacctgctctggtacggccgcttcaccccggcgcagcgcgccaccgtcgctgacttcttgctgtcgatgtcgtcgccgtcggcggcggcggaggctgcggcggtgtctggtggtccggcggcgccgtcggtcgcgtcgtggtgggccaccacggcgcggtaccacccgggcgccgcgcggctcacgctcggccgccaggtgctcgacgcgtcgctctccctcggccggcggctgtcggagacctccctcgccgcgctggccgcgcgcctctccccgcaccggggctccatcgccgtggtgataactgcccccgacgtcctcgtcgacggcttctgcctctcccactgcggcctccacgcgtcggccacctcggccgccgccgccgccgccaccgcctcgccagccgcgacgcgcgggcgcggcaggttcgcgtacgcgtgggtggggaacgcggcggaccagtgcccgggggagtgcgcgtggccgttccaccagccggcgtacggccctcaggcgccgccgctggtgtcgccgaacgccgacgtggggatggacggcatcatcatcaacctcgccacgctgctcgccggggcggtgacgaacccgtacggcggcgggtacttccagggccccaccgaggcgccgctggaggcggtgacggcctgcacggggatgttcggcgccggcgcctacccggggtaccccggccagctgccggtggacgccgccaccggcgccagctacaacgccgtcggggtcgccggccggcgggtcctcctgccggcgatgtgggaccccaagacctcgcagtgctctactctcgtgtagtagtactagtacaaaccctctgatgcgatcgatcgatggaccaaaatggcttgggctcggtgtacggacggctgggattagggagtggagtgacgtggtgtctcgtttcttttgttttgtggatatttcgtggtgaacaaaaaaaatggaaaaaaaaacagaatgaagtggggtaatgtaataaacctaggctttcgttgtcatgttctgtatatattggtaaggcattgttcatgggttcgttgatcgttgacatctcaagcaaaggccgtgtttggattttttttttatataacaatgttgcaccagaatatttggacacatgtatagagcattaaatatagatgaaaaaactaattacacagtttgcatgtaaattgtgagagacgaatcttttgagtctgatttgacaatgtgacttttgagtctaattacgtcataatttgataatgtgatgatataataaatatttgctaatgacagtaattatgacagtaattagatgtcttgtagacggaatctgtaagactatatttaatactttaaatgtgtgtttgtatattaatgacagtaattagatgtcttgtagacggaatctataagactacattacatttctatatactttaaaaaaatttgagcaatgaactaaacagagccgatgtttgcaatgttttcatgaaatcgaccaaatgcaagtacggggtagcaggagtatttgcaaaactcaagacgggcaagtggcaacaaggaaaaccattgtgcttgtgccatcatctaccaccaccttgttggccatcgtggaaagcatgcacacacaaggaagcaaaagcaaggggaggacggaggacggacgacgcgatgcatcatcactatgccccggtttgtccgggcgtggtatggagcacgggaaagagggtgaggacaggacgagaatccatccaggctgtgcaggggataagcttgggcgcacagtggccgcgtgccagccgtggcaggggagagggagagaaggtttgcccgagataaaaaggcttggatggtacggaaggcgtcccgtcgctgcacggagttggggcccgtcagacgtgaccgctctgacctctgagctctgagcgttgttcctcatctccattggcgtaatgacgtggagtaagtacccaaccaaggctgggtttagttaacatcaaaattaaaaattttgttgaaattagaacgatgtaatagaaaagtgagaagtttatgtgtgtaaaatttttttatgcgatgaaaaagttaaaagtttgaagaattattttggaactaaacacggcccaaatgaagttcaggcagagccatagaggtacgtcccataatactccctccgtccctagatataagggatttgggtcataaaaatattcagatatgttgtactaggatatgtcacatcacatccaacaaaaataccttatatttagagacgaagggactataaaggattttggatggatgtaacacatcctccgtccatattcattgtactagaatatgtcatatcaatctaaaatcccttagagtaacgataatgtatatggcaaaagtagtccatagagatgtgacccacatatataaactttaactattgcaaccttcacaatgtatatgtatagcaaatagtattagtaggagagaagagatagtgataaataatatattttactctttatgggtagcccatatgcttatgggtaatttttgttatttctttcttatggactagttccacaatgttagtggctgaatcaaatattatattactggtggaccacttttggagtacattgtgacagagggagtagctagtagtagtattgctactgtatatatgttacggaatttagatcaggtgctgttttatactagctcctttccaaaatatagctatatttagctcagtactttatcaaaaataaaatgccaacctaaaaatgtctatattttaggatgaatgaagtattactactactctctgcaaaaaaaacagatatagttaaattcttagtattacaatatgtcacatcttatgtgaaatttggttttagaggatggataaagtatgtgtaaccgtgatttaatgactattctcttcatcaccgaaataaaccaacttagattgaatgggatataatctgtccaaatttattgtactaggttaagttatggtccgtcctaacttatattatagtgtgcagtgctcatttcgtttcaaaataatttaacctaggatagttgtgatctaacctagtacttactttatcgatccaaaaatatagcaacctagaatgggataagacccatctcatcctaggactatctctgtttggattcatggttattttttaaccctccctcaaatagcctcaaatagcccaaaagtccaaacaggtgagttattttagggctatttgaaaataacccaccaaaaaaactacccccccctcaaagggtgctaattggagctatttcaggtggggcccactaaaaaatgtcttttctctcattctctgtccatgggaaagtgtattaaaggccaaatagctctcaaaataacccttgaatccaaacaacttagggctattttattagagagctatttccttgtgctaaaaatagctctcaaaataactcttggctagttctccaaacagggctatgaatctggatatatatgaggcatttcaaattcattatactaggttatatgacgtcatatcctaatttaatttattttaagatgaagcgagtactccctccgtcccataaaaaacttaatctagggtttgaatctggacatagtgtatgctaagatttaaatctaggattagattttttatggaacggagggagtatgtcacaagtcgtaagattatactggttttaccggtgatttaaatttcaagccccgctggcaagcaactatctcgtccaaactttcggactttctcttttctttttttttttttgcattgcggttgaaattattaaatttttaaatagttttgtgcaaaagaaactgaaactcgtgaaattttagtggcactgaaatcactagaatttcagtctagtgaatgcaaaccttgggaatgtagcaacaagtttctcatcttttttactactagtagtagcacaagtactagtcattcgagcgaaaaaaatagctgtgggtaacataaatgtaacgaacattgtagtcctctagagcttgtttgtcacaactttaacttcaactctaagttaaggttcaaccaaacagtttcagctctatctaaactaggagagaggtggaactagatttaggctgtttcacagcttcactccagatccaacttttagagttaaatttagtagttaaagttctatcaaatatgaccctagtcttctacttagtggaaccaaaaacgtctagaggttttccggttagctccacaagactagcctggattcaaagccccacctcttttatttatttgatatttgattttccctaatattcatctttttttctacttagtggaacgaaagtacggctgtgaatagtcacactcgagcgaattcctagcatgcggattagctgggaccggtattggaaggacatattcgtaaaaatcatacttaaattgtttataaattaatgaaaacatattagagataaatataaacactacgataaaatcgcaagttcacactcaactttatttagtcataaaaaaagatgaattttgggtgaatggtaacacgacaatatttatgtaaaatctattatttttgcttctctcaagtgaagttgagtttaaacttaagattcggcgagaatgtacgtatctacacccgtctctaataactttttcgtgactaaaaaaaactttcgggttgattttcacgagctttcaactcgttgttacacgatatttacccggtatcggagctgagacctgcatggcttcttctccgccagattctctgaaacgacacgaaacattgctggacctaaggatggtggtacgtacgaccagtactcccagtctcccaccgtggtacgtacccccacgcacgcgggtcctactaccctcccactagggtgcgtgcgtgcgcgcgccgagccgcgcgcaacagcgagcgagcattccaacccccgtcgtcacgcggcgcccccaccaacagacgcgccgtgcacacaccggggcggggagcgcatctgcgcatgtgaaccgcgtgtagtaggagtgtaggagcagtgcgtgcgtgcgtacgtacggctcgtcgcgcgatgccgccgcagtgtcacgcgcgcgcagacgagagcgattagcggccgagagcaccgcggagagggaggagaggagagcagtgcgcggcaggggccgacgccgaaccgagccgagccagctgtatcccaccattgcctacctcccccgctgcggcgctgccccctctactggcacacctgcaatagggatactgctatagtgctatgccctctcgagaaaccgagaggccgagtgccacctttttcctggcatcgcctgaaccacagggcgagtcctcgacttgcctctgcaacagcttctctatcttatttagccacttaaactaaaaactcactccaacagaggctgtgtttagatttaaagtttggatccaaacttcagtccttttttatcacacatcatcttcaattttaatcaaaatgtaaactttgcgctgaactaaacacaacaagactctctattaattctctctaaaataaaaatgaacccacgtgtcagcctctccccccaccttcttccttctctttccttcttttcccctttccttccttccttcctgtcgaccacactgatgccgatggcggccgacgcatggcgcgcagtggggcggcgacgcggggaggcgggaggcggcactcaccgaggtgctctccctctccccgccgaccactccccacagccgagcaccgtcgagctcccctcgggctgccggatctagaggccgccgccggctttgcggcgacgaggcgacggagctcagagcgggatggcgacggcggcggcggagctcggggcgggatggcggcggctcgccacgacgacctcgatgacgacgacgacatcagctcgcgacgccgacctcaacgatgccacagttttctcgtcgattccctcgtgtcgtcagtgggtgagcgagcggatctgacggaggcggaggtagcggtggaaatcggcggcgggaagaagccgagtgacgacggtgacggcggcggcagcacctgagcggcgacggcgacgacgacggtgtgccctcgcgcatttgaggcagcggtgagtgcatggcacgagaggccctgttcggcggcagtcgacaatggtggatccgtgcatgcgtgaggtggccccgacggtgaacgacgatggtggcctcatcctcttcgacggtcgtgcgccgcgccccatcccccctccctcgatgccgcatccctccctccgtcgtctctgcgccctctctccctcaccgtcaccatgtcccctccgccgccccattgcatgccttcctccaccgttggtgccaccattggccaccttgcgccgctcgccggccatctcgaccttcaccatgctgcacggatcgacctcagtaggagctggccattggcgccatcggcaaaggcatgggagctagccgtcggctgagagaagagagaagcaaagaaagagataggtgggacccacggtggggcccatcgttcggcaactggaggaggccggccaaatttggccagttgagatgcttgtttggccagccatatgacttggcaatccaagtagctagactattggagggagtttttttttcctgtgttggctaaaatttaacttgaggagtcatttatcaatgctattggagatgctctaatatctccgatctccacaactaggtcccatttggttcaaagaaaagtcataggaattttttttgtagaatttcgttcctataattctttatttctatagaaccctctgaataaaaggaatggaccatatgaaattcatacgaaatgtctccttccatataagtttagaggaaatttaacatgagatataaccttatggaaagtttccgttgagttttttttatctcttcttagacaaataattgataatacatgcgatgcactaatgtagaattttcttctctacatcatcaatatttagttttatattagtaacaatccaagtatgtgtaatactacacctctatcctatcatataatttatattaccaaaacttgtctaccaaatatttggtaggctagaaaaacaaacagctccattcaacgcttcagtgcccataaattcagatcaggtgtagttatacttataactataagttaactactacatataattttgaccgtcagtttttattaatggtttagatttgatgctacattaacaatgtaaatactccatactacaatattctacggtgatacgaactgtgaagtgtgcgatatagaccgtccgattcgcatccaatggtgctcattgctactgtttaagtgcagctgatccgaatccaacgtccatatatatggtggttcttctaaaagcacaataggttggccttccttctccgtttcataacgtaagtcattctaacattttccacgttcatattgatattaacaaatctagatagatatatatgtctagattcattaacattaatataaatatggaaaatgatagaataac

SEQ ID NO: 60888 - DNA, 2990 bp, Oryza sativa
tttcaaggcgagttatgaaattagttttttcatttgtgtccgaaaaccccttccgacatctagtcaaacatccgatgtgatacccaaaaattttctttccgcaaactaaacagggccttatagcgatattgatggatggaaaagagataaaatgggcagagaacataagaaaaatcttgatgaaacaactataaatatatatttaaggtacaatgcttttttttttttgctgaaattgtatctctctcctcccatcgactttaggtaaaaaagagtcatccacatatgactaaaaggagcgcattatagggtttattagtgttttcttttacttacatggaggatctgaagtcatcataatcataccctctctacttctctagagatggaccaatacatatattaattatcttttaagtatattgtcaaaataaaagaaaaaattacaattgaaaaagtacgactccctctgaattgataatacttttgtttcgaggaaaaaataactttgcccactattttttaataatatatatatagaaatatcaataaatatatgatttaattgaagtaccttttcaggctaatttaggttttcattatttgtaaaacaaatagtttaaatgttattcataatcaaagtttttgaagtttaaccatggttttatccaaaatgacaagtattatcaacctgaaaataatatttaccaactagatttattttagcaatatttaccacttgtgtcgtcaggttttcttcttcttcttctcgcctgcatacatttgtcggagggtgaactcctccaccagagaaccgtgagacccccttttttggttcggccgggggcagcgggtgagattcgatattcctgtgtagatgtgtgaagatggggttgaacccccaaaaaagatctcacccaaggggtttatacaggttcgggccgctcagaagtgtaataccctactcctgtgcttggttgattgagtgtagaacacaagtgcttgaggttgcgagacaagcatgagttcgctaagaagttcctctccctctaccactaggcctggacctcctttcatacctcaaggggttaccacatgggtccaaaaacataacttagtggagaaggattacaatctttgcattaaatgcctgtcttgtctcttaacttgggaagcaagcgcacgtcaccttgatgacgaggcttgtcaaatcttgccgcctgacacggggggtgctcctgtcagtcgccatttaagggacgaagacttctgggctcctgtttgaccagagcggataaaccgactccggctacgatgagagactaaaaagcctaagacttatgggctcctgtttgaccagagcggataaaccgactccggctatgatgagagactaaaaagcctctcattatgatgtgatgggacagagcacgccgcacgccgcctggcatactcacaaggcgggggtactcagccgccgttgcatcggccattcgaccggtcacggactggtcacagatcggttgagtgcactgcagatcgcattaaatgtggcgtgacgcaattgctcaggtcgccataaatgcgggtaggtgggcgcctggaggcggccacctaacccaccgcacgtggtgaccaagagagggggtcgaggggagcccgacccctagtcacaggaaggggcggccaccgtcctaccttgggcccgatccctcctcggggagggccacgtggcgcctgggggtagcctcctccctccagtcttgatcgggatgggcccgacccccaagcgaggagggggcaaccgccactccacctcgggtgctgccccctcggggaagtgtcacgtgggtctgggggcagcctcctccctccaaactcggtatcctaagctaagctgggagggggcggccactgctccacccgggcgccacccttctcggaggcgccatgtgagtttgggggtggcctcctccctccaaacatgatacctccgggcccacatcaccgacagcattaattaggactatgccgtgtccggtacaatctttgttactcatgctgtgtccggctctcttctagcgacgcttcaggtggatctgtccaatccgagacatggacacgcgagacatggacacgctatgtttgaattcacgtgcacgcacaaattctcactatttaccaactagataataccaataatgtgttttgaacacacaacaaactaaacagcctctcaaaaaaaaaccacaaaacaatcactacgcatcacctatattccatccagccctacataaaccattaatttattgtttcaaaccacacgtaattgatacacattaccatcactatcaaccactcctatagagagaaaaaaactctacaataacaattactacctccgtattttaatgtatgacgccgttgactttttatccaacgtttgatcattcgtcttatttaaaaaatttatgtaattatcatttattttattatgagttgattcgtcatcaaatgttcttcaagcatgacataaatatttttatatttacacaaaatttttaaataaaacgaatggtcaaacgttgataaaaagtcaacaacgtcatccattaaaatatggtgggagggagtatgatttaacctaattctccacaccacatgacacggtaataatcccggttggtaggtagccggtggtgcagctacaccgaagaatgtagacggaaatctgccgtggaagacaggcaaaaaaaaaaaaaaaaaaaaaaaacgaagacccattcaacccaacgtacccaagacgctgacctgatcagcgatccatcaccaaaataacactccgcccctccatttccccactatttaccattctgccactagccgaggtctcctcctcctcttcttcttcccgctgcttcgcctcgcgctcgccatggccggcgaccgagcggaggaggaggagggggaggcgccgcctccggaggcgc

SEQ ID NO: 60889 - DNA, 707 bp, Oryza sativa
caatgaaagattttgttcagaattagggttttgaccacggcaggattactagctgaacaaattccgtccaactacaacaaatatcgcctgacacaaacgacaaccaattcaatctgaggactagcctagtaaccaatggcatcgacatctcccatttttagtttaatttgtgtcgaactgtcgatgaacgacacactctagaatatcccaagtagtagtcttaaacagtgctttattacatatgttgaacaagatcactgacaacacgataaattattgtagtagattgcaagaatcattatatgtcacaattggtactttgccatttaagaaattaaacatacaaccacgcaacatcgataggagtaaattggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatgcagcttcctaatcttatatgcttcctcatttgagaaagaagcatctgcattaaggaaatcatccaaggaatgcccaacaagggattagcatatttccatgg

SEQ ID NO: 60890 - DNA, 3157 bp, Oryza sativa
gacgggcctcggatggcctccggtctccgtgccgcaccagcctccgtgcagcaggcgacgccgcactcgcctcggacgaggccgcgccctccgcgcggagctccgccgcgaccccgctgcctccgccgtctcaacacaccagcgcatgcctccgtctactccgccggtcgcacagggctcggccgcggcgccgcctccgtcggctccgcggtggagaatggcggggtggtggcgagttttcttgagggggggtgaagtcgttaagaagaggtggcgtcgtcagagttgagggcgcacggggtcggggccgcacggcatcgagcacacccaaggtgctcgtccgtgtgtctccagaaaatatggtttttaatcttatttttataaatatgactgacatgttgggtcctcatcgacacgtagacgccactgtggcatgccacatcagcggatggagcgggtcgaaacccatttggatctatatgacacccaaaacaagtttggggatctaaaaatgcattttgagagtttaggtagctagatgacacacccacacaagtttagggaccgctggtgcacttcactctaaaaaaaaatgagttcttatatgtgatggcgataactagagcgatgttaaagaaggctacccacctacaagtagtagcgtcgatctagctgagtagaaaaaaaaaccgttgcatcaattcagttttgttttactaattaaatgtaaaaatggaatcgtattgcttggaacgcatgttcacattaaaggtagctatgatcatcaaacaattgttggatccgaggaaaaataaaatctcgttatagcctaattcgattgagcagataaagagaaaattttaaaaatagaatgaagaaatcctaaacatatcaaaacacattggtatcgattaaaacatataattttagaggccggccccatattctgttgaggccttagcggcaccttgtctcacacgtgcctaaggacacatgtctgttttgtggtagattttggtgtaatttataattatagatagactcgttttccctaattaacatagtcctacttatttttgcctgcttcatgttcacaaacatcatcggatgttaaaagttatgggtttgatgaaaactttgaacatagtccacatggatagagtgtactaggcggtttgctttcttggttgtcatgtgtactcttaacactgatggggattgattagtggccactatggagtatacaatgacaccccaaccaacccctctttgaccatgtgaaaggtagaagaggtagtagtctaattattcttgcctgatagctagtctccagcaataataagcaaattagtgttttgctggctgctcatgtattttcagattagacatgactaattgcacattattgtatttttctcatgaaacatgtcgtgattttgcatacacgcctttaatttgaccacacaatatgtactatattcgtctatacatataagatttttttctgagatgcgtagtatatataccgtgttgtgtgtgtgtaaggatgaaaattcagtggcaatgaaaggcttttgatggagccatgcatccatcaaaagataaaaattcatttgctttatagcatactagatgataccctacacgttgttgtaggaatcttgataagattaacataagcaaatcgataaaatgatattagaagatattgaatatagaacattaaatcaaataaacatgaacttgaatcaaatcagcatgaactgacaattattgagaaaaacatggcatctaggaactaatgatcataatatgttggtaccatcgataattattgatccatttagcaagccttcgttagtcttttcttgtcagggaatgttaacttgacacatagttagcacaactataaaattggtggctaaacgacttctggattaaatagagagaattatggatgaactaaaggagtaaatgcaagcgatataatatatagcactaaaacaatctgagcgatcaagttgaatccaatggccaatagcaaaggtattttggagtaatctagagagctaaattttgatctaatggatgaaatttgttgaaatgatttaatacatatgagaggagagaaaaatcgctttaattgtacttagtggggatggactttttatatataggattaattttatgcttaattaatgacatgtgaagagaaaaaaagtgatgcatgcatgctcatagcgtgtcgattgtggcactattattgcgttgcattcaagagaccatacacacacaaaatgagaggcagtcatgttcaccgtcacctcttaagtcaacacatcgttgaatgttaagttcattttagttgtgccatctttatttgatgatttggacataatttatagatacatgtgaaagaaagaaagaaagaaagaaaaaatacagttgattcttggtgatacaaccatgtaggcttatgacctacaattccaaacagaacacaaccacctaggcttttagttttgcatatgttatatgtgtgtcttctccaatcgactcaatataaagttttttttcttaaaaaaaaactttctccattacaaaatactagaactttggaggttgaataacgatatcaaggagaaaataaaatgggaaataattgttgcgcgctactcaagatgagaaagtagctaggtgaagaaactgaatgaaaaatggttgtggttgcttaaaagttatatggagggagtctaaaatcatatggagttaccaagacaactatttatatgtgtcataattgaagagtcaaaagtagatggttgcacgggtcaactcccaagtcaatccataatggagtgtactttaagttgataagaaaccatacaacagttatgtcatatatatttaggttgtgtttagttcacgctaaaattagaagtttgattaaaattgaaacgatgtgacggaaaagttaaaagtttgtgtgcgtaggaaagttttgatgtgatggaaaagttggaagtttgaagaaaaagtggtttagtttccaatttttttcccaaaaacatcacatcgaatttttggcacatgcatagagcattaaatatagataaaaaaaataattgcacagtttgcatgtaaatcgcgagacgaa

SEQ ID NO: 60891 - DNA, 1836 bp, Oryza sativa
ttttaaaaacatgtcaattttgaaacgagcctttgcttatgtactcctaaaaaacatctcttttcttataataaatatgcaggaatttcacagtttctttaaaaagaacatctcaatttataaacaagcctttgcttaggtactccttgagaatttttgttctttttttggtttaaatatgcaggctaagattcaatttttcacagttctaaaaaagcatctcaatttataaacaagcctttgcttatgtactcattgagaaattctcaaaattcctgtgtgtacacccgaaagctatcaaagtcaatggtaagcttttcaatttgctatgtgctgtttagttttttcaaagaagcttcatgaaactttcgatcaaatctatccaagtgtggagcgctttaagaaagcaattttgaaattgtggtccgtatcttgtcaagaagacgtagaagcaaagttgatttgaactgaaagcaaccattctttttgtttgcatgtgtttgaattcaaccatgacaagtacatatttaaattcgaaccaaccaggggagagcaagaaactcaaacttctgagcgaatcaatcaatgtttgatttttgtaatctgatagaaacaaggcttttgtcatgagcccatcgaaattattgtttcttcttacgttttctgcaagatcatgcctaactttgacaaaatctgtccaaaaccttttgaatttcttatgcacggccatacgataagctgatttaaattgaaagccaccgtcttttgatttgtgtagggaatgattccgtgaaaaacaagttactacgtttttaaccaaactatgtttaatatttttatataagcaaggctcttatcacaacaattcaaatgttgtctctggaaagtacgctcaactttggacaaaatccatccgaactttgacatttgcattttggttttggtccataaccatatcacacaagaaaacacggggacaatgctgtccgaattgacaaaatctatatttatgtttgtgtggttccttagttaaatcatcaaaactttggacaaattctgacctctcttggaattttttaacaaaactgagaaagctctggaagttagaacagaaatggccttctttttgtttcgataatcttctattttgaattaaatcatgcagacaacagcatgattcttgcttgccctgtaaggacaagggaggtacaacacaaataattccattgaagtcttagtgcccaaaaaaaagaaatattgaaactaaaataatatcacagtctgaaactaaaatagaggataaaacaaattcaaatagtccatgggtacctgaattctttgtggttgccacgaattcggtacggtaggttaataattgttagtagacgtaccgtctgagaatattgaacatgttatacattggagtatattattccaccaagactcattttactattttcgcacaatcatcaatttaagacctcaagtttacagaaaacgactgatttaatgacacttgaaaaattccaaccatttctataggatcatggtatgctttcagcaattgctgacttttgccctaccttatcacttgagcccctataaatagaggcattatattgaacaaatgcattgcactcatctcaagcttttctctctctctctctctttgcactacattcttgaattcacaacctacaaacaatccaagaagatgtcttgctgcggaggaagctgcaactgtggctctagctgcaagtgcggcagcggctgcgggtatgattttaatgtctcattctctagtctgattcatcattttgtttgtctgaagtttca

SEQ ID NO: 60892 - DNA, 3563 bp, Oryza sativa
aggttgtgcgccactgcccgttcggccattgggctgagcgggagaaacttggcgcacacgaaagaggacgagggcttagaaaaacacacgcgccccctacctggcgcgccagatgacggagcgtggggctcctcaccgggagaccgcgcaggcccccctttgccggttcggccgggggcgctgagtgagtttcttcaccctcgatctgtggaacgttcgcgagagagcaaatgcacaagacacgggcaatgtatacaggttcgggccgctgagaagcgtaataccctactcctgtgttctggtggatctgtgtgtgaaggaattacagagagccggagagcaagagagaagctggagaggaagagagttcaggctctagaaccctccttcctctttttcctcctctcctagttctcgttctggattttgatcttcttcccccccactctctttggtgggcaaggtcctccttttatatctcaaggggataccacatgcaccacttctacctactcttcttttaagtggggaccctccctattttgacccaaacttggcttgcttcttcacctggaaactaaatcacagcttgttcttgagtgaggcccagcgccatcactcgactgacacaggggatcaccctgtcattccttcattaatgggtggagatttgcaatggccgccgtccgaatgaccctccgatgggatgggtcatatctacctccactttgccggaagcagatgcaacgtgggggcacgttttgtctgccgatgacgtgaccggcgtcagaccagtcacagaccggtcattcttgtcctccacgtgtcagattagcatgcctcacgtctgtctttcttcatacaatgacttccttgcaatggttgcgatgaagcctgggatgtatctggccgggattggcgtgtcaactccaggagttaacacgccggctccggctagggacgagtgcctggaggctctcatcattccgatgggacggggcgaggcgcgtgacaggccgcctgttgccacctaacccgcgatctgaccggtctgtgaccggtcacatactgcgaccggtcacggaccggataagtgagcgcgctgcactgcattaaatgcggcgtggcgcgctcgtccaacccgcagtaaacgtggttaggtgagcgctgctgtgctcacctaactcacacacgtggtgccaacaccacagggggtcggggcgccccaaccctcggggccgaaacgggagcggcccgacccctcggggagacagagggaggggtggccacgtcaccctcgggcccgaccccccccagggggtcaaggcacgtgggtgagcgcggccgcccaagcctttagtcacgatactcccggtcccttgtcaccgacatatctgatgctggttcagcagaaaatggaggagatttggatgtctcaggtacacatgatggggtgcacacagcacatggtgacgcccccttggaagacctgggatccatgtcgcaggagtctccaggatcggggcatcagtctccgggatccgtttcacatgcgtcgttgcatcacgcgtccggctctctgcctgccacgccgacccctgcgccctcggctccctccctggcacaatcaccgaaccagcctggtgctgccacgacgccaaccatcagcgcttcctccacctcagctgctgcgcttgacacaggggctcatgatgctcctgacacaaccactgtactctatcaaatagacccagtgcatcaagattcaatggttcctccacgacctcacacaagacttcaaagcggcatctgcaaggaaaaggtatatacagatggtacagttaaatggtcttgtttttcctcctctggtgaacctcaatctctagatgaagcttttgctactaaccactggagggaggctatggatgcagagtatcaggccctcatgaaaaatcaaacatggcacttggtaccactgcagcaggggagaaatattattgactgcaagtgggtatacaaagtcaagagaaaagcttatggtagcctagcagatacaaggccaggttagttgcaaaaggcttcaagcaaaggtatggaatagactatgaggacacgtttagtcatgtagttaaggctactacaattagaactatcctttccattgcggtgtctagaggttggagctttcgtcaactagatgtgcaaaatgcttccttcatgggattttagaagaagaggtacatatgaaacaaccatcaggttatgagaatagtaaatttcctaatcatatatgcaagttggataaagctgtatatggtctcaaacaggctccacgagcttggtattctaagctaagcacaaagctacaagcacttggttttaaaccatcaatggcagacacgtcactattcttctatagtaagggtgatgtcaatgtctttgttcttatttatgttgatgatataatagttgctagctccactccaagtgccacctcagcattattgcaggatttaactaaggagtttgctttaaaggacttgggagagctgcattactttttgggcatagaggtgaccagaacagaagatggaattctgttgacccaagctaaatatgcatctgatgtcctcaggcgtgtggggatgcaagactgtaaaccggtaaatactcctttgcttacttcagaaaaattatctgtaaatgaaggggatttgcttggtccaaaggatgccactaaatataggagtattgtgggagcactaccttgacaaggccagatatttctttctctgttaataaggtgtgtcagttcctacactctcctactactgtgcattgggctgcagtaaagagaattttgagatacctcaactcttcttgttagcggtttctctgatgcagattgggcatgctgtctagatgacagactgtcacgaccggaaataacccaacgggcgttccttacgtgcgtgcattattccttgtcccaggaggcaaggtacaccaaaagttgatacaattcagagtttaacaagcggaagcgtaattaatttattacatgggcggcgaagacccagcacacaagaagacaaacgaaaaacagcggaagactagggcgacaaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgtaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttgaagaattaaaaacactaacttgggtacat

SEQ ID NO: 60893 - DNA, 5704 bp, Oryza sativa
cctgcagccccggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctctgattgtgagtataccagaatgtcatcaatgaataccaccacaaacttatccaagtattccatgaacactttgttcattaagttcatgaagaaggcaggagcattggttaaaccgaacgacatcaccgtgaattcatgcagtccgtatcgcgtggtgaatgcggtcttcggaatatcttcttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatgtaccccttttctttcaactcttccaactgtttcttaacttcggccagttcatttgctgccatacggtagggtcgcttgtacagaggagtggttcctggagcaagatctatccagaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgaggagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccctgaatgacatccttaccaccgttgttggggcggggaggcgcttggccttgctgacgccttggcttcgggcatttatccgcaaagtgcccgggctcgaagcagttgaagcacagacgctgcggacctgaagcgtccctgcggccttgaccaggctgcacagttggcgtaggaggacggggcgctcgagtcccttgttgattctgttgctgctgcggctgtgggacgcgcaccacgaattgaggtcggggcgcggagcgaggttgctgctgctgtggttgctgctgcgaggaggatccccctggatagggattggtgtagcggaccctttggttagcaccctgttggttgcggaaattctccaagtggcacttgtgcgactccagttccttgtgcttggcttccaagcggatgctcttgtccaccagacgttggaagtccggatagtccccggagactagacgcacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtaaaacgggcccaagtaataggctgcccctctggctgcgtagcctggaaatggtcccaccatagagatgcgggtccctgcagttggtgggcggcgaagatgactttctcctcatcgctgcactgcacagtgtctaactttttccccacggcatgcaaccaatccaacgcatccacggggttgttggagctagagaaggtaggtgggcggatgcggagaaactcggcgagtttagagtgttgtgggggtggtggtggagcattatgttgtggcggattttggatgtggtggaggagagcagtcatcatgttggcctgctgggcgaggatttgggtgagaatggcgttggtgtctggtggtggtggtagaggcggaggaggaggtggaggtggactgccctggttgttgtggttgctgccttcggggtgactgccttcaccgtagcagcacttctcctggtcgtcaccatctgaaaaccccacacagaaccagcaaacagagagagctgacaattaaaactagccacccacgactaccataatttttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacagaaggtgagcagcagcgcatcctccgtgctaccaacgccggaggcttccccctcctgaggagccatgggcgcgggctcggcacgaggggtctccacgaagcaggtccatgccaaggactggcgaacaagctcgggcctggaggtgctcttgcgggcggtgatcttctggctgcggcagacgcggcggcgcttggggcgacagacctctccctgggcgatcttgagctgatgcagctgcgcctctgctgcgtctaggtccttcttcagctgcagattctcctaacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaagaatctccacccgtggtgactgccaacgaagtcctctcgggtgagccagtgaggatcactgcagtaacctcccaagcagcgtggggctctgcatcgtcaccctcctgctccgggagctgcctgccctggtagtccactccatgcgcataccccaggacaacgcacatgccccgcagctccaaaacaaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggattttttttttcgaaaatattgctaaggcttgggatctaaggctagtcctatggtcaagggggctctgataccaacttgtcacgaccggaaataacccaacgggcgttccttacgtgcgtgcattattccttgtcccaggaggcaaggttcaccaaaagttgatacaattcagagtttaacaagcggaagcgtaattaatttattacatgggcggcgaagacccagcacacaagaagacaaacgaaaaacagcggaagactagggcgacaaccacaggcacttgacggcaggcacgagctagacaccaaagccttcatcttccaggaactcctcttctgggtttgggaaaaattgagcaagactgagtacaaccaccgtactcaacaagacacacccacaagtgcagaataaatgtaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaataaccagaccattccaaagtatccaggtgatatgaatatatcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaataggttcttggcttcataagaaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggcccacctggcagccgcggggcgcgcccgaaggcggcctcgcggcacggccgacgggagggggcgcgcccgcgccctatggtccgggcggcggccataggcacgg

SEQ ID NO: 60894 - DNA, 2336 bp, Oryza sativa
gagggggttggcaaggcagcagagtctggtgaggctgcccatggctgcagctgtggctccagctgcaaatgcaatccctgcaactgctaaaggagatggtgatctgcatcagcatgctgatgatatgtacaagtaaataaagaagccatttgatgcaatggctcctgtgtgtgtgtgtgtgcgacagtgtgagtcagcttgtgttcttcatcctgatgtactaatgtggcctgtgaatattgtgaggtgtctcctgctttactctcttgtcagaatgtaattagaggctatatatcatggccttgtgattggagcacctgaagtttttacagacaacattatgtttgtgtaatataatatggtttacttgtgcatgtatatggcatgttctttcagttccatttactgatgcagtcaaccatattgtctcaccgttcctgcttataacccgaaaattgactaacggtgcacttaccaaaaagtagtatacaagtttaagtaggcaaaatgaatgacaagattatgcgcagaataaaatctgattgaacatttggactgtttgaaactcataaagataaagataaaaatggagaatgtaaaatgaggtagatattagcacatgattaattaaattttaattattacaaacttgacaaatagatatatttgatattttaaagcaacatatatataaaaagttttcgcacgaaacacaccgtttagtagtttgaaaaacgtgctaatgaaaatcaaggtaaaatcttaatcttcatgagaaaagagcactagtgtatacacgtcactgctctcatgctagaatagataaatttcagaggaattcaaagatttgaatttttttttttttggaaaagagaaaagagttgaaaatttaagcgatgttccaagtaaccataaatagccaatgaaagctgctgaggtaacctgaagcggctgagccggccggagctggagaagcagaggttcatgccggcgatgctccggcacggcgaggagcgccgccgccgtgaaaaactgaaagcccaatattagctgggcccaaacgtgatcccccacgaacatatcggcccacaacttattgagccgcgaacgggatgggccggaatgtgatgggccgcaaggtattgggccggtacggtcacctgaaacgtgttgggccgtgggccgtggccgtacctcccgccggagataagctgccgccggcgacggccaccgtggttaaccacgcactgcaacgtctcaacctttagtagtacaagaatcaagatgtgcaatagatttcccctttttttttcctcaaagaaaaggatgtgatgatacgccattgccagagccttcagatttctacatttttgtcacaatctccataggagatcccgtcgttcatagggattccaaggggaaaaaaaaaaggaagaaacaattatggttggattatctgtttgaaacatcctgaagtgttctaatccacctatcagattggaacacattagcattgtagtgtactacagttgcttcaccactcctacaaatagggaggccattcttgaggagcaaatgcacctctttcatcaacctcatttttcctcttgcgtacaagttcttgagaggtgaagagtgaagagtcccaaggtagaagaagaagaagatgtcttgctgcggtggaagctgctcctgcggttcctgcggctgcgttggctgctgcgggtactaccgattactcatcgtctctgagggcctcacttatcagcttaaatttaaatttacaatcttaaattggctgattttaaggttttcctttcgaagtttatttttcagcctttgtttttaaatcactaagaacacgaatataaaagttttattcacaaattacttttcgtttataaatatgcacgaataagccaaacggatggggcaattctttggccttacatgcttgatcaaacttaatggtgaaaatttactggaagaaaagctacataaaagatgcaacaatagtactatgagttttcagttattggtctactgaaagctgaaaccttttctgctacttttgccccggacacagaatgatgtaccgtgacatgccagagaacaacaccaccagcaacccaggagcaatggtccttggtgtttcacctgacaaggggtataaatttcagattacaacaaaatatactacaaatatcaggtgcattcatgtgtaatttgaaactgatttgtgtttttcgcaggcgcgtcgaagtgtctgagaaggctgaagaatccggtgagaccgggcatggctgcggctgtggctctggctgcaagtgcaaccc

SEQ ID NO: 60895 - DNA, 2384 bp, Oryza sativa
cgatgacctgtgatgcagtcctgttttttgggaatctgcctgtcctcctattgctgcagacgagaggccagaaacaggtcaatagctgcagacgatggtatttttaggaagttgtttttgtcaatggtatttttaggattaagatgcttgtcgatggtattttatggattttctcgtataaattacatgacatatcacaagacagtattgcgcaaggatgcacaaatttaaaaccggaaagaaatgagacagacgtatatatatcgctgcattatttgagccgcaacacacagcaccgtcgtcgaagccagcgtctgatctgctctacttgcagacgcctccactcggcgcagtgctgctccggtggctcgccggcgagccactgctcgacggcgaactccacagtggagcacgatagatgtcggtgaagatcgagcacgccggcggtgtcgtgcgttcggcgtcttcagcagcatcgtatactgattggccgtgcatagacggtcccggtgacccggtcccggtctctgctgcatcatcgccacggtcctcgggtcccggtgtacagtacacgcacccgtacttctcctcgccggcggccaccaccaagtccgggaccgccagcgtcaataacgagactagctcaaaacaaactaatgtgtatatacgcgcgttcatacgtaccaagatcgccgtagcaacgaggatggcaaagcagaacagcagcttcctatttgcagccattgggtattgttgaaccttcaacgagtagctaggctcgactgactctagctagtttattttgcacttctgttgaggctgtgtttagttccacgctaaaattggaagttttactaaaattgaaagtttgaagaaaaaagttagaagtttatgtgtgtaggaaaattttgatgtgatgaaaaagttgaaagtttgaaaaaaaagttgggaactaaactgagccgtaccgatttgtgagctagaggaggctaacgagggtatttataaggcgagctagaggaccagagctaatatgttggcttgttaaatattctgagggatgggtgcgtagctgaagcatatcccttcgtcgtaaaataaactaactcataataaatgtaacattatatatactagacaccgatccacgtgacatagctattactttattaattataaatattagaactttgatcatatatgaaatatgatgggtattttctgaattatgtatgatgctttagtaagaagtccgcctcacttgcagttgctagctacaactttatactattaactctgatttttaaaattgtcaaattttataaactaaaattaaaagagtcaatgttacttctagccaagttctattttacatgtgctcccaatatcatctcggtttcaatgattttaacccatggctagatatattaattagttaagtgaaacctcttaaagtatcataatattattagtaattgatatagaggtagacagaaggacggcactaaaaaaagatgcgcgcacacggcaagtgatcatagaaaaggggatcgctgataaggataaaatatatagaggatatcaagaattaagtttttataaagaataaaatatattaattagtggtaatatatcttgtgagatgcatacaaattgataacttatcttatataaatggttttgatagttcacacaacttgattggagtatgatcaagctcaatttaccgcatggccttctaattataccgataaaatcacatcactatcccaagactgatatggatgaaatatacgatcatgccatataatatactgttgtgctgagttcaatagaacttcgcatcatcttgtgtgagtcgttaaaaaataatatgttgttgtgctgagtttgaatggataagatatgagttgtgcaagattgtacaggaagctgaaaaattatatgaaaggaagggcattgtctagtgtttgatttatatctgatcgtccgaaatgggtttatagtgatcgcttgcgtttgtagccgtcttacctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctc

SEQ ID NO: 60896 - DNA, 1937 bp, Oryza sativa
ggcgtcgtctttattctcgtccccgcgtcgtcgcccgctccgcccaccgctcacctactctgccggccggccggccgctccccgcgccgtcgcccgctcctccagctggccactccgcgcccgcatcgtgccctctccggcgatctgcttggaggggaggggagagaggctgagaggggatagagagaagtggggaagaaaactaggtttcgctgacatgggggcccacatgggtcccacaccgactcagcagccacgtaggataaaaccgggatcaaaaccgccgaaggacctattgtaactggttttatatagttgagggaccccgcatatctggttttatggttggaggacgattttgtatcccgataataagttgagggaccttcggtgtactttttcctaactttagtggggaacgaatctatatacacaagtttccaagtttcctatgcacaccaactaacaatgttatagaaatgttttaaacaaattaaacacatattttttatttattatattttagtattacacctatgtgtaaaatcctatctttaaattcattatattttagcggtaacaaaaagataaaattatctagattttactcttaaaaccggtcagattttcacttttttttgttacagctaaaatataatgcatttgaatatgaaacttcgcatatatgtgtaatactattaggagcacgtgtctaattttttctagaattttctgtgacatttgtttgttggtgtgtacgaaaaacttatgtgcatatgatatgttcctaagttagtgagcctcgcctatcgaattggtattaatgtcacgaggtgagcttagttcaactagttagtttattacttgtggtagaaccaagctactcgagtttaagtcttagacttgacatggatgctcacatttgtaggtaattattattttagtagtaagcagtgtatatatcgatattgatatgcccatggcgacttcattaatcctaaaatatgccaatccaagctttttggaggtgcttatagcggtaaggtgcgcacgcgttgtaacgccccgattttcacgtggcgttaaaaaactaatttaataaaaatcctatatgcgaaaaatttcgttctttaaatccctccttagtctcaattccctaatgtcaaaatcgtctgcccaaaatctctgtccgagaataatctcacatttcgaaccttcgtattcaaatctcctttctaaacctctatcgagaaatttccccttcgaataattccagttcagttcctctccgaagatttgagtccacactcaaatcatctccggttactccttgcgaagggctcatgattgcaaatctcaagtttggcaaattcgaatccctaacctaacttctcaagtcttcgtttcgaaaatagctttgaaatttgaatccttatattcgaattgaatccgcaaatttcatctaatgctcaaataaaaactaagtccaatgattcacctccatatcctaaacttttcccttagtccttgaaatcaattctcgattgtttcatcctctctctctctctctatctatctctatatctatctttatctctatttccatctatctacctatctccctttgaatcctttctcaaaatattcctcccaactccaggatgcaaaatccagtcaaactccctccttgaattccaactttttcatcccctcccccttaaatccctcacaaatactcctccatgtccataataccgaattccttattcggttcccttcgttgactccctatacttctttgagttcaaatataaaatttgaattcaaatcccacatcaaatgcctctcaaattcgttgaaacaactccctggataatatcaagctatttccatcagtttgggacgcctctcctcattttctctcggcccaacccaac

SEQ ID NO: 60897 - DNA, 9239 bp, Oryza sativa
gaggtggatgatagtgacattgcagcgacaacgaagtaggcaggagatgaaggaggagcatgggtgggccgtccgcggaggaccgtggttatgggcgtcgttccacgcagagtctgcaacgttgacggtgcagcgtctgcgaagctcggaggtgggccaggcatggcaagatagcgtcaggaggagctctcgccggcgtgggaaggaggagctcaccggtggcgacaaatgaggcgtacggacaacacgtcaggcgacatgtggcttcggagggacgagtggcacggaatgaaacaactcgcgtcctcggtggcatattcagaaagtgtcatgaattaagtggcaaacctagatggtgcgaatccaatgacatattctaaaaattctccacatttcaaatagagggggagaagggatttccttggagagcgagtagattgccacgctggcaagcaacatgtgctattaaaaaagacgtgaatattagggaatgacctaatatcaaataattaggagtgaggttttgaacccaggtcgtctagcgcaccacctcgtggagctagccggaagacccctgtgtgtttcttgcctcatgtgttatttaaaccataaatgcaacagtgctgtggggagttttcaacacttgagctagatgggagcagccaatgttggatttttcaacacttgatttcgattgaaaaagacaagtgaactaggacctactccatgattcaaaagttataaaagagggatatgtattttcatcactcgagatgacattccctcgttatttgtatgccatctaaatagttattaaaaattttgaaaaaaaataataacatagattaatataaaatatatcactccacgaacatacaagaccagattcaacttctacatgctgcaacaaaaagaacaaattaaatggacaatagttgtcgtacattcgcaactatatttgttattttcgttacaacttgtagaagttgaattcaaacttgtatatttgtggagtgatatatttcatatcaatctatgctgccaatttttttcaaaatattttatgactatttagatggcatggacgaaacgaggggatatctcctcgagcgatgaaatcacttttcccagcagatggacaaaagtgcaattacacatggcgctaatgcgcgaccagtcggggcgcgcgcggcacctcagctggtactaatactacctgtactactacttgcagtactaatactaccattactgttactactaggactactactagtagtagtatgtattactactactaatctacatacgtatatatatatatatatatatatatatatatatatatgtatataaactttacatacgtgtatataaactttgcatactcgtatataaattttatatacatgtataaaaattagtatatgtacgtataaaaatccagaaaatacatgtatataaagttttataggcgtacccggagtgtaaaaaaccagaaagaaaaaaaaaaaccggaacagaaaaataaaacagaacagaaaaccacaaaaaaagggaaaagaaaaaaaacgcattagcaatttcgattacacaatcgtgaaacatcaatctcaatctcgatcagtcacttaggtttgttcgttgagatttgctactgtccagcgcttggtaccccaagataccagtaccaccaggtactagatcaaatctagccatccaatgtttaggggtaggattgggaatgagtaaaaatctcttccaatattgaatcaattaatcttgttcctgagttcttcgtcaaaatggaaaaattctcattcttgaacaccgccgcatgcttgtgtccattgtttcctccctcatatgcgtgtctttgcagttcttccttgcggccggcgccgccgcctggtccgacgactcgccgccgctgccgtggtgcttgatccgacaactccacgaccaattcgctgcctcggctgccaacacccccgccgttgccgtggcacctggtccgacctctccacggccacctcgccatcgcggccggcaacgccccaaccgccaccgcagccgcctgccatggccgtcgacgccaagactggatctcgcagagtcgcaggccacacatgccacacaccgccgcggatcccgcagccctgccgtcgacgctgggatcggatctcacagcacgtcgtcgccgacgctagccctgtgatgctcgccaccgcccgaccaccgtcgaagctagggctggatctcgcaggctgcacgccacctcaaacccttgaaccccacaggccgcagctcgccgccaccgccatcaacgccggccccagacctcgccgtccgttgatgccaccgtcgatgctgaccccgcggcgcacctcgctgcctaccgccgctatcgacatcgggtctggaacccgtagtctggtgccaccgtcaacaccccaccgcgcaccccggcgtctcgcccttacatacgaaaagtctatactatccttccacctctcttcaagaaatggtaccactataagggctaaaatggtaccgcacggtaccgagcaatctcaaccgtttgatctgtcccagctaacggttaggatttggtaccgcctccctctgctgaacggtagcaaatctcttgttcgtttcgtcctcgcacctcgctcctcttcagttgctcctgcggcgcgaaccgcttccagtaccagtgtcgcgcccagacggtgggcatggactcgagcaggaagacggcgatgaaggcggtcatgacggcgacccaagcggcgtagtaggcgaaggtgccatacctgaaccggcagagcatggcgaggaacgactgcgtctgcacgaaggtgaggccgaggccgatggacacgttcatcgcctgccccgccgaccggatgtccaccgggaatatctcgccggggatcacccaccccagcgggccccacgaccacgcccgccgttgcgatgacgacgtacgccgacggcgaggaagaactggaacccggccgtgagcgagccacgccaccgcgtcggggccatctcggcgatgaagagaagagccgcctgccatttcgtccaaaaccaaacgacatgatcaaaaccgtcgtgcaacgcgcggtgcaccgcaccagcgctcgtgtggtacctagtcgccgcgcgcgcaacgtggtagtggacagtgacgccgtggcgcggcctctggcgaggctggcatgcggctatgctgcaacaggtcaccgcaccaggcaaccaccaccggtggatcagttgcaccgaatagacctactttaattcagtcaacaattcccactgcaacatacacggagtattatctacttaagcagaatatgtcaatatacagcggaaccaaattacctccatcatatcaatgctctcgaattcacccacaagtcaggacgacaatactgaggataatatttgttcagcaggatagcaagttgtcaacttgccacaagaattttgttacattctgatcaggcttaattggctatttaagcatgaattcccggcatatgaaagttatcgcgcagtcagatcagcgtagcaacctgagacctcgtgcaatccataaatggaaattcttttgaagagcgctgcctgaaaacaaacagcctttgttgcgtacgcttgcttggtgcataagtgatggtgatgaacaaggcaattgggactcggagggcaatctccttcttgcgtagaggagagcgctggagaacatcccccttctctttagctcaagctgaaaatttgatgcaccctcgattgcttcttcagattcaatttccatgcctaaagaaggcagagcagcatccagaaaattaaaagtggttggccgtctccaagcttgcattgcatcaccgagagcttgttgtcttcccatgccattcatcagatatgacaggcgacgttgcgcataaatgacaggggaaaccatagtgctagatttaatcaactgcatgcataaaaaaggagcaaagtcaacaatagctgtgaggtttaaaagcttttccttttcaatggattgatgttgtttacagacagggacagtcaagaaattgctgttttcacaagcacttttctcaagaaaatcagtagaccaaatggaactgttcgcactgtgtcatacactaattctatttgatcatgcaactcgctgacatctctcacaaacccatatagcacaagagacagagatcttaagcaaaatcaacctaagaacaagtaaatatacaacgaaagctaagcttcatctccttactggtccaaaacattatcattagttcattaacaatatacatgttagcaagtattgagtacatttcaaggagggaaaaacaaggctaaagcactcaagtcaatccacttgttggtggcataggaaatatggtgtgaacgaaacaggagggtgttccaaaatcaagagaaaaccatgtcgcaactactcatcaaaatacaagacgaaatcaaaatatggagcatgtgtggagcaaaaaacatcgcgagaatatccgcttaggtttcatttagtgtgtgtttcttttatgttttcttccctagtttcccttgtttctttctccttcaccttctttggtgatattgtaaatacttttctattctccttaatataactccagcttagcctagcttcggtttcaaaaaaaaaagtattgagtttataattacatattgtaaaaaacaagcatacctttgaggggtcaagacagaagttggttagagggaagttgcgctgtgggttctccataagcagttcaatttccctgttcaaaaaaagcaagtgtgcataaaaaaaactgagaaaggaacagaacctgtggaaacataatagtataagctaaactattcttaccgcttgaggtttctgcttgttgcttgcctaagcttcataatagatggttttgaactctttggcacttggggagctggtttcctaaaataatcagaggaaggcatatagaaattatatgtttgtatagttattctttgaaaagaactaatcaaaattgttaacttaaaggcacagtagtatacccagcacattcatcatctacgaacacctcaatggggttgacaagattttgcagaattgcagccctcgatcctaccttctgacaaatctgttcagtgaaatagtatcatcagttcattaaccgttactgaaccgataaaccttgagacatgtcaccaaagggaccttttgagttacaggttgtgaaacaaacatacattccaccgctcgtggggatgcagacggacatcagagagaatggataagatcttcaaaccagaatgaataaaacactctgcaacagagcaaagaaaaaagatccacttgcttttgagcatcttctatgcaaagctgagatactttaggaataccaatgcttaaaaatcagtaataaaggtccaaccatccacttcgcctgatccattatcatgcgatgagcacaacggaatcttcaatgaaagcctcaagtagggttgattacctttgtatatgacatcttttagagccttccagttcacgtttctcatcatcagagccattactgctggggccaatactcttgctgtcaatgtctctggcctgtgaggattaccaaacaaaagagtgggtgttattccaacacgtatcttttgtatactagtttcaaaagctattacggtaagtatatgaaagataaatggaattctgtaaacgagatgttgagttgcaaacaaggaaaacaatggagcacgcaacagcataacactatgaacagtttcgatgaaacaatgggtgaatcaaatgtcacatctcaaatcagaggatgatcgctaaataattcagcaggataaagtttcatttatgtatctaacaactcataatattgaccggtgactagtttcacatcgtcacatgctgcaaatatatagatgtcacactgagaatcaggaaattatgcaaaatcattttgttgaacaaaggaatatttatgcaactttaacaactgacaatttttgcttttaatacactggaactaaggagatgaaaagctgatcagcgtcaagttattgtcaacttcaggtgcactaggatcaaacagacacatcatatatatattaataatacatcaaaatgcaatatgcacgtcaccagtaagaatatttctgaggtaaaacataaaatatgcaatgagcccatgaggactaaaagactaacatgcttgtaacttgctcccttcagtctttctcgaactcctcctccctttggtacttcttccccaatcgatccacctccacctccccctcctgatccccctcctcccttctttcctttctttttccgcttgtcctgctttcttttgtgcttaacctcctgacgatccaatgtgttttcaaagatgggcttgggaggtttctcatgctcaaataatcctgagttaaatgcatccctgaataagatcctgacaatactaagagccgattccatagaatctatgacaagtttctcatgcttgaatggttttggctctaggccctgtttcatgaggtcaacattttccattatgtgagcagaaattttcttgtacttcttcacatacatggggttggagggatgtttccccaatttgcttaaacccggattctcagaaaggaaagaatctttgatgtagtcatgcaccgggcgtaatcttgctgcctcagatataatcacagcaaatattgcaacatcttctgatatatttatgttttcaccaccagcatgcctccagaagttgtcaaatgcttttctaacaggccatagaccagtgggagtattctcaacacccccgaaaacaagcttgttatagttcaaaccagttttgagtctgatgcactttgggtccagagtgaagttctcatgttggtcatggttaagctcaaaaacacaatcccttgctttccatcctctaaggtacagatttcttccctgtatcaagaatcttatagaccgacccatgtacacgaattccacttccattgagcctccagctcttgtagtgaatacctcatggcactgtccacaaatatctgagatatccaccttaattccatcttcatatgaccaattaattacctcttcaatgccactaagatagcttgctaacgcttccttgtcagttccatcaaggcaaattgtggtcacatgctttgaggtgagccccctattcctgatctgctaaacaaaattacaggtgtgtacattcatatatggaagttaaatgagtaaactagcaacttttcaacaggcagtgctgcttaatggtcagttgtagttcattagggtatatccaaactcccaatcctgtgaaagattccaggcatattaaacttccaagttcagagtaacaatgtggctgatatatagccttgcaagttaactgtaacaatctggctgataaccttgcaagattataagcaacagcagcaaaactatggactgctgaaccatattctgttctcacatttttggatccaatatacagtctaatactctgtcaatagtgttttctatcattctctgacaatactgccgtaccaaatatccatattgaccagggcacagttattggaaatcatatccaagtaaaccaatcaccataattttgtatggcatttccctctcttaatataaaaccagcaagatctaggtttcaaaaaaaaaaaacaatcaccataatacaattaataggaacgactgaaacgaattcaataggttgtcctacctaggaaatttatgcactaattagcaagacaaaatcagttcggcaggtggatcataagttgcacatgctcagggaatcttactagcgctgcacataaatcggaaacaaaaatctctaataatgcacaatcaacatattatcgctaactctgtatcatgaatccgctgtggataaagtaaaattctgccgcggaatgacgtaagttctgtttccaaaatcgcatctaagccaattggtattcgataccgcgtcatctccgctccacggctgaacacaaacaacaacgaacggttaaagggggagacgattacctcgctcgcgtgaggaggcggaggcgagggccgtgagcgccccatcgtcaacgaatctgccgggcgatagcggcgtcggcggcgagaggttgctcccgtcagcgccgagggaaccctagggtttgagatcccgcacgcaatcgttgctggggcggggcagggcggcgaaatggtgcgcgacggcgatcacggagcaggcgaaatggcgaagagggggctcggaagaatgccgctgcgcttgtcgatgcaatatgcttgagaatgggggagttgggtctctgggcttcgttttcgggcatcgcgagattagtgggccgtccgtactcaaatgtgacataataactttagggaaaaagtacaccggaggtccctcaacttgttgaatcgtccttgaaccacaaaaccagatacaatgcgtccctcaacttataaaaccagaataaactagatccctgaacggttttgactccggttttgtctgatatggcagatgactcagcgtgggacccacgtgggtcccacatgtcagccacttcttcccctcccctcaccatctctcttcctctctcctcccctctccacggcggctgcagagaacagatgggcgttgcgggcgcgggcagcggccggcgagggaggagctgccaccggcggcggcggctctacgccggccgacctccagctgttgcatctgctcatcaccagtccgcggcgagacgacgacgccgcccgacgcactatggtcccggagcaaacacccgcacgcggagcccgacgccgccgacatgccaccgcccacgaccgcaaaccgcctgcagcagcgcggccctccgcccctcgtctgcctctttcgccggcgccggcggctctctgcgtcttgcagagcctctcggcgatggtgtgccccatgtgcattgacaggtgacgagcagcctcgtcgcggcgacatcaagcgcctccgtccgggagctccacgatggagtggccctggtggttctccctgacgaccgagaccacggcggcgagcgaattggcgtgcgcggtgagcgcgacaggacacggatgatgctgaggttgagcttgtgaggaatgaagcacttgagcatgtggatgaagtcgtagatgg

SEQ ID NO: 60898 - DNA, 1015 bp, Oryza sativa
attgaaaacagaacaatgtgatttttgtagaaaaacatgataacagaggtttttctttgagtacattttcattctcgaattttaatgatgcttcttttccaattgctggcagattctacattttctttaaaccatatagctgctgaagttctaataaccaatgaacccctttttcttaattatcagttgcattctagcagcagaagtttatttgctgtatatttcaaattatgtgattaatattgaaaagagatggttcattgtatttgtgtctgtatgagagaaccaaatgaaaccttctgtccgtagtttgttctatacttctatatttgagcacagattacatagtgaactcttcttatgacttaacactagtgtctttcactggaggcctggacacagtttgttgtttggtttactggtcaagctttagacacattgggtattttcctgtcaatgtctctccagcattataatttaaaatactatgcttatttttgttatgtactctggtagatgcaaatgaccagtatttaactggcaggtaactcattaagttatttcacaggaagagcaacagtgtatggcatggaaaagacttttggcatttgaaaagtgagtaaacatatgcatgatctaattcattaagagtcacggtatctctttgctgtagttatataagctaatctttgttttcatgttctttttctaaaaccctgtcccaaccaagtaaaattgtgtatgcttcttgaatttattcaataacttgagcctcactggtcactacctggtgcaattaagcatatgagtttttcaccagccttcaggccctaggaattcttgtttcctgcttaatttctaacttgcctatagctcagaaagaccgaaactatcccttcaaattcaaaatatgttccattgcagggggaaccctcagaggattgatgctacaactgctaataggcgtgttacctttacatttgaacaagtaagccattttcttcctgtatgctta

SEQ ID NO: 60899 - DNA, 2155 bp, Oryza sativa
cctaggtcacgcggctcacgccacagccgcaccgcacgggatgagtggatgacgggaggggaggggaatggatgtggggaggagagagactgagggatgtgctgctagggttaaggatttttttagtgggctgggctttttgggctttctttgatctatattttgaggtctatatgtactccccgggggcccgcgggtcacccgcgggtgaaatcagtcccccgtcccctccccgcccaaatgcggggccccgtccccgacgcacccgcgggtcgaaaatcggccccgcccccgcccccgtaggggcgggtccccgcaggggacccggccccgcgggggaaattgccatccctaattatgtctaattctgcccaacggtgatgtaggctaatgcatattattttaatgttaatttttgttctcaccgtacgtgattatttcaggtggctactccttgatgggttgcattaaagatattccgaccctgaaaggagataactacgcagaatggaaaagaaaactcgaccttgcttttatcttgggagaggtggactgggtgttgactaccccatgtcctatagaacctgctgaacttatcagaggtgaaaatgagtcagatgctgactggcaaaagagacagagggacaatgctcctctcgtcatgtcgtatgacattgaacaaaagaaatggtccttagccaacaagaaatgtttggctgtggtaaagaacacgattgagccaaccatattgggctcaatcccagagtgtgacgcagtctcagattaccttgaaagaataaagagtcagtttactggctcttcaaagacttatgctacacaactgatcaagcagcttgtgacagaaaggtaccatggaggtggtgttagagaccacatacttaggatgagcaacatggcttcaagttgaagccaatggatttgggcataacagatgactttatggtccatctggttatggcctcattgccaaagcagtttgacaattttattgtcaactacaatataagtccagagaaatggaaatttgaaaagctcattgctaattgtgtgcaagaggaggagagaatcaaagagtcaaatggtggttcaataaactatgttaaagataacaagaaaaagaaccacaagtctcccacctcaaaagctaaacagtctcagcatctgcttcagcaacaatagttcgctgttgagaaagatcagtgtctccacagcaagaagacaggacattacaagaaagactgtcctgacttcttgaaaatgatcatggcaaggaaaggtgagaacattattacatttgtaaatgaatctcattatgttggttactctagatccacatggtggattgattctggagcaactattcatgcttgtaattgtttaaaggcattccgttcgacaaggactacgcaaagaagagaaagctccattagagttgccaatggagttgaagaaaaagttgaagctgttggagatcttcctctagagattgcgaatggcttcacacttttacttcgagatgtcttttatgttccttctttgcaaagaaacttaataagtgtatcaaagttggattttgatggatatgattgccgctttggaagtggcaaatgtgaactatggtataataatgcatgtgttggtcttgctgtgttgcgagacaagctttatttgttatctctttctgagaatgtgaatgttgtgtcctcgttgacaaaagaaaacaagaaaaaaaagagaactcccgatgtctcatcgaaattatggcactgtcgtttgggccatattttgagggggtgaattgagagactagttaagaatgaaattcttcctccattggagttctcagacttagaacaatgcatagaatgcattaaaggaaaatttataaagagcatcaaaaatggtgcaaaacgaagcgcaggaattttagagatcattcatacaaatatttgtggtccatttcctgtgaaaagtgtggatggctatgactcgttcataacattcacagatgattactcccgctatggttatatttatacaattaaagagcgatcagaagcattggataaatttaagatattcaaagctgaagatgaaaatcagcatgatataaagattaaagtagtaagatctg

SEQ ID NO: 60900 - DNA, 662 bp, Oryza sativa
tcgagtatgtactcaaaaaactgcatggatcttctagtattatcaggatataacgagcagattaaatatcaggcattatgtaaaccgtaaacaagcatgatttatacagaagaaaatagagcgagcccccagcgttagaccgtagttggcctatcgtcggaagtactcgcacaacggacattgtataaaaaacatgctctaggtaaacataataaattattgatctgacaatactgcatgatctggataggtacgataaattgcatataaaatattgcgtacctgtgtagatatatgccggatatatctacggaattagtagattgattaaattaattaatctactaattaccttaactagccttagtagccattgaattgtcttcggtgcatgtatatgatggcaaaccaatgcatgcctgggcacgtattgagtctgtgcatatgcatgtgcacatgtcagaagcgatcagtacgtggcgatgtcgggcaatggtatatccggcttgttactccgagtctaaccaaaaccgcacttaaacccgatgagtgtagtagtcggtttcggtctctagaggtgtcggcgtcttgtacccttccggcatcatcctcaagatcgtcaatggtccgaaataccgtacagatgccctccgcagcggtgg

SEQ ID NO: 60901 - DNA, 1322 bp, Oryza sativa
  unsure (1)..(1322): unsure at all n locations
tcgatcgataggttcagatagcgcagtgtacttgggcaaagtgggacagaaagaaggaaaagaagtcagatcctggatgttggcacgagggagcttttcggtttcatttgacttgcagctctgctccgtgaaatatgcagtttctggtcaggcattgcggtctacgactttacggcagcatctcatggtcttaaactttgcattttctttttttctttagtacaaatcaaaacgttcatagcgtcggtcagatgtgctatatagttgccaacacgaggaagccgcatagtatttaccgaggactgaattaatcttttttcgccgggccagtagcgaagaattgcctctgcggattttattatctatgactgaattttaccctcggttgtaagttcaagccaaggaactagcaaaactcaagagaatttctgttcgatcccatcattagaagtgaaaaatatcgaaaggatcgaacagaaattcttcattagaagtaggcaaggtgtatgcaaacaaaacggtattaatcaatgtctttttctatttgatataagcttttctatacacagctgcagggttatccactgaaatttctacaccacaagatcgtttcaacaagaaaatttcaatccctatcgaaacaacaacacgttataatctacttagccggaaaaaaaatcaccggggaaaaataatatctctagtttacaagcgaaataaatctacaaattgaactgttgtatatattagcaaaaagaaaaaaagaattgctgtatatatgtctgtgttacaaattagctactagctagcttccaagccatcttcaccatcgatcaccatcagcatccgcagttagnnncgtttggggctgtaggtcttgcaggagtgacctggaccagcaagcttgtgcagatacagctgccggagaaacctgacgacgacggagtcgtcgccggcggtgtcttctccggtccattcctgtcccaccaatggccgcgccgccgcggtgccagacacgaccaagaacaccatcaccatcacgatcagtgacagaacaagcttcctgatcaacacggccatgatcttttacttccctttcgccgctcttctccctgatctccttctgtcttttctactcactttcactaagaaaaaagctaagaaactttactgaactttacaatgttcttctcaaaattctgatatgttcatcactgaattggagcaagcctatatatagatattagagtggcaggcggcggttgcttgctcggtacggtggccacttgaatcggcgttagtaattggagggctgcaggaat

SEQ ID NO: 60902 - DNA, 39484 bp, Oryza sativa
tgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataaactagaggacgtgctcagtgctcagctcagctctcctcctcggcggcggcggtggccgtgctgatcttgccgcagacgctccgctcggcgtagagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcctcctccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgtaagattaaactagcatggtggcccgcgcagattgcgcggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatgtcaaattttagttatttgtaaattatatatactcctatatgtactctagacttgtcttttaatacttcttttttttaattctgaattttctgtaaattgtatttctatatagactgtttgctcttctttcaatattatttatttttatttttgaattgttattattactaattgcatttatatgtggactctaaacttatctttcaatattctttaattttaatttcgaatttcagttacttctaaattgtatttctatatttgtattcctatattgaccttaaactcttcttcccatgttattcttaatttcgaatttcgaattttagttatttgtaaattgtatttttatacatactctaaactctacttttaattttattatatttattccaaattttagttagttttgaattcctatatggactctatactctacttctaatattccttattttttaattctaaatttctacttttttcttaattgtatttctatatggattctatactctacttctaatattccttattttaaattgggtgaatagctaatatgctccctgaagtttcacttcgggctcagtttagtccttgatgttttaaatcgtccaaacaagtcctccaaattaatcatttgagttaatatagtgcttggacccaaaaaagtgccacaaattaattatttgggttaatataatccttggacccacaaaaagtgccacgtgagcatgtcaagtcatcctcgcatgcagcggtatgaatgaaatgaacattctacccttatataccatataaaaaagaaaacaaatatttcacacatgtatggacattttagaattgtcacttacgattgctgcagcctaatcgtataaattcctttgtcggccaccctccgcaacaatgttgggcctaggttagctttttttttgtgtcttttatttcttttctatatagtatataggggtagaatagtcatttcattcatatcgctgcatgcgaggatgacttggcatactcatgtaccatttttttggtataaggactatattaacccaaataattaatttggaggacatgtatagacgatttgaaacctgactaaactgagcctgaagcgaaacttcagggaccatattagctattcaccctttttaattccaaatttctattatttcctaattgtatttctatatggactctatactctacttctaatattccttatttttaattccgaatttcagttatttccaaattatatttctatatggactctatactctacttctattattccttatttttaattccgaatttaagttatttcctaattgtatttctatatggactctagtctcctcttctaatattccttattttttaattctaaatttcagttatttcctaattgtatttctatatggactctagtctcctcttctaatattccttatttttaattccgaatttcagttatttcctaattgtatttctatatggactctagtctcctcttctaatattccttattttttaattctaaatttcagctatttcctaattgtatttctatatggactctagtctcctcttctaatattccttatttttaattcagaatttcagctatttataaattgtatttctatatggactctgctttttctttttctccgattaatgtgagaatttctaggccatgagagcgaacgtggaggctcatttttctattcctttaataatataatagatgattagtgtactgtttttttagatgaatgtgtcgttttttatgctttgattagacaacaagttgaattcaagaatgaggggatacaggattcttcaacggatcaatcgatgaatcgatcatgtgatgcacaaggatgatgtatcacgtagggggatttaagtcaaacaacgagcttactgtatattcaactgctctgctctagctggcctgccagtagagcacaatagtgctcagatatgatcaccatctatgcatcttctgttttggaggagttgaatttcattctatactcggcaatgatttttttaaaatttaattattactctttttctgtgaatcatgtgttagaaagctgcattaatggcccagctcggtgttttgtgattcacatttcagaactttaggacagcttcaaagtttaccaacattatctagtagtatagagtaggacccaagacatgtcattcatatttgcgaatggatataggctatgtttagttcctgaaaaaagttagaagatgagggaaagttggaagattggaaaaaaagttagaagtttatgtgtgtaggaaagttttggatgtgatgtgatgtgatggaaagttaaaagttggtgatgaactaaacacggccataaacgtcaaatctgaaataagtggcgaacacaactttaaaatatagatgggatgacatttagcaaggagctagccctagttcgatgatggcacatcacatataaaatcatagtcaccggctcatggacccggcacggtgacacaccgcacaaacatcaagcaagttaacaatgaaaattaaccggcgaacaaactcggagttaggtaggtgaggtactaagctagtcatgaatatgagacagtgatgaagaccttatgtcagaaattaaggatgaaaatggtcaaaccaaaaattattaatttagaaacaatttacaaaattttccatttgtaaaaaggtcctttttactctcctgttccgtactatttcatcaaatcacttaacctctaaaatattttatttcttattgtatccctaaactaataaagatggtttgctttactaattaattgcaattttgttttttgtttctctttatacaactcgtaaaaaatgttaagccataaacgacaccataaccaaagttctaaaatattttcaaaattagtgcttccaacctatataaacaatgataaaaaaatgttaacaagtagattataatggatctaccaatcctattaaatttcaatgcaaatatgccttatatagagataaaaaaatgagaaatattgttagggtgcgagtgaaccatcttcaatagttcgggttgtaaaataagctaaaaaattatttagaatgaccagtgctccaccaacatagttcgaggcagtaaaatagaactttttaaatatatttaccaatttaactatttagtatagactaggtactaaataaataaaaaaattcaaattttatgtatggcaaaaatggggaacagtcaaaatagtaccaattataaaaaataatacttattcgaccgtgaatttccataaatatttttatccctgttcaaagtacttgatttatctaatggtttgaaagtgggctgacggctaatgtgctagaaatgggctctaagggtgtgaggcggtacagaccgtagctggaccgactgacccaccccgcttaatgggtgtgtccacccctatccgaaatacaataatactttgcttatctattggaatgggaaatcctcttaaaatttgcctaattctgaatagctgggccaatttacgcttgcctcgaatatgaaacctaaaggcatttggaaaacaataaaatgtgcctatatatacttgcagtggcttagctgctccttggactagatcggtataactacttgaatatgaatcagtgagggggcgatgtatcctagctagctagaacgaatcacttacaattggtggccatgtgatgcacaataagaggaccaaacaggtaacacaagtgggatacaaatgcttatatataaccttacatcacctatgttatctgaattagatctagtctttctttttgttcttcttattcttatgtgaatcatgtgatagaaagatgatgaattattaattgcacccaacataagtgtgaacatatcctatgcaagcacacaagctttctcgtgtacataccgtgcacaccaactaaaaaatatcatcaaaaattctaaaaaaaattgtacatgtagttttagtagtatcacatctatgtatgaagtctcatatccaaatttattatatatagcgagaaaaaaagatattatttttgataaattgatattctcaaaactttcaacaatttatctttatgttacggtaaaatataatgaatttaaggttaagactttatgtaacactattggaaatacttgtacattttttttagattttttgataaaacttattagttagtgtgcacgatgtgtgcaaaaaattcttgtgtgcacatgatttatatgtttcgaacacaaatagtccaatatattaattatatctgtgaagtttatgctacttcacaagatattggcatgcacgcttgcatgtgaatggatctaatccaactatatttttatccgagtttatgccgagtagagtgcatgatgaagaggagagaacattgatgcaaaaccgcgcttgtttgaggcatggcacgaggaccttcgactgaggctgccgaaacctgataggcttaggcgaagcgccagctgaagaccaaggttttcgccttaggtgaacccaatgggcgaacccatcgggcgaagcaggagggattcgccatcaacctagatgccatttgctacttgagggccaattataaagcccattaaggagcccatgaccaaatagacactagttactctcataagtattatcataatggcataaaatttgacaatttgaccctttgcaaaaactaatttcacaaatgaacaatggccataacttatttcaaaatgacccacaaatgaacaatggccataacttatttcaaaatgacccttttgttcagcgccacatcgtatggcgctgaacttagacacctcagcatcacgtcaactggcgctgaatactgtgccacagcggatgggaggctgagtcggcgtgctaacgtgcattcagcactgtgctatttggcgctgatatgtctaagttcaaggccatatgatttggcgttgaacaaaagagtcatttttaaaataagttttggccgcggctcatttgcaaaattagatttcggaaagggtcaaattatcaaattaaatgatcataatgttatccatgtaaattcccctatacacattaagtctagggtgcatgaccttgtactaaggctataaatagtccctagagacatgtaataggggatcccaaaaaattcaatcaattaatacatattgctttacttactactatgcaaaccacgtctttcgacgtgcgcagttatcaatcgacaaaagtgctgttggtacaggaatcaatcataccgtaatatcccggttgtaaaaagaatgaatataacacaaaaggctcatcaatatatgtttattccagcaaaatctacacagtaaagttacattttcgccacataccaaagtaattaacccgcactgcttatttccacagcgaacgctcaagcagttaagccgaaacagagaccgaagcggaagatcgatcacaacaatataaattgagaaaatccatgaaatgctatcgacaggcattccaatcccaaaaataccatcgacaaaagcaacatcttaaaaatgccatcgtataagcatttttctcccagaaataccatcgtcgtcaatctaccgttgatttcacaccgttacaatttaagaatgaccaaattgccctcagtccaaaatataccctagcattcacggtaaaaaggaaaaagataaagatgaaatggggaaaatgtctagacccgatccaggcggctctatcggcggcggcggtccatggtggcggcgcggcagtcgtgggggcagcggcgtggaggttgctggctgtggcgcagggtccgaaggcattggcgtgggggctgtagcggcgaggaggccgcatgtggcggctcgacggtcactgggggcagcgaggaggccgcagtcgccggtccctgaccgccttcatcgccgtctctcaggtgctgccgacggtcacctgaagacccgacgccaggacccagcggtgactcctccatctcgggtccgacggcacccagatcgtcgcaccctcgcatcacccaggctccgcccatcgcgccatccccacgcccatcgagcagtagcgccgctgcccatcacgcccttccccttggccatcgatgacctgtgatgcagtcctgttttttgggaatctgcctgtcctcctattgctgcagacgagaggccagaaacaggtcaatagctgcagacgatggtatttttaggaagttgtttttgtcaatggtatttttaggattaagatgcttgtcgatggtattttatggattttctcgtataaattacatgacatatcacaagacagtattgcgcaaggatgcacaaatttaaaaccggaaagaaatgagacagacgtatatatatcgctgcattatttgagccgcaacacacagcaccgtcgtcgaagccagcgtctgatctgctctacttgcagacgcctccactcggcgcagtgctgctccggtggctcgccggcgagccactgctcgacggcgaactccacagtggagcacgatagatgtcggtgaagatcgagcacgccggcggtgtcgtgcgttcggcgtcttcagcagcatcgtatactgattggccgtgcatagacggtcccggtgacccggtcccggtctctgctgcatcatcgccacggtcctcgggtcccggtgtacagtacacgcacccgtacttctcctcgccggcggccaccaccaagtccgggaccgccagcgtcaataacgagactagctcaaaacaaactaatgtgtatatacgcgcgttcatacgtaccaagatcgccgtagcaacgaggatggcaaagcagaacagcagcttcctatttgcagccattgggtattgttgaaccttcaacgagtagctaggctcgactgactctagctagtttattttgcacttctgttgaggctgtgtttagttccacgctaaaattggaagttttactaaaattgaaagtttgaagaaaaaagttagaagtttatgtgtgtaggaaaattttgatgtgatgaaaaagttgaaagtttgaaaaaaaagttgggaactaaactgagccgtaccgatttgtgagctagaggaggctaacgagggtatttataaggcgagctagaggaccagagctaatatgttggcttgttaaatattctgagggatggtgcgtagctgaagcataatcccttcgtcgtaaaataaactaactcatgataaaatgtaacattatatatactagacaccgatccacgtgacatagctattactttcttaattataaatattagaactttgatcatatatgaaatatgatgggtattttctgaattatgtatgatgctttagtaagaaagtccgcctcactttcaagttgctagctacaactttatactattaactctgatttttaaaattgtcaaattttataaaactaaaattaaaagagtcaatgttacttctagttcaagttctattttacatgtgctcccaatatcatctcggtttcaatgattctaacccatggctagatatattaattaagttaagtgaaacctcttaaagtatcataatattattagtaattgatatagaggtagacagaaggacggcactaaaaaaagatgcgcgcaacacggcaagtgattatagaaaaggggatcgctgatcaaggataaaatagatagaggatatcaagaattaagtttttagaaagaataaaatatatagaaaaggggatcgctgataaggataaaatatatagaggatatcaagaattaagtttttataaagaataaaatatattaattagtggtaatatatcttgtgagatgcatacaaattgataacttatcttatataaatggttttgatagttcacacaacttgattggagtatgatcaagctcaatttaccgcatggccttctaattataccgataaaatcacatcactatcccaagactgatatggatgaaatatacgatcatgccatataatatactgttgtgctgagttcaatagaacttcgcatcatcttgtgtgagtcgttaaaaaataatatgttgttgtgctgagtttgaatggataagatatgagttgtgcaagattgtacaggaagctgaaaaattatatgaaaggaagggcattgtctagtgtttgatttatatctgatcgtccgaaatgggtttatagtgatcgcttgcgtttgtagccgtcttacctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctcgcctcctccgtcgtcatgctcctcctcttcgtctccgagctccgtacgcctcctcgctctcccctccctccctccctctcacttccgatctagttccgctgctctcaaccctagcctccggatgggtgcctttggagatccgatggccatggatttgagtatttgaccatgggggatatgctggacgagggtttgcctgattgatttaattcggtgcgctagtgaggtgtgggccgttgttgcattgtggttttgcgttttacggcgggaattcgccctcaccgtagagatctccttgactgttttcgaggatctggttgatgaggctggaatcgagccactatttcgactatacagcgttgagttttgcttcatctggttgttactggcttactgctggtatattgcattgaagaatcatttgttgctcaattctgttacatgaataattggacagttcgtgagcttctatttttacttttgttgtgctgtgcttggttaagtatgcgtgcagaacattctaccattttggtattaatgtgttctcacaactcctagggactccataatgaatacgaagatcaaacttgcatgcataatgttcggttccttgtgtacagagaaacttgagatgctgcagaaatgagttaaaccgaacttttgatcatcatcagagttccttaatatttactatgtatgacaaaatcaaattagtccaagaccatatcattaaaatgaaaaagaggggctgtttttataatatcatgttttatttctgagtgtaaaaatatactcacaatgtctaaatttgcttccatatcctagtgctgttgaacattctttttgtattcatgattcatcctgtgctcagtagctaatgtttcaccatacaggattatatcttcatgcggtcacagaaacaacactaagggttgatacctcaaggggagaaacacttcgcataaatgtaatgaccagctttaattctaaatctttgattgcatctgattatattctaaacctttcttttttatttctaccaaatattgagaaactttccgttcctcatttcttttagataattttctcaccgttgttccctttttcctttctttttttgtttttcttttttgccagttagctcatctgattatattcagaaatttctctcttctatgttcgattgttaccttctttactgcattctgttcaggacacacgttgacatatacctttggtatgattctaaaaatgcagtttgatgtcacctttccagcccttcagtgttctataataagccttgatgcaatggacatcagtggacaagagcaccttgatgtggtatgtatctgtgtgttgttattgttgctgtatgtgttatggttgatcactggttgttgcagacttttagtgagtagtagctaacacagctttgtgtaatgctcttatgtagaaacatgatatattcaagcagagaattgatgtccatggtaatgttattgcaactaagcaagatgcagttggtgggatgaaggttagtgcttttcactgtccttaagaacaatacgctcatgatttttagaatatagtaaggcgttacttcaaagtcccatttatgaattaatcaaaatcataactagtatgaatgcattttgtcatggaaatgccttaacagtcctagattcttaacgtgaagctaacgaggactggttatttaaaattgtaccatatctgaaatctgagctattaacaagataacataacatatatcattttccataactatgcaattaagtaaattctggcttgtaatgtccagatcttgatgcatttcgttaaccctaaagatgcatgtttccttgtttcttattttttacaggtggaacagcccctacagcggcatggcggcaggcttgaacacaatgagacctattgtggctcttgttatggtgcggaagaagtatgctcctcttgcttttagatgatatttcgtcctgactcgtatctctactactttaaaagcgaagttgtcccccttagcatctgacttcacccacatcccccccccccaaaaaaaataaaataaaattaacaacaacaataataataatcataataaaatgtgtttccacgtgaaaattgacgcagaaaaaccagatagaaaaagaaaaaaccattcatccgttttcctctaaatcctattcaactcaagggcatgcaactagcactatacaaaagttttactgccctgtggccttagcgaaaaagacacacctgatagtgatagtaggggttatcagatataatttgcttgggttagaccatttaatttttttagctttctgttttcttctttatttgcttactgtacaatggattgccctctgttttgcaaccttggccattactcctttgtgttttttatgggatattgttcttatattttagctcactagtgccttatatgctgatctcaataattccagggttcttttctattatctgtttcttatttacatgaattagattgttatatagtgctccgtatatttggtacatcagtcattcttccaggggtttcactgaatatcttctttcatttaatttagtctgatgagcagtgttgtaactcgtgtgaagatgttcgagaagcatacaggaaaaaaggttggggtgtatcaaatccagatttgatcgaccaggtataaaatctttttttttattatgtgctataactatgtacctgcatatgtaacataagttgcatgctgtataactcgtgttccttccacctaggggcattttattttgcctgatatgcattgttctgtagtgcaaaagggaaggcttccttcagagtataaaggatgaagaaggagaaggatgcaatatttatggtttcctggaagttaacaaggttgctggaaatttccactttgctccagggaaaagcttccagaaggcaaatgttcatgtccacgacttgcttccattccaaaaggacagcttcaatgtaataatacttgagcatgatttctaactgtgaatactggcaggcaggaaaattattgtttccatgtgaacattctttctttaatattccaacttttactttattctttatgttccaggtcagccataaaataaataagttaagttttggacaacgctttcctggtgtggttaatcctcttgacgggtagcttgtttttctcatgttttcatttcattgtgtccttttctatgtttattagaattaagtgcatgcgcctaagaataataaaagtgatactaaacatttctaagatctctctgcttgtaaaatatcagggcacaatggatgcaacattcatcatatggaatgtaccaatacttcatcaaggtctgtcctatactctttaactatcttaggaaaaagtatggaatgctaaatcatgttgcttatttcattgcacgtgatattatagcatgatataggaaatgtgatgataatattgtgttttttttcaggttgttcccactgtctacacagacataaatgaacacattattctttcgaatcaggtaatgccttccttttttccctcatgtgcacaagtatcgtcaagttcacctatgcacatgtatgtatggatggatacgattttaaacatatcttaaaatgctgttattccttgctgcagttttctgtgacggaacattttagaagtagtgagagcggtcggatacaggctgttcctggagtatttttcttttacgacctttcgccaattaaggtatcgttttgaagtattttctctgacgctgctattagactggcttcccaatttgcatcatcttctgtgttgtcttttataccatattttccttatatgaatgggaaatcagtgttcatgccttcaatgtttaataatacatcttgcagtgatattactgcaacaatcatataaacctcccatcgatgccttttgcaggtcacattcacggaacagcatgtgtcatttttgcacttcttaactaatgtttgcgctatagttggaggtaatatttcccttgtggacattgtcttacacttaatactcaattttattaaactgtatatgtttcatttaagcatttgatattttaagcatcgaatttctttttcttcaaaacctgagatatctacatttgtgtctaagaacaaacaaaatgtagctgctgaagcaagtgaacgatacctgaagttagacatatgtcttgccatttagtctttgtatatttctctttgttttgtctaatttagtctactcctgaacgatgtgcaaaatatgcaactttttttctgtcagctctaggggccatacattattagaagctatgaaattaacccaggtcatcaacatcctagtaacctaaggtgcctatcttcttgatgtgcaggcgtcttcactgtttctggaatcatagattcatttgtataccatggccagagagcaatcaagaagaagatggaaatcggaaaattcaactgaatattgaatgtagccttcctgttggtactacccacaactcattccattttcaggacttacttttgaagaactattgtcacagtagggggcgaggccgctccaagttcaaaaaacgccagtgaaccaacccactaatatttctcatatgctttctgctctgaaactattgattcccgtgcatagtttataaccaactggtcatcaaagtacaagtgacttggctgcttgcttccagcagaagctacctgtaaaggaaatggttcatctggttatactgccctggggcaaacggagcatttcagagatgctcaattttgtacaccataccaggaaacattttgtgtaagctgcatttttttttcttttgttgtaaatcggtgactccgtgttaatgagctcttgcttctttgtagaacagaaaattttcctgactccgtgttttatacatcatattcttttacttacctgtagctttcacatgctaggtaaaagaatgtgtaattatttcgaggaaaagtttcttttctcccttgctccccgttctctacaaagtttactgtaatcggtagaagtcaatgaccattgtattagatataaagtaaccatgtgacggtgtggatggtatcccataatgaatgcaccatgtcttttgctccgtccgtcataaaaaaaagataagtatttatgaatctggatgtctagaacttcatgtttatatattttttatattcaaggatggatgggtgtgctgtatatacttgttgtaattaagaaggggccattttgagtttacttaccgtgcaaattgaattttgttactgtttggtacttctatttcctgtccactttctttgtcttgaataaaattatttttaactataatttttttaaaaaataaatttatttttgagtaatcattggatgaaagtaaaaaagaaatgcattggaagtagataaagagagataattatattaaggtttgattaagttaaggtatttagtttttttattggtacgtgtgagatgaatgaaaaattgagtgttttaagatggacgaagtatttgtgagaagtgcacatgaactttctctgcaagcgcttctattcaatgaacataaataattgtattcatttgctcgttcttaccttcacataaccttacctgtttctttaacaaagctacagagctagtactaatgtttagtggatgtcgatgaaatttgttcagtccatacgtacttgatctgtattcagtgaagtgcctaatagtattataaacaaaataaaatgtattttattcaaaaaataaaaaagaaacaacaataagaaaaaataaagcgaggaagaccatagcatcgtcgtccgcaccaaaccaagcaaactccatctcatcgtcgctccggtccccaccctactccaccaactcccgccgccgccgccgccggcggtcgtgcgctccgggccgcagccatgcacggccgccgccacctcgccgcctccctggcccgcgccctgacctacgccccctcccgctccatctcctccaccccgtcgctcctccaaaccctcgacccgtccacgccctcccccgcggccgccccgcccaccgcggggcggctcgcggagctccggcagcggctgcaggcggacgcgccgtcgctgggggacttcacgtactcggtggaggtggggacgcggaagaagccgctgcccaagcccaagtggatgaaggagacgataccaggcggcgccaagtacgcggggatcaaggccaagctgcgggagctgaagctgcacaccgtctgcgaggaggcgcgctgccccaacctcggcgagtgctggtccggcggcgagaccggcaccgccaccgccaccatcatgatcctcggggacacctgcacgcgcggctgcaggtaagagattaatcctcttcttgttgctgcttgcattagatgtagctgggctgctgcttagatccttttcggattgtacatggagaccttactatcatgtctccgtaatattagagactttatctgtagagatagaatgaagctttctcatatgctatccatttcgatgaaatttcacagattgatgtccttgaaggtataacttgagccatgttagtgcaaatgatgtggttattgtatcttctagtttattttagttgcttgtgctagattatgtggatgcttgagctctgcttgtgatgtaaaattaggtcctatcatttgtgcattagggatgttagcaaaaattgtagaaataggcaaagaggtaattaacttagtgtagagaaatcatgagggatctccagttcttctgtattttcgaataggttgttttcttaaacataaatcaaccttgttggaaatattttgagcataaatttcaaaaaatatcagaataggttgtcctgtatgatgacaatttcagggtactgtctctttatctagtactatccatgtgaccttgtatggaaagaagtgttctgtgttattattgttgtgatttgtccatgaattccagttgctagtttaagatttgctgatgttgcactctaccttctcgtgaattggcactaaccttttagacaaggtattgcaagtcttctgttttgatcgtttagtgagttggcaagtcattgatttgcaggttttgtaatgtcaagacctcgcgaactcctcgccaccagatcctgatgaaccttctaatgttgctcaagctattgcctcgtggggcctggagtatattgtcatcacaagtgttgaccgcgatgatttacctgatcaagggagtggtcactttgctgaaacagttcaaaagctaaaggtgttgaagccagaaatgcttattgaagcacttggtaagtgacatatttctggtatattgctttgttattcggtcagtatattatcagtcctctgtctgctaatgttgtgcttccctatattgtacccttatgcaagttattttgcagttcctgatttccgtggagacccagcatgtgtagagaaggttgctacttctgggttgcatgttttcgcccacaacattgaaacagttgaagagctgcaaagaaatgtgagagatcatcgtgcgaacttcaagcaatcaatagatgtcctgaaattggcaaaagagtatgctccagctggtaccctcacaaagacatcaatcatgctgggttgtggagaaacgcctgatcaggttatcagcacgacggaaaaggttagggctgctggtgttgatgtaatgacatttggtcagtacatgagaccatctaaacgtcatatgcctgtttccgagtatgttactcccgaagcctttgagaggtatcgatcccttggtgttgacatggtacgtccgtcttcctggaagttttttgcatcattcaaagtaaaatcaagtattggctttcattagtaggatacatagtgtacatggcaaagcttaatttactattaacatcagattttatcacaataaagaagctttccttggcatcctcatgtagactattagctagtcaatctttattagttttcaatgagggatatgataaacagaacaatacaaccaatctaaatagctgtttatttgctctatcatttggtggaccaaacttgattttttgagaacgtaggcacttgctttgtcatacaatctgcctccatgctcagttattcgtctaacaatcttaactccagggatttgtaaatctcgactttaaatttgggctcctttggaagaaaggatttttgaaggaattctggagaaattcaatcctatggaaaattttcatacgtggtcgtttggatcaaaggaatagatagccaaaaatcctataaaattttagattggctcaaaacataagaatttttccatgaggtccaacctcttggggaaaaaaatcttctctctctctctctctcttcttattcttacatttttcctgggctccatttaaacggtcattcctatagtattcctgcaatttttcagtccataggatttgaggtgcttgagcactccaatttcctgtatttttcctattcctgtgttttaagaatcttgctttccaaaggagccttgcatgcatttcttaatactcccatgttggctctcagaatctttcctacagttcaaggtttttaaacaatactactgtactttgtataacagtaattagcttgtttgctgatgaaatgccatggtcatgaataacagggcttccgttatgtggcttcgggcccaatggttcgatcttcctacaaagctggtgagttctacataaaagccatgattgaagctgacagagcaaaagctacgactgcaatatagttgatcctctttccttgacattgttacactgcaaataaagtcgcaggattctaaaagttcttattggaaaaacatgttcatttttgtcataattgcaatcgtgctcctttcaacttctcactgccccttgtaccatttcaacatctccaagctatgtttgaaattgttgctctcttttgttttataatgtaaaaatcacgagtccctgtggtccagttgtcaatcattcattcattgctgtaaacttcaacagtagcaggaagtcaagtcaaactacccactgaaaatgtaggatattgtccctcatgttactatgctgtacttttgtatatatgatggcacaatgtgaagatggtaaacttgcctgctgttccattgaagatcagatctgatgtagaccattccaaaaagatggagcccgcccaatgctccaagatcgacgaaacactctttctgcaagtcaacaaaggccctcccccaggggctaattggaggaatatgttaggggtaaagagcaccactacgagaattattgacacttccatcggtgtcttgtccccaaaagaaactaaatggccgtgcaataataatgcttgaactcgctgaattattatattgcattgtggacatcccgttgaagttgaaggccaggaggatttgcgtgtcccaccatattcaccagcagccacgctgcagcaatgagtttcgagtcaaaccggcactagcacgaatcgctagctcctgtagccatatggacgacttcttgagccaaacggcacccagtgggtttggttcttgtgtgctgttatcctgtcaaacgtgctttggtggttacagacatgcataaaggaatcgcagcagcgatcgggatcactcgatcaacggattcaactcttcaaatgaggtgaaggtctggaggatcgagttagaacttggaatgaaatcactgagtaatctccggaccaaacaccctcttaaactaatacttactccaccttgtagcaaagcgcacatgattacatgcgtaatataatcgactgtccgatctgtcccgcaggatcgcaatctacttatgtacttatccgaatccgattcggacggagtccctcacctttgcttagtttactcgcgtttctagatttccaaagcgcctaaagaggcccacggggatatcaaataaaattccgcagtgccggtagttatcagcgagctatcccctcatggagtacgtagctgctgcgttcgagcccacgattcggccgtgtcaacctcacgcaacatgcgcgcgcaccggtagatatccttatctcgcgctaaaaacacacgtacgccgcgccactcttccgccggctctatgccagcgaccagatcaaccctttgcagcgcccaagggttcgcgactcgcgagccccggtgggatcgcgagattgtctcgcggaaatcccactaaaaaaccccgaggagtccacgcgcgcgcgcgcgcgcccgtgccaatcccctcccctcgcgaaagcgagagccatttccaaccgcgcctcgcactgtgaccctggctatatatacacgcggtagctgcgttcttggaagagaagagaacaaattaaccgaagctagtgtaagagcagagaagagctagaggtttagagtttgcggtgtgtgcgtgtgcatggcgagcgtgtgggcgacggagcagccgggggtggagctcgaggtgaaggtcgtgagggtggccggcgtcgaggcgcggccggaggggggaggcggcggcggcggcggcctcttcgtgaggtactacgtcccggctggggacgggaagcggaggatccgcgtggacacgcgcgaggtcccgtgcggcggcggcgatggcgaagaggacggcgcgttctggggcgagctcgcccgcttcgagcgccgcggtggcggcgcgccggcttcggtaggcggggtcgtgttcgagctccggtggaggccgcggcggcgctcgccggcgttcctcgggatgctcgggaacgggaggccgtcgtcgcgcgtgctggcgcggggcgagctcgcgtgccaggacaacgccgccgccgccgtgacgcccgcgccggcgtcgtcggggagtacctggctgaggctctcgccggcgtgccgcgagctgagcgggtgcaaggcgcccaagctgctggtcgaggtcaggatgatccacgccgccgacaactacggagccgtgaaggcgacgaggtcgctcggcggcgtgaaccaccactactgctgcagcgacggcgagcggtgcgcgcagtgcgggtggatcgggaccgaggaggacatgttcctggcagcaacgttcacccacgaatgagtggcgtgatcgttgatttcgtagttcatgggagaggagctagttaattaacctaactgtactttcgctgatgaaatgataaaagaagctctcgactacgaggcaatttagtcatgggattttgatcgattgtccacatatgttgcgacatactccgtatttcggcatcataaatcaatgatttttggtacattggattaaaacaggggcggattcaccaagtgaattagacttgtctcggccccaaaagtttctgcactcccatagattatccttcagcttataagcgcaaccaaaattttaattttaaaacttaattttgaggtttttcattgtatagcttatttttcctgcattagctttcaaaccgttaaaaacacatatacaaattgttttcggttgatgataagctattatagcttataatccgcataagcaaaactatgtattggattcggcgaggtcaaaactgataaatacgctacgctcaaaattagtggattatatatgccgcattcttttctgattgattgagatatatattttacatcgatttttgttagcatgtttttttaaatcccttactgctatatttcatacgaaaacattctatatatatatagaagtatttttaaaaatatcagatactaatgaaaacttaattaatcatataatggttttcttgtttcttatgagctgactttatttttaatcttcagtgaaacaccctcatagtggcgtcgtctgttcatttccgcctcccgactcccgagtggcaacggcggcttgaagtactgtcagtctgtgctgccacgtactcctgactcgcgcttgtacgttcgcggcggccgtgtgcgcgaccgtgcgtggcggcctacacgcaatccacggcgccctcgttttggttccgccgtccgctgacttccgaggcgatacagccatacaggctttgcattggcgcgtgatctcaacccatcgatcacgccatgagatcatgttcaccggcttgaaaacgggtacgccgtacggcgtacgcgtatgcgtacggccgagctcgattgttccataggagtagatttttgcagagtagtacaacctttggacctttaattcagtcgagatctcgagagaagaaaacgaagaatactagtagtaatatctagcgtccgcattgtacctggatttgcagttcgaatatccaagtcgagcagtatactctatactccaaaggaaaaaaaaaaggcataagacgtgcacgcgtagtagcacggctgcagcaaaagcaagcaacaaacaacggcaacacgagatcgtttctttccttcaaagtgtcttggcgcgccacacgggccaaacaccgggagcgagcaaggaaaggagggggaccccacgcatcagacagacgaggggctcgcgtgatgaagcgtccgagagaagggtcccactcccactccgacacaaggccctgtccttctgacagcgggccattgggaccctactgtcagtcgcacacggcgtacctgcgggctcgccgctcgatcgcgtgatcgtacgtggacttttaaaccgcttcgcgtgctccgggcgctccgagccacgtgcccaccggcacctcggccgcgcgggatcctctacgcccaaatccaataaaaatccacttcgctccacccagcacacgcgggctacacggttccaacgcagatatccacggatctcgtgctcccgctcggttcccttccctgtacctgtccaggcaacccgtacccccgccctgcgcccaccgacaggtggacccacgatcttccgggcccacatgtcggtgacgtacaggctactgtttcggtgacgcggacggggacggagggggtgcgttgcgcagctactagtagcggccgtgctctccaaacagcggcagtggtggcgctcgcatttttttttcagctccgcggaaggaacgaaacccaacccaagcgaggcaaaagcggcggcggcggaggaggagaggagcaatggagagggcggtgccggtgaggaagccgcacacctcgacggcggacctgctcacgtggtcggcgacggggcccgacgccgccgccgccgcggcctcgccggtcgcctcctcccgccccagcctcaaggtaagctatgactaagccgtgctcgaatgctgctctgcttccccgtgcgttcgagtgcgacacgcgaggctgacttttttgagggtgcgtgtgggttgtttgtgctggtgttgtggtgtgatgtctggcggccacagccggccggggggatcacgccggcgatgttcggcgcgccggtgagcgagaaggaggcggaggatctgagcaagaggtgagatctggggggggggggggggtacccatcctgccgcattcattgtttcgtccctgatctgatcgatctatgatttcgttgtgctgtgcttctcattcgattaattagcctgatctggcattttgatctacgaacgtgtgttctctgtttgggcgtgtggtttagtgcatcaacatttcgaacttaggaaggttggttggggttgttgctctgggtttaggaagaagtagcagctgaagaaaaaattgcgctctcgacgcctttaatttcagggtggtttgctggagggagaatagtcgcttgcaggtggttggttggttggttcatgtgacgatcaaccgtgtccgtgtatgtgtggtacagtgcaaacatgagatgtttgctaatgtccaaatttttagtgctagaatccaagttttagcagtacaggcaatgatgcttgaaagtgatttgggctgaggcaaacggcaaatgcctggttcaaaatttggatatttctgtcgtgggtgccacaaagagaccagaaattatagcttaataagtcaagtcatgtggagcctgactgtttgttctgacctgcagttgtgaccatgtcattgcatacactatgttattacttcgcctgtcatagaattttgtggagtgttggctgtttatatttgtataatttatggaaaacagtccatgaaaatttcttgatggaccactttctgtggtggccgaattatggtagatgttcttttttatgcacctagatttttctagtttatctgcctttgagtattcctgcttctctgctagaaatttatcttcctctgcggttgaagctttggcttgaaactgtctatcttgcatgtaaagctcctgttgaatttttacagcattttcttattgtagtgcagttaatggtacgtactgcctgttttagttttgacttcattggttttgtataccaagacatgaagttagttcgacgaccaactcttaagtgtctagttgtaacaaaatcagtcaaatatcctttattcatatgctatactttttgaagatatggtatattgaacttataactttgttggcctgttatagtgaacgaaaattttgctcgggctcaaagttaaaagaaatgactggaagtgggatattcgctgagaatagtgaaaatgatgattcagaggcttcaaatcctgcaaacaaaacttctgtaaggatgtatcaggtatttcttctttcttgttcagaaacatgccaatcttcctcccttttattgagaaatatgtgtttctcttgttcgtgttgctgtggtgtggtaataagcaggattccatataatgtgtgctatggatagagtaacaagcaaagacacttcatacttcagttaagatttaagaaaaaaactactactcttccatgcatgaaacttgacaaaaaaaaagacacatctggagaaatatcttatttcgttttggtttatgtaattttatttttagttgcatcaatgtcccgagatatatctttctcttgggttgattattcaaaatctcaaaacattatattcttccagtaatataattactgatgccctaacgtcttttttcataacagcaaactgtaactggaataagccaaatctcattcagtgctgatggaagtgtttctccaaagaagccatcgtcattacctgaggtggctaagcagcgagagcttagtggtacactggagactgatgctgaggctaaaatgaataagcagcattctgaagccaagagcaaggagctcagtgggagtgatatttttggtcctcctccagagatccctgcaaggccattggctgctcgcaatatggagctgcaaggaaatctagattttgcacttccacaaccgagaagcgtccacacatcagtgaaagtatccaatgtaagtgacatgagtatgaatatcctgtttatgtttctattccactatgtatcattttactgtgtattctccattagtgacaggaaatcaaccaagcacttactataggaaaaaaaatagtagtacgtcttgatgtatatcttcaatataaacaagccatcataactgtttctgtttcatattggccaatgtggaatttcaggcttttgttattgagtaccgcaccacggcaccaatcttttgtagactgaataatttactggttagatacgccaaaaaggaattcataccacctttctttaggaaaccacaactacagaagggaccttttcttttgttcctcttggtgatacaggatatccatacaccttacagggaatggatgctcaaattaggttgcattgatataggtgtaagatgcatcagctacagtttttttttttaagcatcagccagaaatagcagcacaaaggatgacatttctatttgatagatatacggcttgcatgacatattgacatgttgcattgccatatgtcatcaaaatgtatttggatttaccttgttatatgaacatttcacccttaaatttgtatgaactgaatgcctttgtagcctgctggaggtccaagcaacatcacgttcagtgaggagcctgtagtcaagacgtcaaagaaaatccataaccagaagttccaagagttgacaggcaacaacatcttcaaagaggacgctacccctgcatcagctgagaaatctctgagctcagcaaagctgaaggagatgagcggcagtgacatctttgctgatggagcggcagctccccgagactatctcggcggtgtccgcaagccccctggtggcgagagcagcattgcactgatctaatcgccgcaggctgccctaatctggactggctacttttaccctcatcgctgaagtccgtggcatgtgctcttcctggaccctggttcttgatcatggttgagagctgatatcttggccctgatatcatctagagtcagcagaatctgactcagcttatgtgttgtaaacttgacttaatctcatctgtcttatggtacttatgtattaatctccttggactgagactgaaataagttttattggttcatttttgtgagctcatggtatcatcaggaaataatgtctgtcttgtatcaaattaacttatttgtgagttatgcaaaagataacgaaggtatctacaataccatttcctcttaacctggtttcctttgaaatttgggagatacaacctggtttcatttgaaatttgagagttacatggatgaagggagaaagaagaaaatactatttcctctaacctcgtttcctttgaaatttgggagatacaacctggtttcctttgaaatttgagaggtacatggatgaagggagagagaaaaaaagagacgaaagtaaatcgactccactggggatcgaacccagaatctctggttccgtagaccagcgccttatccattgggccatggagtccttgttggatttttggacattacggacttgtttactaataaatttcaacctttccgaaatttcacattaccttttagtaggataagttaaatatgatgtcaattctttaaatgttaccatacatttatccaaccaaataatggtatggtttaatggcatgaatctgaataaccctgccgtgcccgttcaagcctaccaccgcttcccaccgctggatccgccaccacctcacctccctaccaccgccgtgcttccgcgggatccgccgtgcctgctcgagcccaacactgcactcctgccgtcgccaacctgagctagagtgaggagagaagtgtgagaggaggaggggagagagagagagagaagaggctctggaaaaaaaaagagaagtgagagagagaaggtgagtagataaggatgatacttacaaattatgaaaatgctgagacggaggaaatgaggaaggttagacttgaaggtgggcctttaagaagcccacgcatgtggccgcttaagaggcccacctgtgaaatagtcttgtttctgcatgtgggtgtgttaagaggtccttctataaaaataggtttttgcatgtgggtcttttaagaagccgtatgtgaaaatgtaggttgatttttgtaggcgcgaccagttacggtccgcctacaacttgtatagaaaaatcgtttgtaaggtacgtacatgcttgaaatttggaaggaatacaatgtctcctctcatcgtagcactcggatccactttgactctctcgtgcgtccgttacctccttgcatcatggaaggattgtcctctctccatccaagccacggccttagtagaccgtctaaacaccacgttctctttttttctgatccttctcgttttattaaaaaaaaccgttgtaatgcgctggtactttactagtacaaacaacacaaaaggtgtcttgacactcttataaataatctgagcgatccttgactctacacagcagcatcctttttttgttcaggtccagaaaagctggtacgcttcacgaaatttttatccagaacatcagatggtaaagttcccttgaggctggaaagattagaacaaaataaatacaataaattctctcaatgggtttgcatgttcaaacaggttttagctctgcattacttgtataaggcaccgtgggccactctgatcttgctttcagttacatcaataggggccaaaagctgcaacgtaagatctcccattaatctgcataaaaaggccatcagaatggtgggtttctttttttttgttgcatttttggaaagttgccctggggaaaggatatatttgttctagcaaaaaaatcatgtaattaccgtaagtgttcagaaacaacataagtgccactgtcactatttgagctatctgcctcctgtgtcaaggtttttacaaggtaagtttagtatccgtaatctaaaaaggagtagagtgctatgccattaagcacaatttagaactaacaaattttaagctcgaggaattgattatcaaaacatacatggatgtcctttgccctggtcaacatatcgaatttttggatcgagagatgatgccgaatcagagaagaccaatggcatactccaattgtaccttctcttcaaagattctacgtttgtctctacaaaatatataggcattatttcgtgtgcttatgattggtatcatgctaaatgtgacctatgaaatctgtccaatactgacataaaaaatggtattctcagaaatagacttatcggttacctatattctggagctgctccaatgcagcaagaagattggtatctaacaattcaatcatttccctgatataattcaacaatagcaataagtggcacacatgtcaagatgcagcatattagcattagacagcaaatgtgtaaccactgtaccaataacagctacaaattacctgttggtgtgtttatccagtaccttggtcaagtgagactctcaaaaaataagggcacaacaaaactgttacacaacaacaaaagaaaaaaaatgcaacactcaagtagcagatgcatggttgttaaggctaggtgacatggcaaggtccacccacaccttaagactaaattcataagactaattgcgtactactagtgccgaacctcttctttacatcaattaaaatgcttcccattattaagctagcaaagaattaatatagttttgcatggtagtggaaggcgtatcaataagatcacctggagccttgccgaggtgcttgaaaaggtcacattgcaggtagatgcgatggaaaaacagaattttctgggaaaacggtgagactttctctagcttcttgttctcggtgttgacagagagcacccaaccacttggatcagtacccttcatcttggccattacataaagaatattgtcatcgtacaaatccattgtagggtaagtacaaatgaagttcgtaaatgtcagctggttgtccttggaatctcagatcacaggcattttatgaaactaatgagactaaataattagtgcagaaaattttgacataaattttggaaataaaaaaggtaataaattaaaatttttatttgaaattttaataggacaatgatttttttttgatcgggagcattcataaaaaaattattatgaaaattggttgtcctatctttgtatgaatgatcctcttttttttttttacttattttaaaaataaatacacaattttttatttcattatctaaaaatattttttgggataaataatgcatcgcacaacaaactcatagctataatagtttcgtgtgagaagcttttacatttttaacaatgtaattcatccaaagggtaaaatggtcatttttatagaaattagacggtcaactaacaatcaactgacgggaggggtatggaagggatcaaaatcaaattttaggggtatataaggaagtaagcaaaattcaggggcatagaagggattagttaaaatttcaagggtatacaagggattttctataaaattaaatgaggggtgacaaaaaagaaagtaagaggtaacaaccgatgtgacttttaaaaattataaaattagaaacatggggatgataaggctttgtttttcaaaatctttagattacgagatagctatttaacaatatttaagtaaaatcatattaataaatagatatttcctccgtttcacaatataagtcattctagcatttcccatattcatattgatgttaatgaatctagatagatatatctatttagattcattatatctatctagattcattaacatcaatatggacgtgggaaatgctagaatgacttacattatgaaacagagggagtaattttgtatgggtgctagcagcgcaattgcgcgagccacccatctagtttttcttatataaagttagatgcagaatttaattatcttgtaaaaaggtaattatcttgtattatatattactgtaaagaatataatttaattccactacctctatttctaaaaaaaaatcattgtatcttaaaaaagatctgttggtgttcggtctcagcgtctatagcgtgaacaatcgcgcagtgggcttttttcgacttttgggctagcaagatcacacacaacacgcacatcacgaaccggaccaaacctccgccgccgcccgccgccgccgccgccgcctacacaaccccccctcgccccccgccgcgccctcctctccgtacgtggagcgcatgcaaatcccctcgcgctcgattcttcgcctcctccgacgccccatcgtcgcgccttattctgccctgcggcaccgcatctcgatcccctcccgcgatctctcctctcctccatggctacctctggtccggctcgcgggtggctaccggcgcttgcgcgaagaatcgcttcagtcacgtggacgcttaaccctcctgccagtcgtgtttctcggtgtgttctcctgctctgatcgtaaagtttgggcctttcgtctcttgctaaagttctcgatatagattctgttgaatttagtttttttttttgttagaactatttgttcttatatcatgttggtgttttgagtataactagggaaattatttcaatcccgactgatggcacttgaatcggacgcaaagatttacccttttatgctctttgttcatagatttcctggatctcggaacatggccagcggcagtggagtggaaggcgagggattgggtataccatacaggcgccgcttcatcccatttgccaacgatcctatccacacaaccaaagataatatcatttctatggacaagcaccttcccatcacccaaggcaaggacagtgctgcaactaaggagttcatctcttgttatggccattgccgtcctaccacgtatggcgatgaagatgcttctaggacagctgtggaggtcaccggtggtaaacaagatccaaggggggcagttcagaacctaatagatggtgaagtggcagttcaggagctaatagatggtgaagaaattgcaaggaaccaaagggccagtgaggttagtgacaacgatggatatgaagagttcaatgatcgtgctgttaactaccactgtgactgtcatgtttggacgccacttattgcaagcagccaccgtgacggttctatatacgataccaggggcacctttggatctgggtggaaatgggattatcgtattgcagatcgtaacgagagtaagtgatatatatctattttcctgttgttatctattttataattaggacatttgtcaagctataggttcagctaatatattctatgttgaaaggttagtgtgcattatattttgtacttaaaatgataaattaaactactaaaaccgggtcacttcacccctgctttaaattgagattttgtaccataatatgacactccactctatgtcatgaatactttcgcaatttctcatgattatctgcatacattatcacatcccaagggtttgtgtccaggaggaaggtggcagcaatgctgccacttatgcaaccctagggtgccaaccagtcctatggctgctggggcccaccatgtggccatctgacctacatgccctgaacaacaaacaagacgagaaattctgtctattattaagagtctggagtctagtagactaggaagttatcaattaaatagaaatatatctcccatttaagttaagggtggcataatagatgatatttatatcaaaccacagctctaagtatcggaagaactttttatttgccactacagagtgtcctattctgggatacgccattggaaaatatcttatacggtctatggcatccacctcacaaatttcacccttatttgcaattgttgaccagtcaagacatgggaaaggtgtaaaattaggatgcctcatccacctcctaggtgatcattcccatgatggccatgatctaactggtgatgcctcctcgatggcactattgaacagaggcagcattctaccatgaccacaatcgatgaagtgtcacagaataaattgcagactttgtgcttgagggggacaattgtggaccagtggaacagagccccctcaactccaaaccatggtggtttgttcccttgtttgggacctgatgttcttttctttttcccctttttttttattttcttctgtcagtctgaattggttactagaaattacattggacagaaggtgttttttttttttgccttatattgtcccacatgaagtgatctggttttagtaattaggtgggggagtgaaatgagacgggaattatctagacaaccaaaaagctttagtcattagaatggactttctacctttatttttattgtaccatgcatgtattttatctactctttaagtttccgttacaatttggcatgtcatctttgttgtagctcggttggaggcaatgatgttatcacatcccacgaaagattgctacatgagggatggaacttgcatatggcatcctgcaaatggcatgttgcaaattttctcagtaaagttggctaaaactcctgtagttgatggctcaattgaattgtatggatacattgctgtgcgggaccttcaggatccattacttaattatatagtcaaaattggcagggatgatcccatcattgtggagcaggtatgcttccatgctctctacaattatttcaaattactttatttgtttcacattataagatcaaacttacagcatgcatggaacaaatgtgattagagcttacccaacattaaccttaacactaaaccgtccttcacccatggttagccaattttgtgctaaatggtcatttaaacagaaacggctaaccaccatgtggcgtttaaacaggctaaatgaccattcaggtgaacaatgaggttaccttttgttgttactccctccgatttcattttaattgacgttttggacaatgacacggtctacaaaatatatctttgaccttatttttctattataatatatgcaataaataaatgcatgtttacttttattatagtgctttgaaagataaatctatatatgttgtcctagttttctttaaactagatattttaaaagttattgatggtcaaagttataaaagttcgatctcaaccttgtccaacacgtcaattattttatagaaccggagggagtattttacagccacaaaatatcttttacattactgaatttaggatagagtggaaatggtgtattaggctcagtttgatagtgtaggctcagtttgcaatctttttttcttaaaaagaaatgaaatagtagtagtctatggtttccgccatatttctcatgtgaatgtttttttttctgaacagaaacatgccgctactatgattttcattgtcccaccatgatctaacagcttagtttttttttctttgataatgtggtaatttgtaggtcttcaaagtgaacatagtgcctctttttcaagctttctttatagtataatagatacataacatacgtgcccgaaaaggcagctaaaatattatagtgttatagctgcaaaaaatttgcttccataaacacatgtctggacagtgaggaaggtgagttgggatgcgattagtgtgtccaaaagtaacaaaataatattatggattgataagacctttatcaagtactatattgtggaatgataattatgatcagacctgtattaatcatgaactaggtgcaagtgagtgtacgtgttgcaaacagaatcaaatagaatagtttcgaaccctttggttcctgcctagtaccacataaaattgttctttttttggttgtctacagacatatgaatgacccttcacaacaaagtccttttttgtttacatttcacacaagcttatatgattaatattttggaattcaaaattaactcaaataaatagcgtgggacaaaccttctctaacattcttgcacacattgtaaccgttctgtttgacacatgacgaatatcttgggcatcaactgtaaaatgatccgtttagctaggcattattgtgactaaaacgttaatattttcttagttacttactttgctatgaagagctactaaatattaatatttttttagggttccctcatcgaaatgactggccctaagcgagggatcgacttttcttgtgctgttctagttgaatatgacatgagaatcaagacaggagaacgagaggaagatgatctacaactgattgatggtgcaacagatcttgaccatatattgacatcacatgtaccagtgagaaatcgcatttatggagattgcggcgcagttgacataactcaagcgaatcttttgtatgcatttgaggcgactgtagaagtcgtcatatcagaagtgcagactagttttgatttgtgtctcagctgttttaccagtgggttacatgaggaaattcggctctttgatggtgcgatcagtgagtcacgtgacttgaggaggtatgtgattgctgtcatggaacatgagtgtatggatttgaagttcaaggtaggtttagggtctgggtgtttcgctgaacattgtcgatccttcaaagcaactaatcatggatgtgccagtgaacaaataaagattgagttcgcctcaatctcggtgaaggtcacttggtcggctatggagttctagaagggtacttagcgtttggacattttttttttatttgttactccctcagttctatattgtaagactttctagcatgttcatattcatctagatagatagatagtgtgaagctagtgttgctagtgttgagtgtaggcatgtgtgtgtttcagcccaacagggcccattacaccaatgcatatgtatagtagaagagagaggaaatagtgtgaagcttctggagaaaaacaatcacctagcaacatggtatcagagggcgaccgcgtcgaggctaaaccctagctagcggcgcgccggtttgtggtgctgcagcttggagcaacggagtggtggcgttgacagcggagacggcgacagctgctacagaggatctcgacgcagccggcgtgaaggagggagcagggtgtgcgctcgctggttgagccgcgcaaggggaggacgcacggcgggtgagaggcgcactgtacgagctgcgtctagacttggctgtggtagtgttcccgaccattatgggtctagacttggctatggatacaaaagcacaagctaccgtcatctcggaaatgcatgccaactgtttagagttgagccatggagccatggtgtccatactagcaatcctgatgtcttgtcaataccaatatctaaaatggccagtgtcaaggctgctaacaacatcaccatcgaaccagtggttcagtatgttgataaagagctggacaaggcatccaatagggataaaggggccaaaggcaacagaggtatggtggtggctgatcatttccaactgtggccatctccttatcagcttaattgtgaatgttctcacactgagcagcaaccatggccaccgcctactcaagcaggagacattggttgtcaagttgcgctgcgacgagtgctagggtcatcatccaaatgcagccaaggtgacttaatgccggtgacaccaccaaggccactgacaataggaaaattgcataactcgaggagccgttctgctggaaacacaactgaagccgtacaatcaattattgagtctcatgcaatatctttacactgtagaatttccaagtcaatgtgcattgcacttaattttgttgagagctggctacaaaacacagccaagaaattatgcaatggccagttgcttaacctttcagttgggatacattttgacgacagaaagatttctactacattgttttttgctgagttgcttgagcacccaataatatattttcaggtttacttaactgcttttcactgtgttcattcgaacaaaatcctgagaccatggattattgctagagctgctaatgagaagcagaacaggaaggtcaagagatgtggttatgattccattgttggttttgatggaaacaatcctattgatgccagtattgcagtaaaggtttccattgatgtgattggtacttggacagattcagagacgctatatgcataagttgcaaacaaggattatttgtctgttaaattacttgagctggtaagaaaggggtccaatacatactggttattagaactcataactaatgagctgaatccttggtgtttactcagatatcagagatggctagaaattctggggctcccacctttgactagggctgcgtggacaggacaagggaagatagaacaggacattagtgtggacataatttcagcatctcaagttatcaagtctctctgtctgaacaagtcatctattaggagctactcaagttattttctcctgatacatgctttggtcagtaaattgagagcttgggaagcattggtggaaaagcatgtgcatcgtatgcactccaaagataacaaaagtactccctccgtctcaaaaaagacaaaccctggtttccgtgtccaacgtttaaccattcgtcttatttagaaaaattatgaaaaaaatttaaaaagataagtcatgcataaagtattaatcatattttatcatctaacaacaataaaaatactaattataaaaaaaatttatataagacggacagtcaaacgttgacacgggaacccacggtttgccttttttttttttaaggacggagggagtattgttgatgccttgggatccaggaggtttccatcagcttggggacaagctgaattttatgggggagggaatgttaggatcctgcctccttccatgggcctgtcaggtcaaatgcatatgggcctagccaaccatccacccccgccaaagcacaagcaagcaggtagaaggtataaaaagaaacagatacttcacattggaggcatggtgggatcaattggcgagctgaggctcacgacggcgacctaggcggccggtggcacccttgtcgatctcttctctttctcctcttcttccttgagttactagcaacttgtatcccctattttcttcctttgtttcaccaaatacttgcaagtggtaacaatctggttgctaattgaattggagcaaagggtgctaacaccacgtcagcgggccccacgaccacccgaacgccgccgagaagacacacgtcagcgccagcaccgccacggagtagcgcctcgccatcgccgactcgccgtcccgcccgatctgcgaccccatgatccacgccaccgcgacctggcaggcgatcatcacgtacgaggccgctggtcaagaacagtacccggcggccgtaccggtccaccgtggcgatggagacgagggtggagccgaggttgacggcgcccatctcagcgacgcgttgtttcggtgcacgtgtgctgcaaagtcggatggtcacgcccggtagtggtgggccggttcatgcgatgtattgcgtgaatttgggatcggtttgatcgatctgctgcccggaaaagagctatttcgggaggatttttagtggttttgctacggacctgcaggttggtgaagccaatgccgaagccgagcagcatgctgtcgacgatgagcatggcgatgttgaccgcagcggcgttgacggcggcgccggcgaagaaaagcgccgcacccgcgagcatgacggcctgcctcccgaccgccctggtgacgcggccagcccggccaggtacagcgacgacgtgaacgccgtcagcacgtggctgtcgtagacgcagtactcgtcccgccgtgccgccgccatccgccggagcacccccgggatgaaggccccactccatcgccgtcactccccctgaccacatcatctccctcacagacgacggtatatataatacaagtgatgaatgtcgtttgcagccacgtgtaagtgtaacgacgtatcgattttgctatttatttgtcgacaaattttttcccaaaaatttgacagatataattacagtataatcgtagtataattacactgaaacttgcatgtaattacagtgtaacttgtatgtaactttcaaaaatctctccgtaacatgttatttcggtaaaatggaggtcgcgggaacaaattctttcacatatgtgtgtgctatgatttgttttcttcctcaccaaaacaaatcttgtaatagatctaacgatttaaaattatgtgaaacttatatataagttacatgcaagttacagtgtaattacatataagttacagtgtaattacactatgattgtactataattacatctgtcacatttttgagaaaaaatttgtcgacaaatgtataggtagtcccacgacgtatacgtaccggagatgccgatgtcgtagccgaagatgaggccgccggccggaggcggccatgaggcaggtgaccacgacggagaaggttatgccgccgcccatggggaacccacctccagccatatcgcgcaacggccggccttgtttggcacgcaatagccgcgcgctcactcgcgcactagttggttgggctggtagctagctatacgatagcaaaggccgatcgatcggggtgtctggtttttgtatatatccaaatccacggccacgtgcgggaggacttgtgttagttaattattaagcgcacggagcaatcgcgtgccaaaccatatattggaaattaactcgttcggctgctcttgctttatcaactcgttttgttttctttttcgttttgttggggcggaattattcagtcgtattcttgaagaggccctacgtacaaactaaacgtactccagattccagaagatcctcagtcctcactggcagactggcaggcacgctgctactcagattgcgatgggtttcacgggtggggtggttgttgaggatcgaatggttcaactgcaccgctgcatgcctgtggtgcagagtgccgttttgcatgcc

SEQ ID NO: 60903 - DNA, 1138 bp, Oryza sativa
tgcaattgaacaagaagtaaactatattgcattcatctctacccttctaggaagtacacggcgagaaataccataaaccagactatagagtttgccaatttggtgcctaacatgttagtgggggtgggaagggcaacctggtggcggtggaatatttgggtcattgctcgtgcacgagggccttgatggtagctgctgcaggtacagctgtttgaggaactgtatgagaggatgatcgccggaggtggccgctccaacccatttgtcgccgcccagcggccgcgccgatcccgacacgaccaacagcataagcaccgccatcatcagcggcaaaacaaacctcttcatcatggccatactatgagctcgatcggacttgcgcgcgcgctggtgtttctctcgctcagagcttctctcctctcctgtacgtgcagtgtgtctgctctcttgcagctcactgtcccgggcaagtcacgactcacaactcacaagcgcgagttcagtgtctgatctgtgcgagctctgtgcatgcacaagatgatgtcttttttttttaaactaactgcacaagacgatgtcgagttggtcgatttgcatgcatatatatagcccccctgcttcgtgggaactccgtgttggctccgctattacgtgcgtgactcgtcggtgagctaaactgaaaaaaactcggcacgggctgaactccgattctacggtcttcagaagggaaaattcacgcggccttcgcgtgcatgggccgtgtacagatacacccacacacatcgatcacggccactagcaaaactgtagtgaaatctgcatgggcacaagagaagcttacctttatttgcctatgtaaaaattccatgctcatgctcagctcgagttacgtgcgtgactcgacagaagacgctgtgccgtgcgcttctccctactacatacgccgatacgcgggttccaattccacggtcatcgcttcggaaggaaaaaattgcagggtgcggagctaaagaaaacgaccggtttgtcgcgcgccgaggtgaccaacgcgcgcgccggtgccctgtgccgcgggtcgtaaatcgtaatgcgcatgtcaacctgttacgtaggtgacactgggacccggggcctggtg

SEQ ID NO: 60904 - DNA, 676 bp, Oryza sativa
gccgtccttgcgtccaccgcccactgcccgccgcccgccgccgtcgtgcctgccaccccctatgcgccggcaacgccactgctcgcccttctacttgccatgtgtcacgcccagaaattcccgaatagaattccaagcagaatgtgcattaaaacccccgtccaggaccggccggggtacacaaacgataaagttgacgtacagatccacgtcttacaaacattataaaagtcttacataaatgcagcggaaaattaaaagataaatggagctaagccttgacttggactgcagcgggaacgccacttcacaggcatcctcgacggcacggatgaagcctactcctcggagaagccaccatctgacacgtactcaaactctggggtttgggggaaaatagagcaagactaagtacaaccaccgtactcagcaagtcataccggaatagagggtatgatgcaggatataaccaaaggatagctagagtggttcatttgcataaagcgagcatttaaaggcagtagttaaaagcagtaaaacagttataataattcatcaatattaaccatccactgttcaacgctaccccacgttgcacaggcctaaccatccacctgaactaatcgattccattagactaagctagggtgagactaatcacgggggctgcaggaat

SEQ ID NO: 60905 - DNA, 714 bp, Oryza sativa
attcctgcagccctgtgctccttgatcaacttccatagacaacagagtagcaccgaaataagaattcaattagcatcacgcaaatgtttacaaaagtttatcattgctctagcaagattgcccaagacattagggcagaccaaagtttagcatgccaagagttaaactctatattaatacatggaaatagctcacaaaagttgccacacataacatcttccagtttttactttgcatagaagctccactatcccttcggcgccggacgcttgccgacagctttccaggtgactttcacagaaattgtgctaaaatcaccaagcttcaccacttcatcttcaattccatgaaaaccagcaccaaatctgtgctcccatcttacacggggcagcttctcaccaagaccaatacctgctggagacccttcgatacaaagatcaaggtgactacgtcgcaccaccgccacaacagaactaattctatgaccagattgtgcagcaccttggaagagacggatcacatcgctgaagccactagttttggcatataacttcaaattaaggccacaaggaggtgaatgtataatctcaacatcaactgtagcttgaactgcattaaccagcagagcaaacttcaaatccaatccacacttctcaccgtacagacgaacagttttggcgaatgatgccgatcttaaaatgttggtgaattcag

SEQ ID NO: 60906 - DNA, 28451 bp, Oryza sativa
cctatgtaagattcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcatatatatatatatatatatatatatatatatatatatatatatatatatatatatatatatatatatatatatatatatatatatatatagtgaaagagcatgtagtctagtggttgtagtgatctgagtaacaccctgtttcataagttcaaatctttggctaagttccatgtttaataggttaaattcctactccctccatttcataatataagagagataattggtgaatgtgatcacatcctagtgtaagggagtaatttaaaatggctgcataatatatccggttggatataaaggccgaaaaaaaaaacccttccaaaaaaatagttatatataggaggatactgtatcactggagtatgcacgtacgtatgcagtgcactgtttgactgacgtactataaggtaggaggactaacgaatattgatcttcatcgaccattcttcttatcagtattcgttcgttcgttcatttatttgtcatcgatgatatgatccatccatcattccatcttcaaccgattcaattctcatcttccctttcacaaaagaaaccgaccgacagacagagaataactagtccacgtctctgcatagtgtatactcctgctcccgtggatctgatcttcttcctcaatcgtcaattcgtcagcatactgctcgcttactatatatgacgaatcattctgcccggggtttgataaaataaatctacatcctattattaattcaagatctacagattattaaattttagcatattttgttttaacaaaaagtagcacattgtgtgtacattaaaggaaattatatcattttctagatatttttttaatttctacataaatttattatagcttttgatcccacggtgtcctttttccttcctaaatagtaggaagttggtggtggggttgtaagatcaaaaaaaaaccgagcttaccatagggaggtgaaaagtgataacattagcagaagtcaaataaccaaacttcgatagataaaaaactcaccccaaccttaaaaaccaaaagatcaaactttgacactctaaccggatctgtacgggtggctaatcgggcttagaactggtttgactgaagtacaattactagttcgatcgtcagattaaaaagaaccttacatcacttgtgtaaaatcttgttttctctaaaaccagccattagatcgagctctaatcttgacaggaaactaagagacaaatctatcgaagggtcatgcaaaagtaataaacggtttaagagaaaacatctcaaaagctagacgtctcagaaatttcatcaaatatgaataaaacataaattttaagcaaattcgagtcaagcaaataccaatgaaaccttttagatctgatctataatataatagaaatgtttcgggtggattaacttgaacaaaaccataacaaaactgaagaatcacaaattaatgccaaaaacgaaaaaaataaagattacaaaaccagtaaaagatcgttgacgccttgttgattgaatatgatatttctttttcaagtagtattcataagacggtcattgcacctctcacgaatttctcacataaccctaacacaaagagtagtaaactctttaatctctcaattgtggcttaccctcaatgcatagcctcccttattcacatctaattacaaaatcaaactaaactccaactctcttgaacttggactccaatccaaattcaacttatccatacgcacacaattccccttgtcacctccatgtgcattattctctagccttggtatccacatgatctccttgatcttctagaactcaacttctaccaagtctagtcttgatccatcatcggcaatactctcgtgacctcaagcaacagctacacgttaacaaacaaagaaaccatatttgagcacaagatcttccccaatttgactcacatatatctcacgtatagaaaccatctaaaagtcataaacatttagcaatcaacatattcgatagaatcaacccaaaactgattcatcaggagtttgccggtctaagtgctccctcccatggcagtcagatcgctggccccatggtggtgagaccactcttgccatgaaacttcgccaaattcaacatcacttcacaaacatcagctcaatcacttttttatcactcttaataattctttatcaccagaatcaaatcaacaccttaatttaataagggtggtgataaattcaccactcaccaccaccgctactctcttttaaaaagagttagaatagattactaattctctgcagttgtgatagttcaatccagttgaccaactataagatgtttttgattaattggggagtttcttttcagagatcccaactagtatacaaacaatatgagaagggctacaatgttttccaaaaataaaaaaaacacaaatcgcaacgcacaagggtcaattactcttttagacggtgcccatatagaaagcccaccgggcttgctttcaaccgtcatgtgggctaatgttggatttaagtatcaggctttaatgtttgatgttaatcacatggcaaatcggtgatgcaagtgtagctcaactggttatgtttttcttgtggtggaatcaacccacctgagttttagtcctatacttaacatcgatgctcatatttacatctaattattctttcgatggtaggtggctgtcggtgacacgggaccaggagtaccatgactagaggcttgaggcagacataatcgcccacgtggcctggcaccctcgggggacgtcgggcccgagggtgacgtgttcgccctcctcttagtctccccaagggggtcgggccactcccgcctcggccccgagggccgaagcgccccgacccctcgtggtttctcctccgcgtgtatgggttaggtgagcacagcggggctcacctaaccgcatttattgcggtttggttgaacctgtcatgccgcatgtaacgcagtgcagtgcgctcgtttatccggtctgtgacaggtcacagaccggtcagatcgcggtcaggtcgcgacaggcggtctgacgcacgcctcgccccatcccgtcaggacgagggcttctaggcgctcgttcccagacggagctagcgtgttacctcttagagatggcacgttagtcccggttagatatatgccaggcttcattctaaccattacagacaagatgttgtgtgaagaagggcaaacatgcatattgctaagctgacgcgtggtggacaagaatgaccgatttgtgaccagtctgacactgatcatgtcgtcagcagacagccacgtttcccacgtcgcacctgcctccggcggaagtggaggtaggtatgtgccgtcccatcagaagatcattcggacagcaatgatacaaatctccgtccatttatgaagagagggcaagtccagtttggaaagggagagagggtgcatgtggtatccccttaagatataaaaggaggaccttgcccactaagagagagggacgggactctggtagattgagaacggagagcaacggagactctggttcatactttgtagctccttcatacacagatccaccaaaaacacaggagtagggtcttacgcatttcagcggcccgaacctgtatacatcgcctgtgcctcgtgtgctctttcgactctcgcgaacattgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgtaatacccatttacctggtaaaagcattattatcaaataaatagtatgctcagaatgtccttaaaaataaaaaaggaaaccctagggtggcgtagctaggggcccactccggagggccccaggcccacctaaaatttcatacatggggttcactccggctgaggaggaatattgagtgtatggcccaaaactctgagtatcaaagcagcttggggcctagcttgggtcccaagcataccctaaagtatataccttaagaatgtaacctaaggtctgcccggggcccgatcccattccgggccctaggctcaccctagtcctcgcaggttctacggttcccggcaagaggagtgtaaaacatgcaagacctatatgccttaagaggataaactatggtctgcctcgggcccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgacttcagctgtccaccatccagcctcccaaggttctggatcacatcgtgccaccgtgccggctcggctcacgcgtggatggggaagacggcgaccgaaggggacaaggaggcggggcggggcggcggcggcggcggcggcgcccgccgccccgtggtgctggtgacgggctgctcggagggcgggatcgggcacgcgatggcgcgggcgttcgcggcggccgggtgcgccgtcgtggccacggcgcggtcgcgcgcctccatgcgcgggctggagggggacccgcggtacctgctgctggagctcgacgtgcgctccgacgagagcgcgcgcgctgccgtggccgacgccgtccgggagctcggccgcgtcgacgtgctcgtcaacaacgccggggtccacctcgtcgcgccgctcgccgaggtgcccatggaagagttccagcaggtgttcgacaccaatgtctatggtaggggtggaaatttttgctcccttttttttcttctttgttttaattgctgtctctcgtgcttgctggtatttggtgattgcgatgttctcgaagaagacgggattttagatcctgcgatcaggtggtccattaagtatgattagtaggcaattaaaatgtttgttcttgtatctatcgattggttgagtagtacaacggcagaaaagttgcaaatttaggattactttgtcaagacattttatcctgttagtgccagtactaatttaggaaaagtatgtaaaatcttctgtagtcacttgcagcactggattacttataagtttgcaactaggaaccctatgttagcaaggagatgcgttaatatttagtagatcacactgagctggttctagttgtgcaccacaatgaaaatccaaccaaaagaatagcttggtggcatgatatgtttagtaacatggggtttcattggcgaaattgcagtaccaatagttgaaagatgtattatacacttgcacactctaacactagtcagatcagtgctcccagggcacgcttcctgtcagttgcacaaattgacagtcaaagtgcagtgacgatgctgcgatgatgttgattgggaagcaactggaatgtggaattgactcattctctcattggatctgacaaattattttgtcccattaagtgtatgattcacaatagctcttaaaccaatgtaaaggtatttgaaaggagcatagcctgttaacctacaattaggctttccacgctgtttcatacgctgataaatagtcttcaaccggacgtaaatatatgtaattccaatgtaaaaatgtatgctggttgaactgctgagttattgtttcataatgctagaatgatgatggaggcgcaggggggaatagttatcaattaggctttccacattgtttcataatgcttgaatggttcatggcttcatgcttgtgcaacagcttgtttgagattacttacattgggcctgcacttatgaaaatgtctaaatgactgtcttttcatctacaggagcaatgaggctgattcatgctgttattccccaaatgatagaaagggaacaaggtacaatagtgaatgttggaagtataacagctttggctcctggaccatgggctggtgtatattcagcatcaaaagccgctcttcatgcattgagcgatacgctaaggtctgtacattcaaggagcactctatactatgctggtattattatgccacattgtttttctctccgtattactgctggtttatcactactctgagaacttgctaaattgtttgatcgtgcaacaaaatgcttttcaacagaagctataataagaaataaaaatgaataacgatacaatagtgtgagactattcgaaattcccatttgtttgttttccatgtcatcttcttgtatattcagttcttttcgacttgcaccgcatgatctgtggcttttgacgctgaaattatttttcacttttgacactgtcagttgacacgacagtttttatcactgcagactggagctaaaaagtttcggaattaatgttatgattgttgcacctggagggacaaagtcgaatctgggaagtaactctacatccaagtatgttcaaatacgtgactggaagtactacaaaaaattcgaggaatccctcagagccaggactgatgcttcccagggtcctggttctactccagcagaagacctcgcaaaaagggttgttgctttggttcttaagaagaatcctccagcctggtttgcttacggccagttcagtgctattctaagcttgttgtactatgcaccactatggtttagagattacttctataagattgtcatgaaatgctagaacttctgatgtcagtaagttcaaaggacaaagaggttgccactcagataacccgcaatacatacttgcatacagttttacagggaccattcattcaagcgaaaaggcccctcccagtgtatgccatcttttttcacctgtaataatagcggtgctagtttgttcatgtagtgccaaaggatggcaatctgaaatatgtggcctgaagaaactggtttccttgcaacctccactgttgacatggcctgcatcttcctgtctcaggaaatcaaatttcgacgcgcaaacgggtcgaacacttgtgatctgattgtttgaagtttgcattctactatgtctggcagcatctgctgtagttggggggcgtcaagtgcacacggtgaaactgaccagttgcgcatcattgttcagatcagagccaagctctgcaaatatctgacgatactgcaacagttcatttggagagtgataatgcttctcagttttaagtgggaaatgaattgttttggcaaaatattaccatgaaattcttattcttacattccaattggccttaaccttaacggccatttccggcaaatgtatttttttacaacagttttgcggtaatttcacgtaaagaaatcgagtccaacatgaaagaagaacgcaactgaactggaatacttgtcaaatcgctcaggattttactgcggggcggtctcacaccagcgacccgtccccacaaatcacaagcagcgtcgtgggcaggatatagtccacgtggcgtccacctgcgcggcaaaatccgatggcgcgcgctccccattggccggcgacatatccaccctagctccccggggatttccccatcctgtggccgcggcgctccgcggcgccacgattaaatatcaactcgcccgccgtgaccgtcctgctcgctcccgatcacaccgtccgccaccggaagagagagcccccctacgacgacgacgaccatggcgctcgcctccacctccgccaccgcgtccgcggccgtgctcaagacgcccttcctcggggcgaagcgcgcgctcgccaatgccgtcggcgtcgcgggcgccaagcccgcgccgcgccgcgcgctcgtcgtgtcggccaagaagtcgtggatcccggccttcaagagcgacgccgagttcatcaacccgccgtggctcgatggctcgtaagttcttcttctcttttttcctcttcctcttcttcctcctcctcgcgccgccgcattgtgtttggctggctgacaacccgagcgcgtctcgtgtatggaacgggcaggctccccggtgacttcggcttcgacccgctggggctgggcaaggacccggcgttcctcaagtggtacagggaggcggagctgatccacgggcggtgggcgatggcggcggtgctggggatcttcgtcgggcaggcgtggagcggcgtgccgtggttcgaggccggcgcgcagccggaggccatcgcgcccttctccttcggctccctcctcgggacgcagctgctgctcatgggctgggtagagtccaagcggtgggtcgacttcttcaacccggactcgcaggcggtggagtgggccacgccgtggtcgcgcaccgccgagaacttctccaacgccaccggcgagcagggctaccccggcggcaagttcttcgacccgctcggcctcggcggcgagaccagggacggcgtctacatcccggacaccgacaagctcgaccggctcaagctcgccgagatcaagcacgcccgcctcgccatgctcgccatgctcatcttctacttcgaggccggccagggcaagacgccgctcggcgccctcggcctatgagcaatcaaccccgctctcgctcgccatggatctgacacacagagttgggtttcgcttgcatgcgcgcttcgtgtttgatcgctagctgttgcatcgatcgggcgcgtgcatgggctcggatcgaacgattggaggtcggaggagcagtagcaaaatgtatcttgttgtgttcgtggccgcttttgggttgggtggtgtgcgtgaaccaaatgggggaattaatcaaggagttatttttttttatttttcttcccagtgtatgtaccatatgtaatatatataattaaggctgcaggatgagcaaggatatttcattgatctcatggtgttcgtgccattcctttgtcatgtgcactctgtttggccgcttgcctgcatggcgaaattgcatcagctaaaggccgcattgctacgaaatatctcatccgctcttcgaggttcgaaatgaccatagtattttgtttcttccattgcgccgaaggaagaaacgtgctatagtagctctggcaaagataagtaggagcatatggtaagaactgaagaatactctctctgcaaactgaagaactccagagtacctgccactctttcttcaatggctgcatttgccttgaagcagatacaacatcgatactgcatttggtcgtaacatgagctgatttcaagtacaggagcagatcacattcccaatctcaaccattgcaatacctgccggtaccaaactccactctgcaaattagtgcaaactagatacctctgctctgcttggagctgtcatttttttcaatccaaaatggaagagaacgaaattaactaattaaacaggcataaataattaacaaaactccacgcctatctatatcagattatccggcactaatccgagctcgacccccagtgacagatgggactgtccgggaagtcgctcatgtccaccacttgcgcgacaccgaggagaccctccagcatgtcgtcgtcgtcgacatgcacggtctccggagcgacgctcccatccccgccggctccggccgccacgtccttcccctgctcgccgccgccgccgtcggtgtcggtcccctgcaggcagctgtagtagagcttcatcagctcgtcgatggagctgcggtccgcctccgggacgacgtcgatgtccgccggcagagagagctgcatctcctcgccgccgccgccgccgccgccgccgacctcgcgcttgcgcttgtcggcgtgcgactcgcgcggcgtcggcccctcgttgggttcgtcgtcgtcgtcgtcgagcggcgtgatgtggagggagcgcagcgcgtggcggctgagcgcctcctcctgggtgatgacgcgggaccaggtatcggcgtccctggcgctcatcttgtgctgaagccgcttggactgccacacgagcttgcgaatctggtcgaaccgcgggctcaggtgcttgatgacggcgctagctctgagcagggagatcttccacgccttcttgaggtcgtgcggcttccggtacggcggcgggccctggctggcctgcgcctcgccctgcaggccccaccacgcctcgccgccggtcggccaccacggcggcggcaggccgcggtcgagcgggaagctccgctgcggtggctcgcagtgctggatcagcgccgacagcagcgaccccagcgtgctgtcctggatgtcgaggagcccgtgcaggaacgacgccgccgccgcggggctccgcgggctcccccggccgcctcggcccgacagcgccgtcggccccgcccggtcgaatgcgacgtcgtccttccaccacccgcggaggctgtcggaggagccggacaccggcacgccggactcgtccacgatgccgtacacgaacccgcgcgcgttgcaggcctccatcatcttgagcatgtggcggagcacgccgtcctgcgcccggagcatcgccttccgccggtaccgcgcctcgggcggctcctcctccgccgcctgctcctcccccctgaagacccggtggtgctgcgccgccagggcgccttcgtggcccgaccggccctcgagcttcatgagcagcatctggtccttccacatccgcttcttcaggtcggcgatctcgatggactcggacccggactcggagtcactaaagaactcctcctgctccggcgccgcctcggcagcagcagcggcgtcagcagccttggctttgcctttgtcgtccatggcggcggttggccgtggcagcggctcgagagcaggaggtttctgtttctgtggataggcgaggctttccatgaggagagcttgctgtgtgaagcggaactcgtggaaaaggtggcacggaagggtggcgggaaaggttgcggcgtgcttacttatgtacgtgcagacgttccgggcggatcgaaggatgtggaagaagctaggcttggtaggtggatttgctgtggcacgcagcgccttggagcccgaagggacttgtagggagtagggacgggagcactgaccagcgaggcactcactgagtgcggagtagggtggtggtggaccggtggtgtacggtagcacccgtccgcaccgcacatgcttgtaggagaagaatacacacgcggctaagactaagaagcctaattttttatgcttttgtgctttcttgtgccacagcgcggacgcgataatttttctgctctctaggagaaggttgagggtaatgacgagccctgcacttatctttcaattattgttcttgtagtatttgtttatgatgttactgggcctgttcagcaggccggctacaacggctgcagctgcagctacacatattgagtgtggcactgttcacattagctatgggctgcggcgcagcagcagccccggctaccaaacaggcccactagtgatctttttcatgcaattatcactcttgctgttgtttcgaaaagaactatattcattcggttagggctaacgccgggggctactgtcaataatatggtccaggggtatcatgtttggagggaagaggccaccccgaaacccacatggcacttccccgagggggatcgggcccgatgtggagtgacggctgccccctcttcgcctgagggtattaaaacttgagggaggaggctgctcctagcacccacgtggcactcccccgaagagggtcgggcccggggtagggcggcggctgccccctccatgattgggggttggactgccccaacccccaccgcatgatgccacgtatgcggagttaggtgggcgcccccaacggccacctaaccgcatttaaagcggccagagtgcgtgctgtgcacgtgaccggttgaatgattgatggaaccggagtagtgcgcctgtgcactactcacatgtcaggcggcgtgcgatctaacctgccccgtcacatcgtgaagcctctcatcccgaccggagtcggttcatccactctagtaagcaaggctcccgttttccggtgcaaacgggaacccagaagtcttcacccattaaatgccgaatgacacgagcgtccctcgtgttaggcggttcaatttgatgggcccatgttgcgacacttgtgcgcatggcttccaagacaaggcacaacacacacatttaatgtagagaacatttttcctctttggtaggtagcactctcaacacccgtggtaaccctttgaagtataaagggaggtccatgtatagcgagggagggggatcgaaaggtgaaaaggcttagccctagcttgtataccagagattcagagactttgtaagctcagaaaaatcatcatacacatgagtagagtattatactccttagcgacccgaacctggataactccctagcgtctcatcttcaccgagggcccgaccctctcgttttctcccaatccttccagttcctcaactttcacccgctgtccccgaccaaactaacaaaagaggggcctcacggttccctgctcgaggagttcaccctccgacacatacgtacatatatcaatatggcgtaaaattcttttattttagatagaaagtaactttatatatatatagtttatatgtgtgtataaaaaatatttgcatataaattatatatatacctatatacaattttatatatgtgtaaatttatacgcatatgcatacttttgatgtatataaaagtttatatatacgtgtactacatatacatataccagcggttttatcgaatacgggatgctactgcagacataaaagggccggatcgcggaagggagttcgcgtgtttctgagttctgacgtagcacgatcgcacaggaccacgatgcggggggaggtgtgggcggctcgtggactcgagcgttttacctggatgcatgtacgccatttgtgacggcgccacactgccatgctgtatcatcctgtgctgctgacgtccgcaccgcgtacgcaattactcgctccgtccaaaaaagaagcgatccctgatccggatccccaatgtaagtttagtactaatgtgaaaagacgaaaatgcccttctgacaagatccaggagtagtatgccagaagcatctgatgcagagtaaaaaatgccaaacgcttcacgtgcacaaagcaaatactaaaaaaaaaaaatctctccagttgagaaaatactagtactagtagagcatgaacatcgcaagaaccatgatttgcctccaccactgcaagaatcaagaacgtatcaccgtcgcctccaccaccgccgacgccgcgtctcccagtcgcctccgccgacgacgacgacgtgtctcctggacgcctccgccgccaccgacgccgcgtctcctcgacgcctccgccgccgccgccgccgacgccgcgtctcctcgtcgcctccgccgccgacgacgacgcgtcttcccgtcgcctccgccgccgccaacgaagccgcgtctccccgttgccttcgccgagcgggaggtaggtgcagagggggtcgaaagcttggtgaggtctcgcatcttaccgccgccgcattgatgcagtcaatttgggaacgggagagaaacgcgagagaaagagagggacgcgagactggtagagacgggcaggcgataagatttttgcggtgtgaatgtgaacgagagaagaagtcgctgtccaccagggcccacaaatgatacgatagatttgaagttttcttgatttctgtggaggaatcctcccttccagaaatcgtctcttttaggacggagggagtacgtactactaccaccgccacatgagtatgtgtatgtcctcccatttcttgtgaatgcttacatagttacacggccagccagtctactagcgacgttgcatttgactcgtttgagacgaagatcccgatctatggcactgaattccacagacgcggacaagttttagcatgtttctgatgatcatctccgtgctgtagtgaagattctcgttcagccatcaactccggcccggcacgccgttacccccgcagacttttcaacagaaccatgcttgggcctatctaggacttctgggccgtatcgtcgaatccacgggccacggcccaatctaggcagaaaagaggccgtcggcaggtcccatttgtccacttgttctggaatcttggaagcaggtttcagaattgcccctttcctaacttcagaagcaatcaaacaaaatctgttctgagttctgacttctgaagaaacaacatcaaactccagactccagagcacccatggttcacatatatactgtatactccagtacaagtatacacaacgacaggcctgtcggacactgatgtgtaaacagccgtgaggtctcgatgccgcatgtacatttcatatagagattatgccgacacaaaaacgatacatggaaatcaataagccagtcatggtgacattgaaggtgtgaatggagtgatgctgacatgttaccaactggagtgagcaccggatcgtccgaccgatccaacgctggtttcatcttattaccctcttaaaatcgtataattattttagcatcctcccctcaatgtaaaaaaaaggatcaatcactgcaatgcacgacagcacgagcagtcgagcagtagaccacatacgcgtaaggtacataattacacgggaatccaaagagaatctacgatttatttacagcacggtgaccctcggctcgtcggcgtcggcggcggcggcgtccttggccttgttgcagttgtcgacgacggcgtagaggcggtagggcgatgcgtcggtggcgagccactgctcgacggtgaagagctgctgcgcgcagccgaggtggggacccgtgacggtggcctcgaggtagttgcagtaccagccgtggtgcgggccggtgccgtcggaggtgaggttcatccggcacggcgcctggcgcatgcaggggccgcggccgctgaagatgtcgaggttgccgcgctcgtagtagtcgtggccgtcgcccatgaggccgccccaccgctccaggtcgcggatccgcaccccggagccgtcggcgcccagcagcgtcacgccgatcaccgagtccgtcccgcccttccagatcgtccccgtccgcacgtatatcgtgtacacgcacttgttctccgggtccgacgacgcctccgccaccgtgatcccctcagccgccgccgccgcgtcgtcgtccgtggccgccaacgcctgtacaacatgcatgacatacggcgccctatgacgatgagaaggggggtttcgcgtacctctatgttgttagggagcggacgggacttaccgcgacgacggcgaaggagacgatgagaaggcaggagagcttcgccatggccgagcttgctcgctccaacctcccaagtctcgaaggccctttcccgccgcggtcaatgggaaagtggtggtggagatcgggaggaggattttgcgaacgaggtaggagtagtaccataaggccataaggggaaccgggtggggcccacctgacagtgacactagctaggaggagcatccaggtggcatatccttctggatacatacagagaaaaaaaatttcttatccaaccaaacggtgcaaggaaatcaattctgccgcgttcacgtgtaacacgcactcgagccaaaatttactgtaccttttcttttttttttttgacaaacaaccgacggaaataggccacgacctccaccgatcggccctgaatcttgggaagcagagataagatttcatctctaggaaaacaggagcacgacctccaccgatcggccctgatcctgttgattacaatgagtttcaatgctctatacttcttccgtctcataaaaaaactaatctagtattagatatgatatattctagtactatgaatatacatgtacatttgtacagatttataatattagaatgtatcatattcaattatatatttgttttttaatagaacggagggatcatataattatcatttggcgagggcgaagccggtctactactacatgttaatttggggtagttggcgaagacagtgacactaagcaggtgtcagacgagaaatagttggccaaatagtagtacataagctgataagcagtcaagaattcaagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggacggagatatggtatatagtggcaggacaaggcctcccaagcgtgttcaattgttgatatttttcagaacgacatcaccgtgtgtgtcatgcgttgtgctactggctccacctatgttccttttgcatctttgtttaggcctcgtttagttaaaaaaaaaagcctttccttcatcgcatcgaatgttcggacacatacatgaagtactaaatgtgaaaaaatatatatattacacagtttgcgtgtaaattgcgagacgaatcttttaagtctaattacgccataatttgataatatggtgctacaataaacatttgctaatgacagattaattaggcttaataaattcgtctcgcagtttcctggccgaatctgtaatttattttaatttattttattattagagtacttttaatactttaaatatgtatccgtatattcgatgtgataactaaacctaaaatttttttccaaataaacgaggtcttagtctgccgattggcaaatgaagttagctactccacactacatgattgagtaaatacgaaatgtggaacagtcaggcattcaagctcaaccggcttggatatacagtaacagcaacatattcttaagtttgttttaacagtattgacttttcccttgatcccatctgcttatgaaaagagcatttattcatgccacaaatggtacaatgccacgttgtcatcttctcctgtaagagcatccccagcagctcatccatatttaatcctctaaatacccatatggatagtcatcaaaaaaagattcctcattcatatccattcccactccaacaaatcatccatattacgtcattcatatcccaccctcctatattttaataatatcttccaactaaccttacttttacttttgtatttttaagggacatattttgaactactaaattttaacagtgttatttatcacgataatatttcgaaatgagtatattttaacggatacatttttaatggatagttttttaattgatatatttgaattgagtgaagcattttttttggatatattcgtagcaacatccaaaaaaaaatgaacacaacaaaaataaacatctgtatatttccctttctctactcaggctgcacagtagtgaacatactactagaatttttttaaaaaataatacgattttaatagaaaatcgcaaaaatataggtcggttcgacgaaatcgtaaatttagcaccctgtcgaacaaccgtgtctcgatagaggtacttatcgaactatggcagttcgacatgtacctgtcgaactgccatagttcgatagggtagttggtccaagggaaaaaataaaaaaaggacagtaacagtgcctggcaggacatatcgaacaagcaaacttcgatagggtggcatgtcgaacttggtctcagctacagtgtgctacagtgtttttcctctttttaaaaattattttatcatctgtcgaactgccggcaccctgtcgaactgcggttgttcgataggtaccctgtcgaaccacggatattcgatagagtgccaaacttgcgatttcgtctaaccgacctatatttttgagattttcctttaaaatcgtattatttccaaaaaaaatcccatactactactactctttctgcagaggcagcaggcgaggggcagcagcgggcgtgcggtggaggggcagcggcggccgggcggacgggcgaggggtggcgcgggcgtgtggccgggagggcgaagggcagcgggcgtgcggcggagggcggcggcggccgggcgggcggagggcggcggtgggtgtgtggccgagggtcggcgcgcggccaggccgacgggcgaggggcggcggcggacgaccggacgagggcgcagatgggcggggaggaggcagacggggggaggagaagctcgagggcgctgctgcgggtgtccgacggcgggagcgccgcagtggatcaggcgacggcaggaggacaacctgggcgcgggtggctgacggcgggagctcgtgctatggcgaaacctccagatctggtacgcctattcctccccaccttcactgctctatggctccaccagccggtgtaccacggcgtcgcctgctcgttccggaagagggcgggagctcgcgacggatgtggtggttgggatatggcgtgaggagagagaaacgccaaatctgacgtttctctctccaatatggagcacgatgactagatggaagatctgctggagcatcaattttctctcagatactctatttttaggatggagtagctgctggtcatgctctaaggccattcgtaatacgctgatgtgccattcagcccggagagcccagctcggagattctactccacgactgtgtttttcattgctccatgaggaacgcggaaccaattattgctacaggtacctcgccaggatttgcatgtttggacccaccactttcatgccccgcgccacagggaagggagagggagaacgggaagaaagcatccgaccgaaggaggccgcatcgactgccaccgaagagctcaacagggacggtagcctcccgctccgtgccgccgccagggagcttgtcgaccctccctccagtttgcaccgccaatctccatcttcatcgctcgatccgcccatggcccaccaatggcggcgagatgcagggattggtaggcaaaatcagagaagagaagggagagccgcagccctcgacggagctcgcctcgacagcggcgcttcatcccttgtcagcatgagccaccgacggatccaccggattggagaccgaggggggggggggcgtggggcgaagctcgcggcggcgtaggcctgagccgctgtggggacctcgccagcctcaatccgtgctcgccgctgaggccctcctcgatccacgccgccagaagctcgaggtgggaaatgccgccgtcgctaagctcgatatccagccgtttccttgtcctgtcgttcgagcttgacgggaaaggcgacgacgggaccggagaagagagaggctggtgcggcgagaggagaggagcgacgaagagggagaggaagacatgagggaggagagggaggcgacggagagcgagaggagcttgaggtcgaggccgcgccaccgaggtcgatccggagccggcgggggaggcgacggagagggagaggacctcccgagattagcagctcggtgccaccaccgttccgccgccacgccaccgtcgtccacggcttccgcccctcgcggacctcgcacgtcgcccgctgccgtgccaccgactccgctgaactcgccgacctcacccgtccctcgctcccactccgctgaccccgccgctgcttcgggggaggagagaggggtggatctggcgagcaccgacgccttccttcgcctgctgactcagtctgctagtggggaatggattagaggagagagagagagggggggagttaagaagtaaaaaagatagtactagtgcacccatctattatctatctatctatcttctatcttctatctatctatctattatatactaaaagtccattaaacatcctacaaacgctctcaagccgctatatggcgctcctacaattgctcctaggccgccacgtggcacaatctaatctcaccgtcgattttcatttaaattgatggacccgttattttataccgttagattagatctatgctgttaattttcatttaaattggtggatccattattttttaaccaataaaccagatctatatataatacctttatgctatatgtaatgtttgcctgaaggaagaaaacatcacgataaagatgaaaacttcctcatgtttaacatacaggcgctactaccgtatgtatgagttcatacgtacgatacaaatacttccatacgtgcaaacgtacatgatctttcctaatcttgctggaaaaaaaatacacatgaacttaaaaaagatagaagaaacacacatccataaaaattaacggtctttaaaatatgatttttgataaaatatattaattcataaatataaatatatttagttaaataaagctctataataaatatccaatcaatgttctttaaaccatcttctaaatctatctattatatattaaaagtatattaaactttctacaaatgcttttgcactgctacgtgactctcaaataaattagagaaatcctaaaaatctattatatactaaaaatctatgaaacttactgcaaacgctcctacatattttcacgtggcgctctaatttagagtaatcctagaaatttagagtaaaaaaggaaaatcatccaaccttcaattttcacttaaattagtggacccatcattttaaacattagattagagctcttaaaattcctattgctaatctctataaaaaaaataacgtgcttatgtcgtacgatcatctccctaccggaaaaaaaacaaaatttaaatacctacaccatatatgatgaaaaaaagataaagccaaaaaataaaagaaaacataaacacgtacattgtagaatcggaaagaaatactaaaaaggaaaaatcatcgatgcctgcacagatttattgtgaacagcctttaatatacgattttaagattttcatccccaatctaatattatagtcccagtgtagatagaaattcctttatggtctaattctgagcggtagtaaataccaggacttagtaatatttgattgatcacaatttggtatattccatttattataaaggttgctaaggaattcattataggaatgcttccattggaaatggtttgcttttgcacatcgaaacaaaaaattaaacgtgtggatacgtataattcggaagaatagatgagtgattcatactcagcatccctttcttttatcgaaggttctagcaattgatatcgggattttaataggtgagtgattcatattcagcatccctttcctttatcgaaggttctagcaattgatatagggatttttatttagatctaagagacattcttatcacataaatagtatattaaaatctaccatctattttacagtaaatatatttatttttttattataggataatctaaattcccttacagtatatatatagtgatgtatgattccttatagtattttttttaataacaaataagatgcccgtgtatttgtgcggaattcctttccgatttatattcaggaaatgttcttcaatttatattctatcgttatagtgtttgaaaaacaaactacaatacatacccgcgcggcgcgggctaccttcctagttataaataacttgcactgtagagcatgtatggttcttgtctagttggtatatgaggtccgataaaaacctaggacgcgctgctaatgccctaagaaaccaaactttacatgttgccaatattggcttattgctgcatcaacgctcaaatctcgcactgctcgccatacaccgacgaccagctcggaccacctcaagaaaaatgacaggtgcaacagcatcacaattcaagaacaccctcaggcgcatgctcagcgctcctcctcgccgccggggcggctcttggcgcagacgctccgctcggcgtagagctggtaaggcggcgcgtcggtggcgagccactgctcgacgtcgaacgccgccttggcgcacccggcgtgggggcccgtggcggtgacctccacggacttgcagtaccacccgtggtgcgcgccggcgccgtcggaggtcaggttcatccggcacggcggggacggcaggcacggcgcgcgcccgctgaacacgtcgacgttgccgcgctcgtagtagtcgtgcccggcgcccatgagcccgccccaccgctccaggtccccgacggcgaagccgctgccgtccgccgccgcgagctccacgccgatcgccgcgtccgtgccggccttccagatccacccggtctccacgtacagcgtgtacacgcactcgttcttgtcgttgtccccgccggcgaccagctggccacggcgcggcagcgccgccacgccgtccggtgatttcgatccggcggcctgcgtacgtgcgcgtatgcaaaaacctggccagatcaactcacaggtcacagcagcgagacgaccagaaaagaaaatgcacgtaccaagaccaccatggaaacgagcgaggcgaaggcgaagcacaagaacttgtcagcagccattgtcaaaggcttgaagaactccctctatttggaatttttggattggatgcgcgctgctgtgagctaagctgaagaggttgatatataggcagtgccagatctaacagtgacttgttagattttcttatagagagaacagttcgtgcaggtgtatgccactctatattgaatgcatcttccaacattttttatgcttggattaggtgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataaactagaggacgtgctcagtgctcagctcagctctcctcctcggcggcggcggtggccgtgctgatcttgccgcagacgctccgctcggcgtagagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcctcctccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgtaagattaaactagcatggtggcccgcgcagattgcgcggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatatcaaattttagttatttgtaaattatatatattcctatatgtactctagacttgtcttttaattttttttaattccgaattttctgtaaattgtatttctatatagactctatgctcttcttctaatattatttatttttatttctaaattttcatattatattttatatacgtgttagttattaattatttttaatgtcaaattttagttatttgtaaattatatatactcctatatgtactctagacttgtcttttaatacttcttttttttaattctgaattttctgtaaattgtatttctatatagactgtttgctcttctttcaatattatttatttttatttttgaattgttattattactaattgcatttatatgtggactctaaacttatctttcaatattctttaattttaatttcgaatttcagttacttctaaattgtatttctatatttgtattcctatattgaccttaaactcttcttcccatgttattcttaatttcgaatttcgaattttagttatttgtaaattgtatttttatacatactctaaactctacttttaattttattatatttattccaaattttagttagttttgaattcctatatggactctatactctacttctaatattccttattttttaattctaaatttctacttttttcttaattgtatttctatatggattctatactctacttctaatattccttattttaaattgggtgaatagctaatatgctccctgaagtttcacttcgggctcagtttagtccttgatgttttaaatcgtccaaacaagtcctccaaattaatcatttgagttaatatagtgcttggacccaaaaaagtgccacaaattaattatttgggttaatataatccttggacccacaaaaagtgccacgtgagcatgtcaagtcatcctcgcatgcagcggtatgaatgaaatgaacattctacccttatataccatataaaaaagaaaacaaatatttcacacatgtatggacattttagaattgtcacttacgattgctgcagcctaatcgtataaattcctttgtcggccaccctccgcaacaatgttgggcctaggttagctttttttttgtgtcttttatttcttttctatatagtatataggggtagaatagtcatttcattcatatcgctgcatgcgaggatgacttggcatactcatgtaccatttttttggtataaggactatattaacccaaataattaatttggaggacatgtatagacgatttgaaacctgactaaactgagcctgaagcgaaacttcagggaccatattagctattcaccctttttaattccaaatttctattatttcctaattgtatttctatatggactctatactctacttctaatattccttatttttaattccgaatttcagttatttccaaattatatttctatatggactctatactctacttctattattccttatttttaattccgaatttaagttatttcctaattgtatttctatatggactctagtctcctcttctaatattccttattttttaattctaaatttcagttatttcctaattgtatttctatatggactctagtctcctcttctaatattccttatttttaattccgaatttcagttatttcctaattgtatttctatatggactctagtctcctcttctaatattccttattttttaattctaaatttcagctatttcctaattgtatttctatatggactctagtctcctcttctaatattccttatttttaattcagaatttcagctatttataaattgtatttctatatggactctgctttttctttttctccgattaatgtgagaatttctaggccatgagagcgaacgtggaggctcatttttctattcctttaataatataatagatgattagtgtactgtttttttagatgaatgtgtcgttttttatgctttgattagacaacaagttgaattcaagaatgaggggatacaggattcttcaacggatcaatcgatgaatcgatcatgtgatgcacaaggatgatgtatcacgtagggggatttaagtcaaacaacgagcttactgtatattcaactgctctgctctagctggcctgccagtagagcacaatagtgctcagatatgatcaccatctatgcatcttctgttttggaggagttgaatttcattctatactcggca

SEQ ID NO: 60907 - DNA, 611 bp, Oryza sativa
tacgtgtttacacaagataaccagggaaacaaaaaaaacaactagcttaagacaaattctctcagttgacagtagtatcctcattatgaggcaccaattacaaacgtatctctagaagttaaatattctaacaagaaagaggcagcatatcttccttctaatattcaagatttattacagaaaatagggaaatagatgtgtaatattattaaatgaaggattttgaataaaaaccatatatgctgtgcactaggattagtttgtttcctcctgcaaataaatatacccaaatcttgcagtgccagaaaataggagtaaatgataatcttaaaaaatacaagagctggactcgtgagtccaaagaacagcataacactagccagccaacaattgaataaaattgctagcatgagtggcaagaaagagtggacaattctggttgaaaactgagcttacctcaattgtaacatcatggtctaatgtttctgttggtgctggagtatagtccataggtgtcaccatacgaggcggaatgagagatgggtcccaagaaacaaaatatatgtccccgtcaagatcactccctgaacactcattaggatgcggcctgc

SEQ ID NO: 60908 - DNA, 554 bp, Oryza sativa
cagcctcacggggaagcaaccgcggcctattggcttcgtatactgttgcgaagtagtacgtccacaactccatcggaagaaaaggatgtgaaaccgtcgtggaaagcggatcctgcgagagaaagttgtcgggagaaaaggatgtgaaagttggccggcgagacagagaaatgcaacgcagaaagatgcttcctgctcccctgcctcagtcccacgcaggataaaaatatatacactaccacgaatgctgcatgttttgtacttttacataaacgagtagcgtcatattgcagtttgcaaagtagcaaaaggtaccagtgaggccaaaaagaaaagcatagacattttccaagacgtaaagaactcaacagcacaacacattcacccggagggaagtgaaaccgaatggggaagtagtagttccagacttgcagttccgtggcatatcatacagcccattccaacaagatccaaaccatggaccgtcggcccagacaaccatactaccttgctcgttggcaagtggctagtagcctagtactgggctgcaggaa

SEQ ID NO: 60909 - DNA, 638 bp, Oryza sativa
tatgggcccttttagaacgttgaaatcaaatccctactgtgcgttacttatttgggtgacaggcattagcggtttaattatgaactaggcaattataagtgtatgcttagggatgcaagtgggcaatccctctactcatataaaaacccgcttaatagttcattttcttgcttctagtacaaaatttggaagaaaaaattaactagaattgtgataagggcacacttgcatccctatgtatgctggagcatccataatccagttagtttttgtatatagaaagaaataaaatttgctgacactaaagtaattttgactcgcactcttttttgtgttgattaactaacatgtactggtgttgattaactaacatgtactgaattttgttatcatgcttgtatttttgtggtgattggttgctgttgtactctctatttctacttggagatttactgattgctttattaactttcttgacaacttagatatgtccctgcctattcaacgcggctgaagtttgaggacaatgtatggcatgttcttccagaaactcttcagacccttttagtgctgcagatcctgtgtggaccgaaagcttctggaatacaattggcctcagggtgtatgggctgcaggaa

SEQ ID NO: 60910 - DNA, 1121 bp, Oryza sativa
aaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttgcaaagcaacgtaagatatcccaacttatgactgctgtaacattgatgtaccataacttaaggatcctcttacctttctttttaggagatgctgcaacgttggagtcagttccggatcttgtgaaggcaatgtacataaacgttgaaagcttcccttgtgtgaggctgttgaatcactctggtcaagtcggttgttctagtgagtattcggtttactcttattctgtatgcttaaattaagatggctgtcattttctatcatcattgtcaaaggctagccaactctgccttgttaagagtacatggttattggggtctccattatgtaatcagatcctgggcatgacaaggttattgcaccgattgtaagatttggaaacagaaatgatcagttggttcagccgtcggcggttcttcttcccttaaatcagatgacagatttctttctgaggtataattgcttagatagtctaaatctcacaaatgatgttacatatgatcgtctttcaaagttatgtttccttgaggtgctaagagatgagaatatttgctacattgtttgctcttgtgcagggtatccaatgatccagaactttatcgtaagatagctggcgtactagttgaggcaaatggcgttgataacatgctaggtttgtggatttgttttttttatgtattttattgcctttaattccaaaaataatgtactgttctgactttgtagagttttcaccggatagaaaatttcca

SEQ ID NO: 60911 - DNA, 89480 bp, Oryza sativa
taaaaaaaattcaactacaaaggtgtagatcgcgtcgagggctacaagttcgatataaagtttatcttcattagagttcacatgaaaaagttatgaattatttttaaatataaagtctttagaccgtcctatttgatccagatgatattcaaatccaagtttagggaccggggtgacacaactgaacaagtttgtggacctaaacgagtgatctgcaagtttagggacgggatgacacagtcgaacaagtttgaggacctaaacggtcgatttgcgagtttagggaccgggatgacacagcggtaaaagtttagggaccggtgatggactttactctttataatattgtctcgacagtttggatccagctggcgaatcaagccacagtgcatatttgttttaggtccgcttttctgacctaccaaatgggctgagaggtcgagttcacgtgaatagatgtgcttttattaatggtactcgtgataaccccctttatattgatcacctcaagttgatccgttccactcctatgccgcttgttaatgtacttgcttatttagatgagtgttttttcgttactatctccgcagatgcatcatgattcggtaaatatataaaaccatttctttttacatgactaaagctaaaacccaatatccttccctttgttttaaaataatcaaacacacaattacatagccatgggagagatcgaacaagctgtactgtgaatatgtgagtatcccaaacggttttctttgccaaactcacggcagtgcaggccataagcgtgacacagaggatcgatctaggactaggacagcagcggatccgtacaccggaacttttaatttgatgaagtagtactaaacatggcagctcgaacaaaactaggttttagagatccaattcatggtggaacccatgcatgtgagcaccacggggtgatgcctcaccaaaccgccgtgcttatctgactcagcctccccttaaaaataagagacaaagaccacctgatcatgtcgaaaacgtcctaagagaaaggataataatacagccagctgcttacttatagcctatctatcagctcactcgtataatggttaactcttcactataaatatatggttcacatgtctgtctcacagattttcttggttcctgtgcctaagccggctgtaaacttacagcccgcttctcatctctctcctcttttctcctatccacttcagcattcagctttcttatagctcactattatacttgctctaatctcgatcgatcgatcgcccatggtggcaatagtttaatccccagaggccacaagtgtcaatcatcaggtcgatgggaagaaaagggcaagatgacgagattgacgccgtgcaggggattcccaaatggggctgattcgtccttttcaggtgtacatttcccatttttatactgcctgcctggagctctgcgatgaacttggacaactttatagggaagctacgtatactttgccagcctctctctccggttatcgcaagtaataaagcctaaagcggcacgttactctgtaaggaagttgagtgttaagaaggtaaagatgccatctgagcagtgcattacacaattgagttgattggtcagtctctactatagtagtagtacttacctttttcttatgggaggacagttggtagtgctagctagcttaacaatattctactttgatcatagaaaacagtactagtactaagttagtactacgttgtcgaagaggaaaaaaataagttatctctttgggacttaacaatactctgtttcctttcattagaaaaaaaaaaatcagtactgctaaataagcttatcttctggtacacgcggtacaggttctccattattttttttcctagcgagtccagcttcctgcttccctacctaggaggtccaactccaacccaacgcctccatgtgccttgcccctcctccccccttggccgagatgatgataagctgctacgccttgctcagttgctcccatgccttttgaacgcttttgagaccgtgaccaagctggcgcggcgctgcatgcggcgtgagaacgagcgtcgcagcacgacgcgcgggcaccacgacgactccacgagtccacgagcgttttcacgctcgtttcgcacaggctcacgcgttgccgcagcccgttttgcagaggcctacgcgtggacggcctaggctcgtggtgcgcggagcgggccgggctttttcagggcatcaccggtgttagttaatcgcagtagaaggggtatatgcccccgtgaccccaaatctcttcgaaagaaaagaaattcccctttttcttcaagttcaaaatatcgagttacatttatttaactggatcatggtatagtagtatcaagaggtattagcaatcttccctgcggatgatggagcccaaatcgtttaccttacagagatcaatcacaattcatttccataaacaaaaccgtatccgaaaacagtttgaatcgatctacagggtcatgtaacaacaaagatccgtgtaaccaaagcaagaaaaaaagaaacaaggttctcaaggatgggagaattgagatatcctcttaggttgacaagctgccaccaccctgttgccaaaggttgatgatatcagtggcctgattcagaaggatgatcatctgtttctgagagatccactctttctcctccagctttgctcttagctcctcccaggcatctttccgtggccagaagtagtatgggcttaacggaatgctgccatagccgggaaccaactggtcgagggctatgccaatgttcttctccatccatatgaacttcagaacaagcattggatcctgcctttcaggcaccttaaccttgtactgcgatacaaaatcaattcgtttcaaatctcataatgctaatactgattttgcatatctgagtaaaataaattgtgcagttttaacacagctcaagtcgtagtaaaataaattgcaacaactactgtacgtgttccattgacaacttcatttctctacaaaaggccccatttttcaactgtgagggtaactcccatataatcaaaactaatccacttttagtgtacatctctgaaatctgatatagtgatgaaaaaggaacttattgtgcctgttaatgttgttacataatcacgtaaatagctgaatgaaaaaaaactcctttcatgaccaaaacctgtcaatgctacagtttgttcaatagttcagttcttgcttacacatacaaccaaaaatggcacacgctcaagtttgtggacatgctttcatgtgctcttcgcctcttcatcactagcatacaccttttatctgcagaagtgcaaaactgcaccaaaaggacagcccgagtgcccaaacatgctcaactagactagaacttctctaatttactctacttgtgacttctcttaagctttcagctgtgcattgtgtctaaagatttactctactcgtgaattcacccaaatgtacacctcgtactgtatttcacctatgagctcaagtaatcagttcggtaaccaaaattgattcaagaaaaatcaaattcatgcgaaaccaaatgtgattgaactccatcctcttcaaaaaacaacacttccttctgaaattgagctcgactcggtaaaaaaaaaaaccccgtaatttcagtcactggcatggtttggagcggctactagcccattacctcctgcgcttcctcgccggcgctcgcatccccacctccgacttgcttctcctcttctccctcctccgcttcgacggcgccagaagcggcggcggcggcgaggccacggagcgagcgaaggggaagcctcctgctgccgaggtggacgaggcgtggagtggaggaggaggaggtggtgcagggggaggcggcggaaagcttgggccgggagatgcgggcgcgcgaggcgagggccggcgtggcggcggggtggacggacatcgccagcatcgtgtccgagtccgaggctcctgtgcggataagaggaggaagacgatggtgcggggctgcctcctcttatctttacccttaataatccccttctcgtcagctattagatgtgggctagaaagttatggtaaagcccaatatggcccagcacaaaacggcccggcccagatccaatctaagtaaaaagctcacagctcaatcgtctcggttattcgagaataaacgaaatggcatatttgtaaataaaaaataatttgtgaataaatcttttatatatatatttttaacgatctaaaagcaaagactgaaaaataaaccttcgataaaaaaaataaaatcaaccccaaatttaaaggtaaaaatttaaattttgactgataaacataagtataagcgaaaagatgaggccgtccgtttgccttcagcagggtttgcaaaaccgtctgtaaccgtgcgattaccgcgcttaccgtggggtacggtaaaagggaaaccgcggtaacccccttaaattcaaataaatttaaaaaataattttaaattttgataaattttacacggttaccgtgtggtaaccccggtccggtggtttgggaaaccctggccttcagtagtgctagtgcccagttgccaaccgcttgggcgtagtaaaaactgatagtggaatgaaatgaaccgggtacaaagtactgaaatgatcgtaagttttgaaaaaaaacaagcaggagtagtaactttgcaagtaaggatgctacattctctgatagtagtttcagtgttttacacattctataagaacaccgaacaaaacaagcatcgaatttcaaatgtcgatacagccttgaacagttgaagttcttgcccacaagtttaatcgaaagcattgtcaggttaacccaagaacgtgattaataattactaacattaatattagtcccatcttattcgacaatcattgctaaactatttactgtgtcatgagatcgaatcaagtttgatgccggcgaggttttctccgctcagaagtccggcgccggcgagtacgcgtgggaggcgggcacaaccacggccgtcgacataggtgccgacgaggagttcaccaggttcagtatgctgttccagtagttcttctcctcctcggtctcctggaactcgccgtcggcttccgcgtctctccccgccggcctcgggatctggttcaaggagccttcgaggagtaggcccgtgaaccccgctccggcgccggggaagcccacgtcggcggcgtcgacgtcgccccagtgctggtccttgcacgcctcgtcgtacgcctgcatgggctgcatggcggcgcgcgcggccgccgcggcggcggcgccgtgcgcctccagcacggtggcgagcaccgcgctctccgagaagctcagcgtggacgtcggcgagtcgaggccgtgagccgccgccgccgccgccgccgacgcggggggtgccgggaggtgcggcgcgcccggggtcgcggaggccgcgagcgcgcgcagcttggcctcccgagccaagcgcgcctccgcctcgagccgcgcgctctcccactgcgccgtgtggctgaggtgcgccgcggccttggcgtgctgcgcgcccgccgcgccgccggccgcacctccgccgccgccgcccgcgccggccacgtcggagcgcggcttgtgcgtgaccgggtcgatccccatcttggccagccgcttctttaggtgcgtgttccagtagttcttgatctcgttgtccgtgcgcttcggcaggtgcgtcgcgatcgccgaccacctgcaaaacaacaacaacgccaacgccggccaagaaaaaagatcaggaaaatcgcacgtcaaaagccctccattcgcagtgacaaaattaaacaaacagcactcttgaaaacgtaaataatcggcggtgtgatttaaggcgtgcgtggcgtagtacagacagagggcagagatgatcggaagctgtgagtcaaaatgggaagaggggcaggtggcaacagtggaccaaaccccagttttggtccacaatgatgggggggctcgcctccttaaatgacgagcttgaatgccgaatcatatgggagaaaagaaaggaaaattctgggccgagcctctcactgcccaaccttttcacactttttcccttgttgatgcatgcattgattggtctgtgctcacagctaatgcgtggttgttcgacgggcaaaagatgagcaatgcagcattacgtgtgaacaaaacgaaaacaagtgatgattctgttctaacgtaagaatttttagcctagcttgtgtgttaatctatggacagtacggtttgttacggacaaaatgctgaagcaggtgtgtacggggacagcaagtaagtagcacggcctgcgaaatttacacatcccctggctaagctccgtgttccaacccttgcattgcataaccctttcataaatgtctgccaagactacggtgcagaatggtggctactggctagtgtgttcttgacctgccggtcagcaacaagtactagcagtcaaaattcgtgcaggagaatcaagggttccatcgcgattacggaattaaatgtgctccgggtgcgaggtgaagaacgagcgagcagctagcaggagggagagttgtgcactacgtatcttgtatgcatgatgcatccatgcgaaaacgaagtaatcgatcacctgttgccgagaagggcgtggagctggatgatggtctgctcctcctgcaggctgaacttgcccctcttgatgtccggccggaggtagttcgtccaccggagtcggcagctcttgccgcaccgctgcagccctgcacacgattgtcacggtttgcatgcacctcagatcagagttcagagagtagccagcctcgaggatcgatcgcctcgaccgaacattgcagctaggattgcagaggttgagaagaaatttaagctagataagcggcgcttaccggccttggagggtagcgagcgccagcagccgtggccgtgctgctcgatgtaggccagcagcttctggtcctcctccggcgtccatggccccttcttgagcccctccttctcgcagcacggcgatcgccccatcgccggagaaaagcaacagcagcagcgagctctaggaaaactcctccccgatgatcttcgacgccctctggttcttcctcctctcctcttctctcgggctcaagtagtaggtctatgtgtagtagtacgtgatcgaggcaattcactacgagagatcttctttgcagggagctgtggctctctgcgagtgactaatgcagcagcagagtcagtgagagtgtgtgtgtgtgtgagagagagagagagagagagagaggccaaaagcgaaagagtgaggcacattgcgctgcgtagaggcataaatagaggagaggagagggggtacggtgtggctggctcggcacgcacgactcgactcggctcgcgcgaacgactcgatatcttcttcgggcgccgcgatctcctgccggcaaagtggcctctcactgtcagtgtacgtaactccaccccgcgagaggagtaggggcaggaccgtgatttcaccccccacggtgtacgtgtgccccaccccgtcgccgcgggaggaacgaacgaaccatcgctgccaatcgcgatcccacttcatccatccacccgatcagagggcgtgcatttaactcggcgcggggctcgtctctgcctctgcctctgcttggtatatgtggacgctacactacacatgcctacatggtcctttcctcgcgctaccgcgagtggcgtggacggcgtacggcgcctgtgtcgtcttcccccctctatcgcccaatccatccatccatccatctgcgtgcgtgcgtgcagtgcagtgcatgcatgccatgcgctttcatggcgctgccctgaccagcgctgttgctgccgcaggggagggggaatctcgcgcgctacagctcgctgcaccaaagagtggtcaggcgcgcgaacccgatcgatccaacagtgttccagtacaggacgcaaattccaacgcgaatcgttagttcgaagctggcacagcgtgcgggcgcggcggccgatcgaagggagagatcgaattactggctggtcccgcgattgttcatatatcgcgcgatcgatcgagcgagcggaggagtgcgtgctgttccttgtcaatagtagtatacgcttggcccggcccccggcgtgggcaggtgaccagtagctagctaggcttaggctagctcgctcggcttgcccttgcccccatccgtttggacgattgacttgattgcaaatctcgcggcgtttttgggaacaatttgttttactcattcaattcggtgccattgccgcaagtcacgactggcggtgcatggttcatgattgcgtcgcatcgcatcacattgcgtcgcattgcatgcatgccggtttcagttgtttgcttgctagctcggtcgatcggttggagtgtgagatccccgcgccggccgctagctcctggtttctttgcacatttcgcttgccatttcggggcgctagccatggccgatttgtggatctctccccctgcagattgtgcaggcgatcgtcccagatttaatttgctgtttgttgggccctgtatgtgttgctacgagtcgcggctaaagtgatctctgaaattagctggttgctcgtttgtggtaggtactctattcctagcgttcccatttctcagtaaagcttttgctctcctggaaaaatgtttgtcagtttccaaggaggacaaacggaagtctccaatccattttctgaatctctgatctcgccatccttaatcacgtactaatccagtactgtttatcacgccatcaagtcctagtccaacttactacccaccagatcaacagcttactgctgcgaacattgtacgggaggctgagaaaaaggaacagtactggcagtgaagggtgatgatgatgtacggggtagagagactaatggaacactctgtaaaattccgccaacctgcaattgcaaggcctgagcgcagggatggcttttgccatttattccgctgttcccggtgcccaatcgcaacagtagtacagaaggaccaccgctgtgaggtgaggggaatcattcgatcgaaacacagccgcatgtgcgtcttccccaagaattcaccgtgttctttttaccaccatcactgtaaactgtaaagcaaaattagcttcgctacttcggacacggatcctctacggtattatacttacagtagtattggctaacaggtgaacccgatcccacgtgtcagcgatagctaatgtagatacaatatacttcagacgattcccactgtcttcacttgcaccatcacatccttcagactttagaacttgctgtgaatgtcagtatgtcacatcacggcataaaattataggcacctgccagttgcttatttactgtactagcttgatcgatggcatggctctcaacgagacttaatcgatgctttgcttttgtttgatttcgtatttccatggcctacgttgggttgcagatagatgctgctgttactattctacggctagctacgatgggtatatacttagatatgcatgctagtagtatcgatcaaattaagtcctgaacagtggaacgcacagtacgtgctgcggtgatttggcactggcaccggtgtttaattagccatgcatcagtagcagtaggcaaaaaacttcaattgcctactgaagtagatcgacgccattagtacgtagctagtagtatgtagtatgagctaacctgtgtctagtctgcaataggaaggtgagttaagcccatccgctccgctgccattgcaccgtttcggaaagacgatatggcctcgccaccagatcatctgaaagcgaacgttttctcggacggatctggtagaggttttacgtccaagcctgtgtccagaattgctccgtcctaggaactgaaactctgaaaaggcaatgcgcgagaaatgggcacggcattgattgaagaagaggatcgatatgatgatcgtctgtatgcagtggagtgcaaaccagaatgtttgcctctaatgcatggctctagctgggatgcagacttaattcatttagagtcgagtgattgcctggaaaacgcatcatggtttattacaaactctctatcgtttagcgtgcagacagaacagtacaagggggggggggggtgaagtttgagttaattcaactgttgatcgcctgacatggccattgctcatgccggctggaccagctgattgacgtcgagaggggaatctgatcatctttatagcgctgacgatttgcaatagcgcttgtactactgcagcatcagggcagaagtttttcatctaatgtttttgcagacagcagaagttttccatctaatgttttgcagagatgcgatcaagcacatatatttccattaatgttataaaatcttataggactactatgtaataagaacatgcaaggcagaaaaagagcagctcgccatttagcaagtctgcgtgagctttattattgcgcaaaatggtggtcctgatgaacctttttctagggtccttttcttctccggctctgcgtggttttcctggtttttggcagcaacgtagcaccctggcctggtagacaagtatttaaaggtgtgagccctttacattttcgtcctacgagtactactcatcttttcttttttttcttttgaaaagaaaatgatagcagcgtactgaagtccaatccggtacattaatactccgacctctgttctcaggcctggtaggaccgtaggactaaggccgagtttagatacaaagttttttttttcaaactttcaatttttttatcatatcaaaactttcctacacacataaaattttaactttttttgttacatcattccaatttgaaccaaacttttaattttagcgtgaactaaacacaccctcagtatagtacactttttggctgtgtttgcaaaatgggtttggaatatgattttccaccccttcaaagggtaagctttaatcttagccatccattcttctcacccatttcatcatatccctccattcatttctattttttaatcccacctctcctaacccattttccaaacattccaatccaatgggtttcagcatcaacgctgcagcaatattggtctttagacccgaaatttgacctagttcactcagccaagttaaaaaacctactccctctggtcataaatatgtggcatttataacaagatttgatagcactgttgatactttgtattgatacttagactgtaagtaacttttgaaatgcttaggtaaaaacgaataaaatatatagtttgtgtggctttgtctagaaaagtaatattaattataatatcataagcttattaggttttacaaacttctcctatatcaaagcgttaaacttttgaccaaactttgtgctaaacgtttactatttacggaaagggtacaaatctgtcgacagattttttttttatggatatctttcgatttctggtccattgatttcgtgattagatccgtgctggttgccagagataaaaaaacacagcaaactgcaagatcggggattcgatcgtaggaccaactggtcgcacgcatcacgccttaaccaagtgagcagttattcaaatttgaactgaaataaaaattacacattagttaaacagtaattacatataacttacactgattacatttgaaagatttttctaaaaaatctgttgctagaattttagatagtccctaatatttatgactagagaaagtagctcatccattaaacgaccggacttgtttcaaaggtcgatcttatctccgaatgcttatacaatcctctagaattgaacttctgcacccctccatgcccccagaagatcaaaaagataaacaaaaatatagcttttggcaagggattatctttgaaatgctcaaatgcaaaagtccagggaagcagcttagggcacctccttatgagacacgattacacagtgcacggttgctggcttggttaaagcagcgatcactctatcccacttataaatatctctttagctcttttttaaacctctttgatggcttatatcttttaaatcatatattatttaaagatctatttgcactattatactccactaaaaatatgtgacaaaatgagatcaatgttgaatatatttaaatattttattaattaaaagtaatttatttaaactgtagaagtaacttagctatgcaatagaagtaactctctatagcattagcattagaagtaattacattatgtctgagttgatgtaagaaactatgtagagtaaattcacaagtaaagtgtagggaatattttcaagtaaatacatacattatttaaagtaattattgtattattttttaaaaaaaaacaaatcttgtgtcatatagaaagtaactcttcatgatattaaaagtaactacactgctggagggaagtaactttttaaacaatagaagtaactcttgataatattagaagtaaatacactcctagagggaagtaactataaaaaaataaaataaaaataactcttcaaggtattagaagtaattgaaccgctagaaagaattaacttttcacggtgttagaagtaaccttttgcattattggaagtaactacactagaggagttaagaaaattttttttgaataatttgaatatattcagtatgggtgtgtttggttgctagtatgtccctagtctggctcgtatccctcatccagggtgccctcaacctggataggataatgcaattggctatgtttggttgtctgcatgggtttatcctagatgatatgagatgatgtttggttggttgtatgacaggatgctgtacactagagatggtgtttggtttgttggttggaccttgggtctgggtgacctcttcttacatatggtgaccatggtgttactatttaagccaagttttcgaaaatctcgttaatttcatatatttgacaaatttaaacaactagctgtcagtaatcatgtaattttttaacaaaaaggaatcaatgtgaaaatcatgcatgccggtaacatatatatatatatatatatatatatatatatatatatatatatatatatatatatatatatatatatatatatatatatatatatacacacacacacacacacacacacatgtatatatatttctctacctctcaacagccgtcgtcgatatcattagcatgtatatatgcgaatattctgataaaagtggtaaccatctagctgtggaacataaaccataaatttataaatttatagttatccagtttaaaaatcaaaatcaaagtgaccatctttcccaatctctaacagcaaggaaaataaaaagaacaagggcagaccaaaaaatcatgcccagacatgttagaaaggagaagaagggaagacgagcagccaacgacgggggaagatgagcagccagcgatggtgggagacaagcagctggcgacgggggggaggagcagctggtgacgggggaagaggagcagccggcgacgggggaaacgagcagctgccgacgaacggagacaagcagcctgcgaaggagggagccggcgctcacgcccgcctggcgatggaggatgggcgcagtgaggttcctggcgagcagcccaaaccctagctttttttcgttgtgaaaaaatgaggaagagggagaagcgctcgaggagttgaggcaacgcgcggtgaccccatctctttctgcctgcacacgcgggtgcagcctcgtgccctgtcgctgcacgccacgagccaggccgcccagcaaagctcaaattggccgtttcccctcagcctggctcgacgggcctttttgcatctcctaggcctggctgagtcccccgtccaagcaaccaaacaacctgcaggttgcacgccagatgcgggccaggtgcggtccaggcaaccaaacacgccctattagactcattttgtcacatattttaagtggagtatgatggttcaaacggatcttacaaataatatatgaataatatacttctaaaaaatataactcatcaaagatcctataccaaaggaaaatatacttttgtaacggtatgttagcctcagtagtatgcacgtgaattgacatgacaactagtagatagtatgtggtcctctttttctagcaagtggtctcgtttatctgtttcttggtcaatataacattcatgtgtttatatatatcttagccatcatcggacgacttacgaaagggtctctagttaagaccaaatagagagagagagcacactgaatagattttaccctccttatgccatctaaatattatccctcacacccaatgacacactcacacccaatgacacactgtcccctactaaagcaagccatccccgttgaagatcgatgctaccgtttccttaagggtattgatatgccttcaccaccatagccaacaatttcacccttgttgaagcctgacggcaacctttggcaaaagctttgccactacgtcttcttcaagtccacaaccttaaaagagatcactaccgccatcccttgcaaaagatagaatttcataaacaatacattcttcaagcaacatatttttttttggaaatagcttacgtggcactcaaattcttgagtttcctcgtatgctactaaaaatatggcatttcccttacaagacaccaaaatccagcgtgtatacaatctctaactgtaccatataacttggttgaaccgttgaaatgtatgaaatcgtatgttttacatcatatctgtataattgaacttcagcgagaaacagttaggaaaaacatttttattttttttgaactttcgaaggtaatttaagaaaattcactttgttttttaataaaacaaaacctttttgacatggttgcagtacatctgccacaccgggaaggcagggaccatggcgagaccaaaattttgaatataaggtaccaactaaacggtatgttttacaatgttattagaatagtattttaaggtggagaagcaccaataaagttgtggtatgcggatgtgcttgaagtgaagtggtggtggctagggttcaaactctatcaatatacattacacaaacatagttgtgttttaaatagaaactaggaaggtagcccacgcattcgcgcgggcatgcaccgtacactatgtttgaaaacttataaaggtgaaattttaattggaacttatgaaagatcattttttatttggattatttgagcacatttagaaaaaaattggaatattttctctaattaaaggcactcgattttttatgcagcggctcaaactattcttgtttacgtagtgaacgtttaatttagctatacatgtttcaaaacatgtcatggtgcgtccctgtgttgttgaattatttcttttccttttggcaaattaaatatgaaaattttgttctgataatattgatttaatttagctatgcatgtttgtagaatttttcataatgatatataatgtcttttcataatttttacaagctaaattatagtcaacgggtgtattaaattctaatttgtgattaattgtaatttgtgattttaatcataaataacataatgatataaatagaacgtataatttggtccgacagaaaaagaacttccttaaaacagaaacggagaggaggtatgtatgtgcgtattgtttgcacgcacgctacttgcatgggaagaggggacgtctctttgttagaatgagaaaaatcaatctaatccaatggcttggagtagtgggcctattaattttagagaaatcaaaggctagttgttatttttctcagattttctataatttattggaacgtcacgtggtgtcataggagcatttatatgagcatcatatggtggcttaggagcattatagaaattttcatggacttttactactcccttcgtcccacaatataagggattttgagtttttgcttacaacgtttgaccactcgtcttatttatttttttttgcaaatataaaaaacgaaaagttgtggcttaaagtactgtggataataaagtaagtcacaaataaaataaataataattttaaaaaaattgaataatacgagtggtcaaacgttacaagaaaaaactcataatcccttatattatgggacggatggagtatataataatagaaaggttagatattccttcaacatatttggagaattattcaagctgacatattatatatgttatcaacttttttaaataaaaaatagttcgttgttatatttggttgatatgcaaagaatatggctcatagaataaatatatcttgaattaaataagacatgtaactattgaaattgaagattaggaaagggaagaggagatgaggggagtgaggtagtacgtacaggtggaggtcaggaggggaatatagaggaggtggggtgtagcgcccgttccgtcgtggcgcctagcaggaaaactatctcttaaaaaccctatttacgaaatctgtttctttgcttgttgtctagtgtccgtgccatctcagatctcaaatctccgatctatcgttgagttcaatcccgaatccaaatccttcccgaaactccctccgcaaaagtctattttgcctccctcggattcgttgggccgaatctctctcggcccatcttcccctccctccccggctctctctctctctctctctccctcccttcccggctctctctctccgctctgcccgcgcgccgtgcgcgcgtgcgcgtgagccgcgccgagccgagccctccgactcggcccccgcgcgccgttgttcacgtgtgcgcgccctcgtagtcgccgcctgtgccgcgcatgcgccgtctgcgtcacccggccccgctgccctgccgcgcctgcagccgcgcggccgctcggccccgcgagccagcacgcgtgcccgagccgcccgttgcttcccgcgcgcgcgtgccgtgatggccgaccgcctggtcgccaccgccgtcagcctctgccgcgcctgcccgcgcctgtcgcccgtgtcgccgctccgctccaaaccgctccgccgtcatcgtcgtcgtcatcgactcggccccgcctctccccgcgcatgcttccaaggaaaggaagcagggctcctcctcatcgccctctctccctcctccttttcccaaggtggcaagggggcaagccccctttctctcccccttttctccctttttccctctcgccggcgtcacctcctgtcgccgttttggccgctagctggagcgccagctcgccggcttgaccgtccaatgtcggttcctctctcccaaaccgaccttgtcgcccatttaaacccaagctcctccccctccaatctccctcgttttcgtctctcgccgccactgtcgcccctgttcgccatcgccgttcgtcgttgcgcgtgtcggaggagccggcacgagcaaggacgtggaaggggacttcggccgcaccctcttcctcctcttcctcggcccgaggccgaaatgatcacgtttcgcgctgtcggctctcgtcactgctgtcacatcctgatttttgtttcaggatttataaattatttaataaattaataatagaatttatattaaatgttctttaatttacaagtgaagttaaatgtgggaaataaaatttcttaaatataaagcatggatggatttaatttttattaaattctccatgattaagtcaactctctgaaattttctcggatttttcagagctcaattcctaaatgatacaaagaacagttcagtaattatttgatcattaataatctaattataattgttaagagcttttcttgtttaaaaatccttaaattataaattgttgtttaattggaattattagaatttattttaaaagcctagaagagaagatctaattttaattaataaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctctttttggctttgggccgaaagccggcccaaaacctctctctctccccggcccaagtcggcccagtccgcagccgccgcgcgcgcgcgtttggtcgctgacaggcgggacccacctgtcagtcttcgtctacctctggccgccgccgcccgaaacactagcgccgccgccgctttccaattcggtcgctcctttccttttccggccgaatcgattgaggggaaacgatcttcgcgatctcctcttccttttctcttttggaagcgtcgtctaaatcgctttggaagttcgtggattcgaggtcgaatcggatcggtctctttcctccgaacccgaggtttccttcgcgtcgccggtcgccgtgggccttcgccgccgcctccttgcccctataaaaggacccccggtgtctcctctacccgccgccaccctcgccttcgcctctcgtcgccggtagagccctagcgccgagccgcctcacgccgccgttgtcgccgccgctccagccgtgcgccgccgtcgctccagtcgtcgccgtcgcttggggaggtcaccgtcgtggtcgccgtcgcgtcgccgtcctcgtccgccccttcgccgtcgttgaagaccgccggagcaccgtcgccgctgtcgacccgatcttctccgccgcttcgacctcgtcgccgacgtcgtccgttgctcctccgccgttgctttggtcaccggtgagttcgccgcgatgcccgcaccgttttggtgtcctccgttcgcgccgccgtgccgtcgttcgccggcgagcatgcgcgccagagccgccgagccgccgccggtggtgacgtcatcgtcgacgccatcgtcatcgtttccccgtaagccgccgtagacccgatcgatctcggccgtccgttttggatagggttgatctcggccgttcgttcccgtgaaccgttgccgtgcacccggtccaccgcaaaccctagccgctgacgcaataatgtggttcaagttgcaaaagttatataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtatttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatgtaattgcttagccatgcttagaaacattggcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctgatcagagtaaaactattcgaatagccgtgcccgcggttatgggcgggttgagcaatgtttttcgtgattagtctcacacctctcacaataattatggatgttatacctggtaataaattgtttagctcctggtttggagttagatctgtttagccgggtgtggttgttcaggatggttgggcctgtgcagcatgggtgtgttgctcagtgttgattaaaatttctgattaattactccactgttttatttttcttaaatgttttgctaaatgctgcttttgcaaatgagcctatattatgccatcctttggtatccttgtacacttgcatatttgttgtgtggcttgttgagtatgtcatatgctcattcttgcaataatcaatcaacctcagttgaagaaaaaggatccagaaggagaagacgtttggcttataccccagttgagctgcctgtgggagtggggctgaagccatcgctagaccgttattccgctgctgttttcttttctcttgtaagtgtctaacgttattattatgatggatttgtatattaaattgtcagtttgtgtacctcggctgattcctggacgaggattttatgcacaaataagttcggaaattactagtgaatttccgggcgtgacaactgcgcccgcccgcacggtagtgcctccctccgttcttcctcctcgctccttctcctccccttagactcgggtagtagcacgagtagcctccccgtagctagccgtcgccgccccgactgctgccatcgctcgccgtgtgctcgccgctgtcgccgcccgagctcggaagcgccactcatcgccggcctcgctcggcgtagctccgcccaatccaacgctagcatcggattcccgtagccgcgtagatgctctcgccgccgggaatcggcccctcgtgacctcgtcgccgtttccctcttcttccgccgccggttgccgccgccgcaatccgctgccgtcgagcatcccccggcaaatccgagccgttggctcgactcccctcgtcccgcgcaaccagccggtgtgctcgctttcgcctagatcgccgtgtttcgctccgccgctcgccaccgccgtccgccgtctattccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccgcacgcatgcgccgcgccccgctccacaccctagcgccgcgccgcgtgctccctccgcacggtgagccgagccgctgacaagcgggtcccacccgggaccacgcgagatggactcggtccaccggcgccctctctctcccctccccgcgccctattgggccgtgtcctcttgggcaggccggcccatttagctcggccgagccgccccttttctctcgggtcgcgccctagccgcccgagggaagtttatttcccctccctcttccttttctttttccaaaagggtttaattaaatccttttcctttagaccaaaaatccaataatcttagaaattcaatatcttcccaaccgtaagtccgtttgactctgttcaacttccaaaattcctcaaatctctagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattgacggacctacctaatttgttgcatttgatccttcctttgttaattgttatatcatgtccccttgtaaccatctagttgcgcctcgatattcgtgcaccctgtgcgagtatcgacggtcgccttcaaacttaaaatctgaaaaaacttcttgggtaaaacttgggttttacaaaaggcttggaaaacccgacacctgggtcggtgcttgcgaactaaatgaattttcaaaaccgcggaccggggaacgtaccgggtgtacggtttcccgctcttgcacttaaggaccgtttccttggaatttcatccgaacataagacaagtacgaccacatgggtggaatgggacacccctggctaagtaattagcttatcaggggagccttgatgccgagagacatgtggattcgccggggtggtgtcggggaggacccctgggcttcctggcacagtatggtctgggacctaacctgttgttggtctgggacccctctcgtcggcatatggtaaatctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcggctaggcccgggtggccgtttgaaagttgttggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgttgagtactcccgtactcacccttgctctatataaataatcccccccagttgctgaagaagatgaagcggatcccgctgacgaggagttcttccaggagcaagccggctacgatgagttttagggtttcggcctagtttccaagtcgcgcctgtgttgtttggtccaagtcttggcttccgcttcccttttgtaatgcagttgtgagctcgggatctgtccgcagcccgacttgattgtactcctactctataataaagagacctctgttgctgtgataatctgtcttcctgtgataccagcactgttttctgggactggtatcgattaataggttaatttggagcgtcacgggctagttccggtcgggactagtttggggcgtgacatggggaccggtgtggagaggagggttttattttttttatttgatctaatggttggtaatattagacccactaatttaaaggaaaatcaatggttagattttagactgccacttggcaacttagaaacgtttgtagaaggatacgtgatggctaaggagcgtttgtaggaagtttcatggatttttaatatataatatattagttaggttgggaatttgccatttatttgagtatgttttagggactcaagtgtgtacatgtgagattagggatttgggaaggacaggggcgaaggcaggaagttatcaagggtaaggttcaaccatatagttctgtttattgtttattatgttcaaattttctatgatgtttagtgttttttcattcatttttttaagtcccatgtggggcttaagcccaagctgcctcatatgtggcatatgttgtaggggggacgattgtgggtgtctctagggtacatgtgtgtataatgccataggtgtgtcatgctcaaagagctaacctcactaaactctgttaaaaaagcatccgtgtgtaccatgtacatattattcatggtcattagagttttgagtcgtagttcatatttctttttatttatttattttgaattttttattctaaattcagttaacgaagaaatttaccatcctttttttctactttaattacgtgaaatacctgaattgttccaaattcccccaatttgctaaaccatacatacacgacttcaccatcacaacacgaacgcttctcttgctcgaacccactttggctgcaaataatctgcaatattgcacaccgtcatcgctaactagggttttcttaacacgtcaacccaatcgaccgtaattgcagttaaggaagtatgggagcaccgaagttaaggatacaccggatatttgtataggtttctgtttagcttatgaaactttagctagacatcacatttatgcccttttaatggttgttttagttgttaccgagcttagatactactaaaatggtcctgatcaaagcctacatacagaagctaagtgccaagtaaactccctttcctgatgcacgtagaattgtactacttgtgtcgcggttgtctcactaggccgggcatttgggtaattcattttattattgtctataggaagttttactataattagtgcttaggggtatcagaaaacagagtaatcaccagtgaaatatgcggtatttcctccgtcacataataagttaatttagtacgagatgcgataatatgtgataatattagtaactgctctctgtgtgattactgattgtctggttagataacttgttaattaatcacctcgttcgatcggatcaggcagttgagtagtactactacgtacggcaacgacgtacctactgctagtctactgctactccatacctaagagcacctacaatggtaaagtaaggtgctatctataaaacatgtacatctcagcaatagactagattaatagtaaatcaccttaacagtatgtctacatagttatctatagctctctcatgcattgcctcgtttttctctatagactatctctatgttagtagatagctttgctctctctcttcatttaatatcttccaagtaggaaaatatactgacatggatctcttatagagagcttatagataaccattgtgggtgccctaagagaagctccgtggtcaatgtaggagagcgacgtgactcgccttttatttgagcttaaatgcttaatgacagggggtactgtatatattaccgtacccgtgtagtcgtatgttttgacgtagatctacgtacagagactagttatggcaataacttactgctacatctctcataataactatttttttcactctttctgtttatctcaaaataaatttattttttaatgatcactgcattggagtttatctaagtagaagataaatatattaagagcggataaagtaaaaataattataaagatcaccaccaccattagatctatgcgggaatgacgtttggctagatcggagctcctaaaacatataagcgagacaaacgcactactaaaaaccattttcacagacaccatatttatttctgcaggcaggctaaaacgttcccaattatgatcgttcgtacaaatatataaagttgtacctgatcaaaacctgcctgcgaaaattgatttccgtataaagtagttttatactggttacctggaaaaataaaaacatttttgcaagcgaacctcttaaaaggactgtctacaacaattgaaatttttgcagacggcatattaggagcaccgctaccaaagataaaaaaatcagccaactatattctttttcccaaaattatcctctcactctcgtaccactcctttcttatcctctcctctctctccctcttcatcttccacacttatcctctcctctccctctccttctccggttctccctctcctatctctctctcaccggtcggcatggagcagcggtaactccacgaaaaggcccggcggcggtgactgcaaagcgagcatggctcgcggcaactcaacaaagcggcccaccagcgacggctgcaaagcgggaaggaggggcgtagcggcggctcagtgaaggggtttggcgcatctcctcctctgctcccgcccgcctctaccaactaagcccatagtcgacgagcctcgagaggccgcatcagaagccaacagccttgggtggtgacgacgacctcgatgatgtgacgatttctaggaacaagctcgggggaggtggatccatcgccggtgagcttgggggaggccgacgatccgttgccaacaagctcaggggaggtggatcatcgtctgcgggctcaggggaggccgattattcatcagcttgtttgtaacctattgtttgttctagtggatctaattatagctgtgttcgatgttgttcttgtttatacttgtcttttcttgtttgtctatggatctgattctaatttgaatatgatgcttgcatgcaatgaaaattgaacatttccccctttttttttttgccccaaaataccttttacacgcggggtgatattagagcgccacctgtgaaaagtggattttcccaggtggggctcttaggatgcctatttgagaaaatcgatttttgtaattggttggaggctccgcctgcaaaaatcaatgattttagcaagccttagcatacaggcggagcgttagccgcctacgaaaacttgttttagtcacatgtaaatggttttctagtactgacgtagaactaagttcagggcaaggcaagattgccccgcctctaatgctgctttcatcttcgctccacgtcttgctcgtgtctattttttttatcacttagtgtttgattcaactctaccttctctagacaacgatttgagatttagagccctgtcaaacaatataaataaaatgaaaaagaagagtgcatatataacacaaaataaagtcaaatagaagtacaattttgaatatgtaaattcatataaaactgtaaaagccaatgctaaaaataaacattaataaaaagcataaaattcaattttaaaatgtgttttaaaaatcaaaatttagtagtggcttgtaagctataggacaaaagatgaaagccatattttatttgcagaggaagctcctctaacatgagtcactactatgagctatgagacccacatgtcagcaacttgtcaaatgatagtgagggcctatttgagagagcttaagattctgataagcagctgattggtaggcagcttctaagaatctggtttctagttcattttctggattctataactatagcttctcagaatctgaaccaaaagttgtactgtttggggagcttttgattttaggagaacctgcaacagttaaaagctcctctaaacaaggcctaagagcatcaccaatagtttccctttttcattccctatcctaaattttgaggatttttggtcaaaaattgaatccaaccgattccctatcactgctcccaaaagatctcgttcccttctccggatatatcgatcccaacttccaaggagcaatatttcgttcccaatcgcgtggtttttctctctcgcgcgcgctggagaaaatgttcccgcgctccttctcgcgacctcgttcctccatggcggcggcggtggcctcttcctcggcagcggcagccacttcatcggcagcggcggccacttcctcagcagcggcggcggcggcggtagctacggcggcctcttcctctgcagcaatggattggtaccttgatgcggtgcgtggtgtggcgacgacagaaaaggcattgggcttcttcaaggaaaaggcatcaatcatgcacgcaaagtcattttggttgtacaagcatattccccttgtatatcatactatattcacaatgattttactcccaactcggagaatcaaagggatggaacgtgcacgtgcatacgtgtacatgcggtattcagctgctagtgtcaaatactccctctgtttcataacgtaagtcattttagcattgtatatatagattcattaacatccaatataaatgtgagaaatgctaaaatgatttatattatgaaacagagaaagtacgattttgtccttcgctgactagcaatactgtagtaggaggatacaatacacacgatgtactcatgtacatcccacgatcgtgcagtcaagtcgtcgttcgctgcacggacgccgtggcgcgctggcctggggtaaaagtgcagcggtacgagtacgaccgaacggttgatgaacctgacgtgagcatgctcgatcggctgcccgtccggatccttcggaagatcggcgaatcaggctagagcacgcatccgccggccgccgctgtacggcgcgcgtatacagcgtatgtagttacccttccgtctaaaaagaatccaattctatcaataaatctaaacatatacgtatccagaattataactaagatttatttttttttgggacggaggaataggtagtagtactactcctacggtacaagcaaggagatgacggcgcaaccgacggcgaacgcgcggcctcgtgctgtgtggatcgatcggatcgggccggacgacagcatcacgtggccagtggttactgcggcgggagaggaccggccggcggctggttgctcgatcggccaatggcaagcggaagagggtagtagtaggctagtagctgcctgctaggctgctactgcctgcctgcctgccggtttcagcggccgtcggccggcgaccttgctcggttcgtaagcgcgccggcgcggttagcgcgcggcactcgcatcggatacttctcccgtttctccgagcgacaaatcacggctcggacaaatcggggcgggtgatttgctgccgctttgccggcatctcctcgtattaatggcaccgccagggtgcagcggatgcggtcagtcagtcggtaagtcagtgtagtaccttgcagtgttttgttcctttgcttcatcgtttacgggaggactattatggtcaaaggaggccacgggtctggagtctggacctgggttatgcgtgaaggtagtacgatctaccgtgcacggtgcacggacagagagggtcagggcgttagggtgaaatgctacgtacgtgctcctaactaacgacgtaccgcctgcctctctacgagtctgctgagtccggacatggagccatgtatgcatgagtcagagtttgcccgtggcgtggagtcgaaaattgatcgaggaaaggagctcaggaaataccggaataaattgtggagtaatatatgcgagttgtacatttctctcatttatatgcaaaaagaaagatatatatcttttcattcttcaaatagtaccacaggatccgtggcgcaatggtagcgcgtctgactccagatcagaaggttgcgtgttcgattcacgtcgggttcaataataccccgaaccatttcggattccttttttttatttctttaatgaacgtgaactgttctctttttgtttaggctgccttttctttagacaggccgcatagggcttctcactcaattaatgggcctggcgtttgcaaggccgagatgccgcatatggcaacaggcttatcttcactctttagatgggcctcaacaacggttcatcagtacatcaaagccccaaagacctgccgacctgattaacaggtatacatgctggctttttgcttgttaagccttttgtttggcctcaaacacccgccgtttgtgtcagcctcgcggcgtggcatatgccatacaatcccattgcgaccgcgcggtcgcacgccgtacgcgtgccgggcgaccgacgcgaatgctccgcgcgcatgcagaggggcggaaagcgacgcgtcgatcggtacacattctgtccctcgcgcagtcgcgcctcctcctatacgtgcgtacaaactatccgccacatgccaacaatggactctagcttagctagctttgcatggaggcgcgcgtgttccctctcccccgcttcccccacacccatggggatcgttgtccgtcgcgccccgtgaacgacacatctcggcttgcctccctgcacgcgcgccaccggatggatcggcgcgcgacaaacgaccagagcgtaagtacatacatgcccttctctagcgctgacgccatgcacagcgcgcaacaagctagatcgcgttgcatgcggctgcagctgctgctagctgtagattcgtatacataggcagtcgccaataaggtactaggtcggtaagtcggttaataataataatctagtaatctactactagtagttatattagtttgtgctacttggcgcaagggaacaagctgggggagtgggggttactggtgagcagcagaagcctacaaggcgctgatctgatgagggggtttggaatattttctcgtgggagagattgatggcatggcttgacagttccaacgacacatcagagctggaatatatatctagctatcgccaagttgtggcttgttcttttcatagaccgataggcggagagccaagagttagccggtttgcagcccctctcgacccctttctttttctcggtggggttccgtgatgacacagcaggggttgggcatgggcataataaacatatatatagcggtcgattttataagtgaagatcgagttgctatatatatgaacacttgtataaggttatgatagaggataattaatatagttttggtgtcaatttcattcgtttatcaaactgctaatagttttgcccacagaatccaacctagtatatttctgaaactctaaactaaccatctgcctttcctttcttgagttcacatgaaattctccacttgttatatcctaaactgaccgggttggaatcaactaattaaaggtgcatcttgcataaacatcaaaggtactgtataaaatagcaacctaaaaagtgaggggaaaagtcaggttaattacccacctacacccttctctttacatctaccgcaaataacatacttaacttaattacttgttttacaaaccaaagcattcacttggagaagcaccatgtattaggatgatggtggaattgtgatgtatgactttaaccatcggaattcaaatccttatgtctagaaatatagttgtgtgcatttcttagttggggtatagggcggaagttgtactaccattgtttgaaagaaaaccattcacctcacaaggcactataagagagaatcaagagaatctcttgttggatcgtctctacctaggtatgtttctattttcagaagtattctctgtctcgtgcgcaaagacggagagatggttccattgcgtccaaagcatcattttacatttgacttaaatcaaagtttttaaaagttaccaacgaaggctggttatatctaatatgttaattgagtcaacagtttatgtcccacttactaaaaactaattaattttattatagtattttagggatatcatcattatctccttatatctacttcctccgtttcataatgtaagactttctagcattgcctacattcatataaatattatgtctagatttattaacatccatatggatatggacaatacaaagaaagtcttacattatgaaacggagggagtattagttattagctataaaatcaaaatgtttgttttgagcatgtagtgatatcaaatggtacactgaatttgcacgatagctaagaatgacaagtggcaccaccatgggaatccatgttcattttttgccaggctggtgaaatatcgacgaagaatgaagttgtcagaaaagcattacaaatactcaacaaccatgggtcattgagaaaaaggcttacgagagctcacaccacacttacaacaaatttaacacactaaacaaacattaattggttaaattaacaaatattcttattcattgcgaagaaacctacattttattatgtgtttgtcattcctctagtataacggacaagcactcagtaacatatgtatttacagagtgttccgttcgaacaatccgcaacttacaaagtgctacatgaataaaacctgtaacactttgatgccccttgatacaatcccatccttgtagtaactccactaaatctaaaaattacctaaagtagatggagagagagggagagaaaggaccaacgttgcgcgctccaagccctaaactaattacttggagtatacatataatgtacatgaggtgtccacaagactccattttccattgcataatgggcaagtagcttcatggggctatcctcgatgctggagaggttaggttattgacaataaggttcatctatccacttatgcttgacttgtcactttgacatagctcacagtactaattaatacccctctctcacgagtcccataatagacgttgtgcacaacttgaatatatccatgattttagtactgaaaatctagcatcgtcgttacttattattatccatcatctactaggctactcgtttggataataggaaatgaaagtaatttcctacacatcatggggttacttttacacactagctatctatttttttcccacctcatttcgtcctaattcttcgctcatttcgatctctatcccacccaccagccctcatatctcattattccaaggcaaaatagcccctagctagtgctggcattgtgactgagctacacttcaggggtcccaaaccctaatgctgatccccaaactacattttttcagctactcgctccctcattgacattgacggtctccattcacaatgagagatatgctgctttagggggctcgcttttgcaggatgttatcttgattgtgaatgaaggactagcttgctctattaaaaagcttgaatgcacactattttgttcgttatgtttttttttgaaaatatctttgtagttttcgagatcggaattcgtgcgaaaggtagttttgtgaattgaaatctgaacatttccatgttgaaagttttacaaattaatctagctaattacaagtatttaacaatgacaaattaaagaatggcacataattaatcatcattgtttaaatgcacctgatccccgaatcccctgcaatatttcataatcgactgtatatatcgatataactactacatgaatattctatttgatttgttgatgttgttagagatttttgcataatattaattaataacttttctagtttcacatataattaagttgtttttatattttactttctttgttcgtttagtttttttcctcttcgtctttgttgggccggggtaggaaagtacaagcacaattgagattttttttttaaaaaaaatagcttatttgtttgtgtgttgcaacagaatcaaaggacaaattgggaattgggaatcaggagcatttgaattagggggcacaaaaattccacaaatattctcacacaagtgataggggtggcggtggcccactatcaacattaaagtaatataaaaaaataaaagctgtacttttatctgagaataatggaaaggagactaataaaccacaaacagttgtatatatcttggagtaatatctctagtacactccattaaaatgtccaataaactaagcggatgcaacaatccattgtacgagtacaatagacatatgcacactgatttaatttgatcgagcacaatggatattgcgttggaagtacaaagctttatcaaatggacagttgtctttgctgacatctttaattggcaggatggaatagaattcccgagggagatgatgtccaaagatacgagacacactaaacaaaaggagatcgtactcatataaaatctatgcgagctgccctacatggtttttttttttgggttacagcagaagagttttttttctctataattcaggactagtaggcataagagatctactagaagcagcacagttgtccttgcagcatttgctagctcatggcagggaggcaaaatgcaggagctttgattagttgacctaactggcccctgttagctgccacatataattatatttaatttctcaggattttgattgaaaacaacatatgggctagctctatggagaagccaccatcaatcagggtgggtcccacacattcatatgacaagtgcttgctcatatcattaggggccccatgcctgcgtagagacaaggcatgggaaccaaattggtgacatgtagggcgttgtgtgttcttgtgtgtgccaacctaagctaagctgcatagatagctagccgggggccactgttgtgtcatgtgcactgtgtaagggttgcgatgtgatgtgatcgcccaaggacaatggagctactagctgatcactaattggggattagagctttgtgtacgatggttgagatgtgctagtcatggaccaaaccgaatcatgctttaaatgctagattagctatagctgatggtaccagctactatatcacacagcaggtcaaacttttaggttcaggatgagatcacagttagctattagtctctgctagctttttagaaagagctaaattaagcaactctaactaattaactggcaactgaggagtggccaattgcttaactaaccctccaaacaatactgcatcgatcattctgatacgaattacaaacaaacaatgctaattacatctcccaaatcaccaaataatctacacctataggtacaagcaaattaagcgaaccttggtagatgcctcgatcgcgatctcatggttttatttacagtaatcgctacttcgctaatcgcccgcgattaacgtacacggcgctgatcatatcaaaccttagtagccccatagcgcggcctcgtggtcgaatttttggccggaggatgacgagatctccgggttcacgtcggaggtgaggccggtgtcctgcgacgcgctaagcctctcccgctcgccgccgcacgccgccggctgcagctggctgccggacgctgccatgtcgacgaggccgccgtagccgttgcagctctccaggagttgcaccaggctcacgccgtggtgcagctgcccgtactgcgtgaagctcgccatgaacggcgaggagtcgccgccgccgtgcccgtgtactgccgtcgggttaaagaactggccctccagcgcgttggagaagcaggtcacgtgcgccgtcgtcgccgggtcgacggcgccggcgccggctccggacatgtccatcagcggagggaggacgacggacgacatggcgatctcgtccgccacggacgacgacgtcgaccctcccctcgccatctccatcgtcaccacggccgccttcttccctcccgccgcgcccacctccacgaggctcttcttgaacaccctgcacaacacccactcgttctacgcaccaacaagaaaaacccacggcgtgtcagtccggcctgctcaatcgatcgatcgatcgatcgatcaaactggtcacaaccaaacacacgcacgcggcgtacgtgcgttcgtgtaccttggacgacgcgggcttgccgtggaggaagccgagggcggcggcgtggagcttgccgtggaggcggtactcgtgcatgacccagccagacttctcccccttgggagcgcgccccgtgtagaaaacgagcgtcttcttcatgccgacgagggccttccgtctgaagatgtccttgtccttccccgtggccttccagtacccggactccgtcgccctgttcgtcctcagccccgtcgggtacttcctgtccttgaggcagaagaagtaccactccttctcccccatcttcgccagagctgccaataattccatcgcagcatcaacagatgttagctagctagccaatccaatgatccatgtatatatcaatcatcagttcatcactgcatgcagattgcagaggtaattaagtagaggagaggttgcttacatggcaggtcccagggctcgcacttgttgaggtcggcctcggcgacggcgagggcggcgaagcgggcgtcggcgaccttcttggcgaggtagtgcgtgatcagctcctcgtcggtcgggtggaagcggaagccagggggcaagtccatgcctgcctggccctgatgctgctccattgctgcctaagctagctagctagagctttacctggctaactgctccttgcttattgctgctatatatgtaagatttgttagctgttatgccaactcctgtcctgaaacatttgtacatatgcacacagatatgcataaactaggaccggagatgattcacacacttttaaaggtagagcaaaccaaatcaaattaaagctggtatgtatccatgacacctctttgctagctagctagctaagctagaacaaaaacaaaccacacggatgcttaaaaaatcgaatcgaaccaaacggacatggtatgcaagcacatagaacacacaaaaagaatcagcacatgagatgtttatgcacagaaaagtttaaaaagtacatctaagaaagtagaagaacacacttgagggatgaggtgataaatagttaggatatgctaattaccttttgcagcagaagtagattcagggtgacaagaggaaatcgttgtatagaggaaataaagtgggaggggtggtggtgccccttaaatactagaggcgagctacatgatggtctttttagtagaaagagacgtgggtgatgaaggaaactcatcacaggttactactccctccatttcaaaatgtttgacaccgttgactttttagtacgtgtttaaccattcgtcttattcaaaaaatttaagtagttatttattcttttcatatcattcgatttattgttaaatatactttcatgtacacatatagttttacatatttcacaaaaatttttgaataagacgaacggtcaaacatgtgctaaaaagtcaacggtgtcaaacattttaaaacggatggagtactagctagtaggtgaaaaatgcatgggaagagatagatgagatagctatacaggacagcgtagtgttatgtaatagtaccttgtaacgagccaaaacttgcttccacacatgatcaatcaccggattaatttagtggctagtgatccatcagatcagagtgttttaccctaggatgactttgatctgatctggctggatttaaggatttggtgcattactaattaaatgagtcttaattaatggaaattatgagtactactagcagcattaagtaaagcgtcatatgcgacacgcgagccgagcagcaaccgagaaagcgaccaaaccaatccttcgtctccagaagcttttgagaacgaattagagcagactccatggcgagtagtacacctactatttgtattcgagtactgcaataaacgggagaatttattagcttcatgctaagcatgagctggttcgatcatttggtacaaaatcactaattcaaataattaattaatatctggggtagctaccgacgtccaggcgcaaacaaaagatatattcagtccatagcaaaccttgatatttggtctttgtgcgtaattttctgcagggattgtacagtagtacgtataatcatttgccctgaacctgattagaatcaggggtacttaaacccttaaaaggagaatctcccaggagataagccaatcaaatcggtgacaaactggcagtggcacgatgatcctgtagcccagtgacagcacattggtcacaggctgatactattgtgtaatagcagtggatgtgcacaacattctgctgcttgtatacatgcaatccaatgggggagaattattctctccgtttctgcaaaggccgtaagataatatgcagatctgcagagccaatgtacctgtgttctctttgcagccctgcaggtacatgcaatgcacagcacagcacagaggatccacttggttttgtggggcttagaacggatatgtgtgacaaacgccatgctactgtgcattattctccgcggctgtcagaaatggggcaaacgtctgaaatgtccccggcccccatatgttcaggccgcagagaatactgctgatggggaattcaaatgtctggttaaagaattcatatgtctaatttacactactacatattacttcatccactgtatcaaccaaaaatgtgcgtaggtccatgcatgatgattatgagtgtgattttggttaacaagccagaacaaacaatgagatatttgacatcattttcgtgcgaaatatctgctacagtggtgcttctgctcgcgcaataaattcaccaagaagctcttatcagtttgccgatgcatcctgaatcctcggttagtgctgtgttgctgtcaacaaacttaaggaagagacaaactgaacacaacggaaaagaaaaacgccatctccaagacgagttcggagttccgtccagcatttaacgctttgcggaaaacgcagaaaaagatcgaatattaccacacaagggacttgaaaaagctagagccgcatctatctacaaatgggaggagcctgcagccagttgcaaaacaccatcatcagttagtcatctgctacgacactccgttgcaaaggaagaactctctgtgatctctccaacgcaacgcgtgcatcagctgatgctttaagatgtgtggcatgatgatatgtactctgtgtgtgtgtgcgcgtgcgcgcaccaaatggatcctacacgggatgattggtgtcatgtcgatgtgccatcgaggcaatcctcgtctctgaatttctgaaaatctctggagcctgcccccttccatgctgtcatgcatggcgatcatgggttctgctcatcggcagccgacaaaacggcttctttcaaagtacacgtccagcacaacgcgctgctggatcaataatcgatagtgctgctacccccctctatcatgagctacggttttcgggatcaaatcattgcgtggtctcggtctccggatgtgaacttgacctgtgagaatttgggacacttaaccgggtatgaacccgagctgtgattttctgggatagacagagaaagctatgtccgatcctcactcacattgcaacgtatattcccgtacgttcagggccaggccagcctaatggtgttttgtcaccaccgtacgttggaaacttttacgcgtcttcgctaatttattttgtacctacgtgacaagtgtttatcgtactaacacagtcgcgtgatcgcgtccgtcgaccaaacaacgtaaccctcctgcaagcaaacaaagcccgacacggacgtacgcgtcacggtcgatcgattcctccgcgcagccgcgcgcgcgcgccgatacgccgatcgacttccgccgagaaaacgctagcacacgcaccacggccgccgatcacccggtgttgctcacgcgcggccgcgcgcgcgcgcccctttcgcgcggcaaggagccgggcacgccgaaacgggcaggtcacagcgggaggcgtgtagtaggcgatcgatcacgcgagcgccacgggtttcctttctcggtgtgggcgaccaccgcgacgcgtgtcgtggcagccgcgcgcgcgcgcgcggagagagaggagtcccgcccgtgcgggggatctcacggtcgtctctcttaccggtcgatgtccacatccaccgggaaaaaatgaaagaaaaaataatccccgcttctcacgcgcgcacgcacggcactcgcatcgccaatcaccatgggtgccacccggctacgtagcggggcgcggggccgattcttctctcttttttccccctctcccgccggttgaacggctcagactgccagatcggcttggtgtcacgatagtgcatggcgaatcaaaaaataaccccgggggggggggggggggggatatggcatcacgcgtacttacgacttttggcatgttgaggtggccgggtacgtaggcttgccccgttccgtttcgacggggacgttttcgttatagaatgatatctgctgctttgtcgtggttgcattgcttctcgttcgcttgctgatttcttttccgtcgtgctgattggtttgggcaaatgcttcgttgccatgtgtgcgcacgtacgttttcttgtgggtatatgatattgcacgtacgtagaaaaatgccccataggtgattgtactcgtgactcttagggaattgtagacttccacgcgtccttcagaaaaaatgtagtatactatagctctgagttgttaatccataaaactactgattatcacctcatgccacggatcggattaggcgttgaaaaattgtggacatattttaggctgtcaaataacatgtaggaatacctgatatatgggcaggctgatgcactgtcagattttccggctttctgaaaagaacaagagtagaattgtttaggtggctgctttggtaccactgaacacagacattttttttatatttggcgtccaattcggtcgcgtcaagttagccagattctggcagagcaaagtttctacaagtatgctagcatgacaacaaattgtggatcaaaccatgcaaatcccaataccaaactcaagtgttgcaaaaatgtggctacaaaacaatatggctgagatgtgaatacggttgctgctaatgccatcataatgcaactgtcaatatgttgtcattcacatgccgatcagaaaggacacgagtgctttcagtgagaactttgtttctttaacgatataggtgttcatagcatgcatttttgactcgattcctttttcgaatcatcacgtctctcgtcttgtagcacgcacagatatgtatttcattagtttcgccaaaccccccggtgcaacattctgataagtttggcccctttataatcatatcctatttgacgtggcagcactttctcatcacatctgtcaacttttccataagggcttttatacttaactctcttaattgagattcagatagaccatatgtccatatcaagccagtagcacctgataattctgggtgaaggaaccagggaatcactcgactgacatgacaagatgctaatgttaggttgtcaacaaccaatagcagaaaaggaaagaaggccaagtgcttggatctctctctctctatgctttaggcaaagacatctttctagatcaattatgtgctgtttgctcggtttaaaataaaaggagcactagttagtattgttgtaccaacaaggtctattcaattctttgcagacagacagcataatgttcatgcataagaagtcagaaatatatgttgttcatatatgactcataatgctgaaatattaataaatacgagagaaaattgtactcactatcctgaaatgctggtcaaatcaagatccacaagatctgttagggaagcagacaccaggtgaccagggatcattgaccaaaaatgtgcttgttgcatatctcatatgcttatagctgcttactctcgctggccaaaagaactatttctgagtggttggaacgacgccgcgcagaaattgacctcttctgatgccatcatcagagaaaaaggatacattttcaatagccgatctgttgggaagataataaagaattggaatgtcagatgttctatatattgtcggctccaaatcgagtcaatggctacggtggccagattacaggagatgagcagccaactagtgcaaaacctgcatgccatacaatatgcctagctcattatatattactcaaaccttccatccaggtgttcatttgtcaaaatttagaagagaaaagaacaaaaaaaaaaccaagtcccaactactccagggtgatgtcaatatgtcacggtccgtttagatctgttctgtataaactaaaagttccataccattcacaagtgttatgtacattgtgtaactagagaagaaaatggtcagctaaacatcacgtagaaatgattttgatgtgctatgtcagttctgtcgtcccttccctgagtcattgtctcacctctagcatgtccggccaataggtttaaaaatcgtcatgtttaagcacatcaagataaaaatgttttccctgcatcatcagaaagtgataagattatcaaaataaccaaatgcaaatacgataccacttaaagaattaggcacggtcaggacaacaattttgtcactgcctgcaaataagcaataacatcatcatattgataggaactaggccgagaagtttggatgtttgaaaccttgcatgcgtcattcaatgaaagcaaattattaccttctgttgttcattattaggatttccagctcctgagtttttgggcgaagggttcaatacaaaaagagtccatacaagatgtatgtccaagtataataaggttgtcaagatgaagattaagattaagatgtcacgatttatcagctagttggctatactgattgaagactttaactaatgcatttttttatcatctgacatggcatataaacatgtcatgttcaaaagcaatgccatctaaagtattatgcaacagattaagttgactgaagtgcagacaaagaaaactgtaggagaccgatcattcttgatttcctgtgtttcactttattgcccatgtgtttatggaagaaatacattctaccacattgtaacgaaacattaaaaaaaaagtaccctcagatcgatactactatcaacattataattctgcgaactatatctaatgtacaactaaaacctatatgtttctgcacctaaaactcttccaacacagtaccataaatatctcactatagttaccttgattgctatctaccttatgttgataagtcatgtgcatagcacttcataacgttatataatatgcagtaataagtgatgaagaactgatactacatcagggaaaagatgcatttcacatcaggtaatatatatccagtcatcctaaaataattgaacagtgcattgtgcgatattagagagtaaaattaatccgattactagaagtaaaaatattccaacaaacatttattgaagcctcagaacctattggtatggtggttatgaaatttggtacccaattcattcttgtgattcacataaatgtctaacttctggaccagcttccactctttccaccagatttgtgctggagacagatatctgttatgcatatgttctttgaagcagctttgcacatgtcatagactgtgagaccagcaatggcaactgctgtcattgcttccatctcaacccctgtcttgccactggttgaagcttctccttctatcataacactagaatcttcttcgttaagagtaagatcaacacgaacatgggatagattaaggttgtggcacagcggtatgaggttgctggtttgctttgcaccagttattccagcaatctttgcaacagttagaacatctcctttggcaatcttgtttgatgctaccaaatcaaatgcctcctggcctagcaagaccctgcatgtggctatagcaactcttgtgctgtcatgcttggatgagacatcaaccatctttgcctggccactgctatcagtatgggtaagcattggttgtccatcccctgatccattagtgggccttgctggttgctgaggagttgaacctaaaggactgggtgaaggagattcaccaaacacagattccatttcctggtattgcaaatgtcaagataattaataatttattttaatgaaaaatgataaataaactagatggagatgttttatgacgatgctgcacaacaccaagttacatatctgcatttagattttacttttgctttctaaattatatcaattaattgagacggtaagttctaaatcatgcacaaaattgtaaagtaaaaaaaagctatattgtgcatcattgtagtatggataaaaattggcaagaactcaaaagtgcatcaggacatgttaagatccgactattttgttcctgctgtagtggagtttacttgtaaaaatcatatagtttacattactagttcaattaagtggtcgaatacataagcaccagcttacagctctggcatatattagaaactatctgatcaggtaacagttcaggtatataggagtatgagcaatagacagtttagtttcagttaaaaactctatttccactctcaacaaacaataatcaatgtgatctgtattcaaaatcatgtggttgcgtttgttcaaaataaaaaatgaacattagattaacccaacacaatgatattgaaatcccaattagatatcgatgaggtcatatacatcatactcagtttcagtgagcttcatgtcagtaacaccaaatgagaaaaaaaagggttttatagcagccattaaacaaatcaccaagccacaaacatacatgttcatgtcagtaacaccaaaaccatagctgcaaaaggaaatattcagggcagagatagagatcaaatccctcaccttattgagctctgctatagtatcggaaggaaacccagtagcaaagcatctccaaccattgtttcttgctactgtcgggagaatggagcgaaggactgacattgttgtcaagctagactgctgttatgcttctgcaaacaaggaattgctaaacgtgtgaacagacaacacaaataaattttagcacacggcactcgatgcataaacaatgtgagaaaatcccttatatacccctgaaatttttcctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaatacgtatttattttttaaaaaaaaggtcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatatgcaaccaaacgtaacagtaaaatgatggaaaatgtaacggtaggggcatggaagggatcaaattgaaatttcaagggtatagaaggggtcgggtaaattttaggggtatgaaagggattgagtgagttttcaggggtacacagggaatttactcaaacaatgttgagaccattgctgcatgataagagctgcaggttgcagagagagaattcttgagaacaatgaaatagcttggtgattttactcaacaagccagttgctttacaacttagatctcataagtgccccttgtggccagtggcggacccaggatttcgccaagccccgagccaagcctagttgttatcacaaatcataaatatactacccgtaaagtatgatggaaagaatgcgaacttaaccatgctgagatattgaagtacaaattatttctcagacctataatatgctctagttcagcacttatcatatcctaaaatgacaaaagaatcctaaaatcaaatcctctatatcatgatcttacaaagaaattttttttaccaaaatcccgcatattgaagatgtgggtagaaaaaccaagttaatgccagcaggtttcattaagaaaaaaatacagtactagcaagtggtttcttagtaaccttggttctcatatttctcactctgaatcattttcacacttccacagcacagcaagattactaagatcattacaatgtaggaaatgtggatcccctctcacatcggtagtctcaagttagccttaaggactataaaatcacatcattatctcaagttggtcatctacaaattctctctacagtttttttttaaaaaaaaatcgaatcgatctgtacttgtcttgatctaggcatttgaaaattgaaagtgaacaaactaaagaatgaaaataactaaaatcactaaatgagaggtttgagacctagaggcagggcaagaggcaagagagatcggcttgttgcaacacctagttggggtcctcgtcggctagcaggcgccacatgctcggagagacggggagcacagactcgacggcacccagagaccggagtgggacacagtggcggacccagctttttgaacttgtgtattcgaaatgacaaggggtaaaaaaaaattgttcatacacctaatagcctaaaaattagcttgtatagtataacacactaataattcccttgtctgcccacgactcatttggctggcacgtggttctttgtacatatgaagacattacaaaactggttccccaatcgaaatataagctgcaaactgcagcaatttgctacttgacatgaaggtagaagataaagatcctctagtttctgttcatatggatactgaaactattgcaattgaccaatagaatccatatattttcgttaatcaacgagaggactacgttgaagcagagtattcttactagtcgcagaaatccttcccactagatacaaacttgctaattgttaattgtatgtgtgcaataaacaaaagggactaaaaacaggaagatgtttacctgcaaaccgcttcacctcgggcacgcctcctttcttcctccagtcgttgaagtccagcagtgggtccttgtgggcggcctggtatctggcgctcagcttcttcctcttcctttactaaccccggccacccggccgccaacgccaagccgcgcccgccgccgcgccgcagacccgcagtcgccgccgcacacgccggccgtcgcgcgaatcgcccgccctccgccagtccggtccgccgcggcgggcgccgctccaacccctcactgtctagggtttaggatttgccggctgttcgccggagctcggagtggagcggtgctgcggcggcagagatctggacggccggatttcaggagaagcaaggcggaggtggaggctggggatgggagcgacagagaaacgcaccgcccgtcgagcagagggcgaggagggaggaatccactcaatattctctgtgctcgagtggttgcatcaccttctagtcagcagctagcttagctccgtcctcacgcaccctgctcgctacgcacgcgccgtccaccgtccgccgccgccgctcgccgacggcgacgcctgcgtgcgtcgttctcttcgcgagaaaggggaggaggtgggtgggtttggggaatagagtggcaaatgtgaagtcaaccaaaacagcccatacaagcacaattacggtccaaaacttacgggccggttttctttctacggcccaaaaccgggtttccaggcaggccttacactttcacacaatttttccgttccacagtcacaatttggacagtttatgctaagagttccacatccaaactgtatcaaagatatcgaacgggcttgcttatacatttatgaaaggaaacacacacagagctaattaaattagggaagcaaaggaacaaaaaagacgtgcattaatattggtgcacgcacgatggatcgcgctggtcgatcggccgggctgctggctgcaggatggtggtcgtcgtatcgtacgtacgtacgtctatgatcagtggcgccttgcgagcgcgaacgcggagagggtgatgaggacgacgagcaggaccatggcggcgaaggagccgatgagcgagccggagatgcgctcgcagaaggagtcgaactgctggcagatggagaaccagtttgcccgcacgttgcccttgtgcgccaggtacacgatcgccgccgccgccgacgcgcccgccgtcagcagagccagcatcgcctgtgcatatatatatgcacatcacacatacgtatatccatcacgaacaagagcaatttctagcaacaaacatgtagtcagcgtcgatatatgtcgttatttcctcaccgtgtcgaagaagacgaggaacagccggctgtaccgcgccctgggcctgaggatgtgcacgatggacagcgggatggacagcaccaggtacgtgcacaccaccgcgttcgccgccacgaagaacctgtccgtccggccgtgcatgcaaaaaatcgaactagctgcatcaaacttcctgcgccttgcagcagaacacagatactattgaccctgagctgtgagtggcatcatgtgtatagcggatcgatggcttacgtgaaggacgggaggtcgctgtacttggcctcgaactggatgaactgcgtgaagaaggggagcgtctcgttggtggtgcccatggcgatggcgctgccgatcgtgccgatgatggcgatgaaccggaggaatgtgtccaccaccgcgacggcgcggttcacgccggccgccaccggcgccaccaggggcgccttcgagctgatctccccgtgctccatcactgatccgtccttcgtcatgacacgtacgcaccacgaacagcaagcagctgctagtacacctagctagcttgagtgtggcaacaacaattaactactgcaattttggttgctaaatctaagcgatcgttgcaactcagaggtgtgagaatgcctgattaattgcttattgcttgagagaacctgcatgtggcaagaccttcttatacttggcaaaagaagatttatttccggtaacaaaaccaacatggtctgtttggtcaatcatgcagcacggggcaagggtgttgatttaggtggctttgacaattcattgttgacaccaactaaagcacgccttgccattggttgactctgcacctgctcttacttgctcgagtgaggctatgggacgcaacgtaccaagtcgcaaatatttctgcttgaactaagccctctttagctccaaacccacagtgtaatgtcgatactcgatactcctagtcttttgtctacttttggcaccccctgaaaatctggacttggtaaggctcctggctctcccctgcacaatgatgcaaaattctttaatttcttcggtaatttaaggctgcgtagcgagttggtttcatgagaattattgttgaagcagttcaaagatcacaccgatgcgatgtgcatgtgctgtatttgatgaaggcatacagcagtttcctcaaatgcagggacatactttctggagtctggacagtgcttgccatctcatgttaacctacttgcttcgagtgcccgtctccacgatcgatttaaaacgctccagcccagctcatatggacctgaacatcatgggccacaaggaggcccggatcctgttcaggtccaagatgtatggggtcgcgcgtcggccggaatttcgtcacggcccatcttatatgggcccgcactcgagccgcaatcctgttctggcccaacgaaaaataaataaaattaggcgcattcattcttgaccttacgtaccgagatcaaacgaaatcatcacgtggttaaacaacgcacttttaagttcaaaaaaaaaaaacaacgcacttttcccgattaaaattccgctctgattcgcaaactataacaccaaacaaacgggcgttgagattgagaaactcgtgagctccatccgcaaccgcaaatgacgcttcccagccgcgaaaacgacatcggcgaccttccaaaccctccataagctttagcttccaattccatgccctctcatcgccaccaaagccgttgacctcgcagctttaatccccgcccccagcctctgtcccgtggactcgcagcagcacacggcatccgtagccgagggcggagcagggatcgacgagcggcgaggaggcgggcgagcggctggccggcatggaccggaatctgagcgggttcctgatcgggtgcgtcggcgccgccgtgacgctgctggcgtacgagcagacgctggtgtcgagcacgcagtgcatcgccgccggcttcgtcgtcctcctcttcgcgctcttcgtcaaggagggcttcatctcgctctgattttctgcgtgtcagcggcgacttggtttgggggttccccttctctgcagctcgtttccgattctttgcttccgtttttctgtacctcatgtcctgtagaagtgtagagtagccactagttggaaaaggaatagcttttgcaagcaaaaactaatcctttccgaactatgaatgccatcttggtgacttggtgatggttgggtcatgtaatcctgcaattgctgatgcttgttaccaatcaaattgtattagtagatgactacttgtatctctgtatgtacccttcttccttaacacgatgaactgcatagtccttgttgtagcttccacttatcatcctgatatctggtctgtgtgactgttactctttgctttgcttctgaatacatacagatatactttgtttcgttagctgaaacataagtcgatggttctctatgagttttatcttcggctgaacttttgaataaaaaaatcagtatcatgaaaacataaattgttggataaaatccacctaaattggtacttaatttactccgagtgttcttttttttttcccgaagagataatcttgatctgctagtgttcagcccaaaatatttaaaagcgatgcccggcaaaaaaaatattttaaagcaatgagcaacaaaattaacacagctgcaataaaatgcttcaatacattcaagttcttacaagatacaacagattcagatggagtgctgatatcctacaaatatcatttggcattttgactaactgtactatttctgacaacagagatacagatacaaggccaatagctcccatagctcaaacatacttacgatcccgaattaaagcactctaatcctcgttatctgtactaccttgcctccactacagaatctcaggatttaatcagattactctgctgactgctgacattgaggtacattacggaattgcgttgctacaaaaacgtacacaaattcggacatcggtgtttccatgcctaatgtgcatctcttgacttcaaaactcatagaaaatcttcttcagagaagagtacgtacccgtcgcggcaaccaacgaaccgagcacgatgatcgcggcgatcagcagggtctcgcccctgccgcatcgcgtcaggccgaagatcttgaggtagcagatgcaggggagcagcatggaggccatgacgctgagcagcgagccgacgagcgccatgaggtggccgaagaagggcaccgtgagggcgatcaccaccgtgctgacgacgatgagggtcctgatcagcacgttgacggacctcttgttgccggcgagcagcttctcctcgatcgccgtcgcgaccggggtcaccatcagggcgtacttggagaacgggttgatcagcgtcgtgtagatcgccagcttcgagctgatctttccctccgggaggttcagtgtcacctgagatttgacgtcgtcgccgtacatgaggtagccgagtatggccatggatccgtagttgacagtgcacgccacgaagcatatgaccagtacctatatgcaggtagaaccgtagaagacagacagttcagtcagtcaggggtagtaaaatgagctactgtaggagtactgtccaaagttaaaaaaaaaagaaaataaagagttaatttttactacctccacccaaaaatgtcgcaaactagtatgagatttgacccaacctagaacaaagaatttgaacaaaggttctatcagattcattatcctaggacggataggaagtagttgcgttggatattgtactactgttcagtcatcgtcagacattttcattttcagatagctatcaactatatagtgtcagattcattgcataattccacagttcatatgagaattaaagcatttctttttgtcaagcaataatatgtggcaacagacacttaacagctatttgatgcaacttggcattgttgagcttgacatgaattattcgatgctgcaatgtgcgtgactgttttactactcaatatattcaaggttacttcagagttcaatatcagataaataaagttaaatgaaataaaaagaacccaaattcaccagtcaagccttcagtagttcagtgacatcaaaagtgaaaacagtgggcagctcaccctggagaacttgtccttttcctgcatggagttgcagagcgtggggaatatggcatgaccgcagtagcagaaggtgtacaggccaagagcagtaggcaggccactgacattcagcatcctccccttcccgtggaacccgacgccgtcgaacaccgccgcccacagcacgcagaacaccacgacgacggacgcgagcacgccgctggccgacacgtaggcgagcacggcgaggctcctcagccacgtcgtcggcaggatgacgacggcgacgaccacgacgaacagctgcttcccggacaccacgagcccgccgacggcgaggctggtgcccgggaacagcttgtccaggttgtccccctccagtatcaggaacccgatggcgacgaggtagagctcggcgtagaggaacgccgacacggcgagccggcccttggccccgaacgccagcgcgccgatgtccgggtaaccccgaacggccggcgacgcggccatgcaccgccgcaggaggaggccggtgtagcagcagaccatggcgacggcgagcaggagcaccaggctcagccaccctccctccgacaaggcgtacggaatcgacagcagcccaacgcctgaaccccaagagatcaagattaatcgagttaaacagaccggacgaacagctcctacgaccaaatatcgagtgtttcttgtactcgcctgacagcgcgttgaggccattgaagcaggtgcgcacgaaggtggcgccgtcgccgtcggcctccggcgagcactgcgcctcgtggtcccgctccaccggctcctgcttcccgcgggccggcacggcggcgtgggcctggaggaggggctgctcgaagtccggccgccgcgcggtgctgctgtcctccggcgagccgccgccgccgccacggggcgggtgcggcggcgctgctccgccaatggccatcctcctgcacgcgacgcgacggaggggggagcagagaaccgtggagcgaacggaacagagaagcgagcagagcacgcgcgagtcgtgcagtttgctagtttttggcgtcgcgggcgaacccgcagctgtataaaagggcgagagaactgcgctgttgttttcgtgaaattcttgcgtgcggcgcggcgcacgcgaagttggagagcaacactgcatgcaacgcgatgcagtactgcagcgagggggatctgcacacgactgcagctaaaactggtggcatttagttcttccacgtgggttcaaacatcttttagaaagcattggggatagactccgtctctatttttatcaagattcgtagtattagaatatattatattcggttatttattttttatgaaatggagggagtatactgctaatgatttctcccgtttacttttcagttctttcatttcatggaatctccgaagtttgaaccttggagattaatgtgccaataatcagaaaatctggaagcaacaagctcacttcaatgcgtgcctggtatgctatcatcctaggagtggtgtgtccacaagagtatgacttatgaggatcagactgcacctagatggtgagacggaagcacgcatacagatatttccaagagagtattgttgattgaatggattgcattggatggatatggaccatatggttagctagctactggttgcaaagatttcattttgattcttggatttggctgcagcatgcagctttgctagctagaacgtgacaggccgctccatgttgataagaaatgttcttctacggtttatggagaaaccggtcggtacctactacgttggtactggtcattggtcaatctttttttcccttgggcgtacgtgtcgttctcgactaaattgaagctgaaagagagccagttgacattcctgcgtagctgaaactgaaagagcatttcaccaaactaccaagcagagcaaagctgtgcgcctgcggctgcgccctttcttttttttttcttgacatggggacatggattcttatcatcagcttagaaaattgtgactcaatttgtaactaactaagcaatttgcacctatttaacactttgtatatagtcgttgctttcatccggtaatcaagcatgattaaagcgtgaattaagtagctgtaaggaacatcgatatcatactactatagtattcacacactagctagctatagacggagagtcgtatatgatgctatacatgtggttcgattgagccgttgccaatttgtccttgccgttgagttctagccatgtgagctatgagcagtctcggcaggactccctgtccggcctgatccttttagctagatggatcgttgtgtatttcgtcgtgatcgccccacagagcttggaaaaaggttcgtccgtccggcgcccgccgctagctaacctgcgtggctgtgtgtcacgccatgtggtttgttcgattattaattcgtcgtcgcctcgcgagcggcggtgctctcggtcgatggcgacatgaaattgaagctatagcgtacgtgctgaacggtacatgctcgatcggtacaacgttttttgggcttcaccatcgtcgtgcaacgtttttgggcatgtacgcacgtagctagtacgagtacgacaaccccgatcgagcggttgaacaattgagcggcacctagggcaccagatagaattattgagatcccaataatttgcaaagagaccttgtacgtacgtttgctggagacttgcagctaaacttattcttctaccgcgtgcagacacgtattgatacgtacgttgtcgtacgctctaggtgagcagctatttgcgctcacagctcacgcgctgagtgatttgcaccacacaagacaggagcgcgctggtaattggcaaaggtaacgttgctcatcagcagtccgcacgatgtgacgatggtgacggtagtgcgtgccgttgcgtacgcagtcagggtgagggaggttgtgcgtgaccaggccaggcagagcatatgcggatgtcaacgaggcccatagatccatgggacgacagttttggtccttctccagccggcccggcccatgcacgttgtcctcgatcaaccgtccccggctataataaagcggcctcggctacggcgtggtgtaaaaatcatgtctacatgatgaacgccacttagagcaagtctaatagtacagcccactactaactctaattcatctatagccaatctaatagtcaattcatacaatagttgcttactatactattaatatatggtcccacctgtcatacacagtgtgtcttggagtccgtgctgcagctggctacagatctgtagtccgctgctattccctctcattgtttatcttattaaaaaatgtttatagctggctaatagcctgctattgtacttgctctcagagcaagtataatagtgagttataagcctactataagattatgtggaggagagaggtaaacaaaagagaagggtgttggctctcatacaaaacctagcttaacacaaactccaagacaaatacattaaatgtataagtgagagataaagatagaagaaaaaaaattatagctaactgattttagtataggctaatagtagaaagtggactatattattatccttactcttatacaacaacgtggatcaaatcttcagtgttttgtcacaacaactcgtaaacaaagttacgttaagagtgcgtcctcgtgacagccaccagctagcccagcgctatatcctgccgatcaccgcggtctacttggcgacggtgccagcgcagcggcgcgggtcgacggcgccccgaagatgcggaggtagcaggcacaatatgcacgcgcacccacgcgctgagcatctacccaaccagcgccatgagagcaagttcaatagtactattaatgtatgcttcaattaaacttattaatggtactattaatggtgtagtatactccctcatcataaaggaagtcgtttagaataatgtttaagtcaaacatcgggaatataaatcatgaataactcttaagttgttgagtttaaaaatataaaaataatatgaacagatttgtcttgaaaaatactttcataaaagttacatatatcatttttcaataaatatttttatagaaacaagaagttaaagttgtattttggagaccatgttgctgcccaaaacgacttcctttacgagtacggagagagtatacttaaattcatctatagtcaatctaatagcttattcacacaatatatggtcgcacctctcatatacacacgacgtattgaagtctgtgctgtagttggctacaaatctatagctcactttccttttctctcttctcttctcttctctccatgactttttgaaagctcctattcacacctcctagtatatttgtttgtggcaacttgttgacatggactcaacaataaataatcccccttctagcagcatgtccactattcaggtacgatcaagtgttcaactcagatcagaaaagaacagtccagatactgaaatcatatcatttcaaaccttcttcactgaataagagaaaaaaaaactgtggatatattgaaagcatatcatttcaaaattcttgcaccgaatgagagagatcatccatggagccacatctaccacacgcgcaaagaacagatggataatggtacgtgatgcaggacatcggtgctagatcactagggttcaaacaaacataatttcttggtcacttggggtcaaacatacatagaaacaagacatcattgctggcatgttgctatgaaaatactccagaatgttgctgcttgcatgtagatgtagtagcccacttatctactgtcaccttaatcgtagtagtaggagtttcatcagcgataaaaaagatgaatgaaaagaaaaggtgaaatcaggttttccccaattacatcttatacatgtaagagcatggtcaccttgaaattgtgaacagagtgcatatttttcaagtcgctatgaccgccgaacagagtcctactcttaacatttgggacgataaaatactttaacaattattgtactaaaactacgttttattatctttgttttctttttctcctttctcataaagtaaaagttataaatgctagggatcgatattaagccgttgtcatacgtaacaacgatatttctttctcttccggccccctcttttccatgttagtagacttacctgataaacaaatctaagagattgctattgattgtcattgtacatgttctcagattcactactcttttattgtgagcatatttctgaaattatgaaatggtgtgtgttttaaatactttctatataaaatttcttttaaaatcatttttaaaaaatttacaatactcaatacttaattaattatgtactaatgcctaatatcattcctgcgtccctaaccaactcagatgcagtcttagttctttcatcaccgatatgtgggacttaccaagcctaacaagtcctttcttatcatttgatagtcctttcttactattcgatctagtagccactgcctaacttagacagttggcagccttagtcagcccacttgcatgcatggactatggaagggtggagcccaacaaccgtcaaggagaatatttcttggaatgtttcgtttggagtggtatatttcatattaatttggagtaaatttcataaaattgcatatattttgcacattctatcacaaaactacagatttaagaacttatttcacaaaactacagatttagtgtctacgtttatcacaaaactataggtactttccacaatacatcacaaaactacagatttaagaacttgtttcacaaaactacagatttaatatcttcatttatcacaaaactacaagtttagtgtcttcattatcacaaaactacatattttagcatttaaaacatgtagttttgtgataatgaagacactaaacatgtagttttgtgataaaagaagatactaaatgtatagttatgggataaacgaatacactaaatctatagttttatgaaacaagttcttaaatatgtagttttgtgatagattatacaaagtacatgtagttttgtgataaaagtagacactaaatatatagttttgtgaaacaagctcttaaatctgtagttttgtgataaattgtgcaaaatacctgtagttttgtgaaatttactcattaatttatcttatcaatctggtaaaaataaattaaactcaacttaaaagaaactttggtttttgtaattgtagaagtcaaatttaatattttatgtttgtaaggcgatatatctcatactaatctatcttacaagttatttttaaaatataataaacgagggatattcccttaaaagacaaatccatctccttataacttatactatttttctttcacaatagagttactgatttatatatacaaaacttataacaatgttacccgtgcaatctatgcacccttgcaatctatgcaggccaccacactaatcgacgaaaaatcaatccacacactcccataacaatttggatcaaatcttcgatgtattatcacaccaactcacggataattttcatcagggaatagtaagtccccgtgacagccaccagcgagcccagcaccagtatcccgccgatcgccacggcctccacgctgctcatcgacggcgccccgaagatcctgacgtagcaggcgcagggcagcagcatgcagacggccacgttgagcatcgatcccaccagcgccatgaggtccgcgaagaacggcagcgcaagcgccacggccaccgtgctgagcaccagcagcgtcctcaccgccacggagacggcgcgcgctcccttgccggcggcgccgcggatcctctcctcgacggcggcagcgatcggcgtcaccaccagtgcgtacttggtgaccgggttgagcagcgtcgtgtatatggcgaccttggagctgagcctcgccgacgggaggttgagcgtcacctgggacagcacgccgtcgccgtacatgaggtagccgagcaccgccattgcaggaagcatatcactagcatctggttgatatttgataataattaattgatcaataatcaattgaagagttggtcagtatattgatcgaccatcaattaatccattctgattatgcaccagattgtttataacttgctttaaaaatatatgttttctcaaaaacgtgatttcttctactacattatttctcaggattatctatttgtcaagagattttttttcttatctatcaatcgcatttttaacactagctagatcaatatatatcaacaaactcatccttatgttctttctccttgtggtgaagaaaataatattctaacctaaaagtttaaaaaatattttttggtatatcttctatgtcccttctatacctcttccattagttagccgttaaatttctatcataaagttcattttgccctttggtatcgagaaaatataaatttatgaaatatattgatgtagtgtataaatttattgtatgggactattatatgtatgagtttattttgtgagatattatttaataaaagtaatattttagtttcgcctcgcgaagggaaaacaaaagtaatttttatctatgacaatttattttagataaaacaaaaaataatattttttatcattgaaaactgtatatatatagcatagtttgttatagtagtacgcaaatttttataagataaatcttgttatatgagataaaaattatttttgttaaataatatcttacaaaataaactcataaatataatagtcgcatacaataaatttatacactccatcaatatacttcacaaatttatttttttataccaaagggtaaaatggagtttatgatatgaatttaacggtcaactgacaaaaggagtatagaggggattcaaagtaaaatttaggagtatggaagtaaataatcaaatctcaggaatatagaagggattggacgaacttttaggggtacatagggaaatttctcttcatataaacataataatgcactaaattggtccagaaaatatttttttaaaaaagcaaagctaaaagttgcagtgttttttttatatatagtagtgtgcaagtttagtaaatgacctttgcaaattggttgactaacggataagaaaaaatcacgactgataaatagcatagtgttatgcgcatgcgtatacgggtatacctttggaaactgagacttcctcttcatagatgtgtagagcgtcgggaacatggggtgtcccccgtagcagaagatgtacagcccgagagccgtcgggagccccgcgatccgtagcggcgtcgtcgtccctcgtccggagaatccgacgccgtcgacggccgcggcccacagcacgctgagcacgatgacgacggacgcgaacacgcccgtggcggagacgtacgcgagcacgccgaggctgcgcagccacgtcgtgggcgccaccacgagcgcgacgagcacgacgaacagccgcttcccggcgagggacaccgtccccagggtgactctggctcctgggaagagcttgtcgaggttgtcgccctcgaggatgaggaagccggtggcgacgaggtagagctcgacgtacgtgaaggcggacacgaggaggcggcccgtgcggccgaacgcgcgctcgccgatgtccgggtacgtccggatggcgtcgtcggcgtccatgcagcggcagaggaggatcccggtgtaccagcaggcggcggccacggcggcgagcagcgcgaggctcacccagcccccctcggagagggcgtagggcacggtgagcaagccaacccctggtcgatcagagaatatatagcggcatgagtgcgcacggtaaatcaacgcaagcaattaagcaagactgcaaggtagctagaagatctcgagcaacatgtacgcaccggacagggcattgaggccattcatgcaagttcgcgcggtgccgaccggcattgtgttcccgtttatagttagtaaataaatctggcaatattagtataagaggctcagcatggattaatgcagggtcatcttggagcagtatatataggcaatagccaagccccaaaacaggctggaacttggaagcatttctgcacttcagcgtctcgcttttgctgcatacagcatacgttgttgggtgcatcacctatacctacctatgcgcagctatgctagctagttggtcactatgaaagatacagtagctaaagctagttggtcactgtgagagaactcctatgttacgtttaactttaaaaaaaacatggttattgataagtaaatcatgttatcctaactgtagattgtataatttaatttgtgttgtcctgaaccacctaacacttgcttggtccagactgcttcttatgtaacgagatatgccctcccactgatcctccagtgactgcccggcgtgtcacagttgtatactacacttcttctaatatattgatgtgtaaagtttctacgtgttcatgaaaaaaacccttgcatacaatacaatctcgagaatgctctaccaattgcacacctaatggataacgaaatattggttttgctttaaatttcctagccacccgtttcacagccttgtgacaatcctcctttccctcctctctcaagcctcaagcaggtcctcgtggtggagcgaacggtactacttgttttcattaacagggtcaggggcacggttgccatgagcaatgaggaggaatcggagggggggggggggctggctccccgtgcgctagtggggcccttgatatcggtgtgcgtcaagacaaagtgatacaaagtttatacgtatgtatataaaagtatatacatacatatatacatataaagaggagagatgagagactagagggggcgaactcaccgcgcaggcttgcccccgtgtgaccacccatgcattagcacccctcagcgcggcacccatgtactatctatctaagaatctataccattgtacatgctccgatgagctccaccgaaagttagggatgggaacggtgatggatattcccaaccgatccattattgttctcgtagaagttgtgacgtttctgattctagacataaatttaaattgtctaattcctattagtatcatattgatggtattactaaaatagttgaattggaaaatatagagaattctccaacgatttcatccctaccatccactcttacaaaaacagtgctcgatcagttgggaatttctatcaccattttcatttgtcacatagttgagagttctcctttgtaatttaatatatggatgattcaacatcacgtccattaatcttttaattcctgtcccaaaaaaactgttaaggacttcttagaaaaaaaaatcgccgtattttctaagggaattttattaattgatcatggagaatatcctgtggaactcctatgttcaaaaagagcactaaagtcccctgtagtgatgagtgtgaataaacatgtttttttaagaaacgcattataaatccagttgctcatatcgtgcacgcatttatcctataaacgcacaaacacacgtggaacacaccacctctacgattgaacctccgaaagactaggttgacatattttgagactaatgcaaaagtcatcacggacgccttgatgtcgacagatatatcgccttgaaagaataattagccgtaaatatgagcatccatgtgaccatgtcaagtttagaacttaaacctgaataggctggttacaacttaagttagttaaggtaagcatattttgtatgtgaatatatttatatatacacacacacggataagagacaaaggtttgacaatgtcatgatgtcaagagaaagaacagaaagcgatcacactatcatttgtcaagtttcgctatatagaacttatatttcgtgacaaacaacgaaaatcttcaatatataacgcctcctgcttcgtaatggatgatttttagagaaatttcacaataataattaaactagttcatgtgaaaatcatgaaaattaacgtctcaaggagctctaaatccacatgcattcattgatgactccaactcctggtaatttgatgcacatgttgcatgctagtaacttcactgatgaaaagaacaaaaaaaatctacaagcaggctagtaactcctggtatattgtatagattaattagttaattaccgtgagttactagcaacactagaagctgaaacatacgacctcgaccatgcgttcggtgatccgtaccaacatgagattttgtataagcactcgaggttgcttggtggctggcaaaccaagtgtaaaataattcacgatcaggtgcagctagcgggagccatacgttcttttccaatcaaggagtgatcaagctactcgcacactcgactgatcacatcaggttcaggaagcacttgcgtgctatccactgtgctgctgcatgcatggttccatttctttacagttaataacacagtatgatacgtctcttaattctgctaagtatgcttattccctcctatcataaatacttgaaacgttttggataagttaagattcgatctaacattttaaacttcagctgtaacaaactttgaaatatttagtttaggagtagtagattcgtcttgaaaacacacaactccctccgtttttttcataacacgattgacttctaaagatagctacgaaagttaatatatttttattaacttattctagtaactagcaaaatacatgtgtcttataacatgttctaataatactagatgatctaatctattatattattaaaacagctttgaaagaaggcaccacgttcactgtgggactagaaattttcacattaatcggagaaaagaaaaaaaaagaaaatgagagttcaagtagaaatacaatcttccatataagaacccaatacgagattaatcaaaattcgaaataaaaataaaataaaatccaaaattagaaaagaaaaggatagtccaagtaggaatacaattttaaaatagctgaaattcggaattaaaaatatggtatattaaaagaagagtccatataagaacccaatacgagattaattaaaattagaaataaaaataaaaataaaatctgaaattagaaaaaaaagaagagttcaagtaggaatacaatttaaaattagctgaaattcggaattaaaaataagcaatattgaaaacagaatccatataagaacccaatatgagattaattaaaattcagaaaaaaacaaaataatatccaaaattagaaaaaataaaagagagctcaagtagtaatacaattatgaaacaactaaaaataaaaataaaaataaaaatattaaaagaacacaatacgatattaattaaaatttgaaaaaaataaattctaaaattagaaaaagaaaaacaagatttcaattaagaatacaatttataaataactaaaatttgtgataaaaataaagactattgaaagaaaaaaccatctaaaacacatgacgagataatttaagtaacatgcctacaaaggagtagagtggtggcggttgatacggaatataaaaactgttgataaaacaccaaatataatccaaatgacgattaaatggagggacgacaagcaggctatgaagcaaacgagtaaggcggttgccgggacttctaaaaaataataaataataaatcccattgataatcatattcgatttttaaaatctcaatgacaataaaaaggagaagcagcggacggggtgtataggagtatagttgcaaagccgctgattgttgacgggacttctagaaaataaaaaatgaattccatcgatagttatgttcgatttttagaatcacaatgataataaagagtaggcggcggacgggacgttgaggagtatagtggcatcgtttgacgagacttctaaaaattataaaaaatgaaactcaacaagacaataaactctaaaaactacaatgtccaatttttaaaggtttggaacttctaaaaagtaaaaaaaacaattataatcatgttcgattttaaaatctcaatgacaataaagaagggaggcagtaggcgagccgtagagaagtgcaatggcaaagccgctgatggtttggcgagacttctagaaagtaaaaatgaacccaaacgataattatgttcgatttttaaaatctcaatgacaataaagagaaaagacaatggacaggcaatagaggagtataatgacaacgtttgacggaacgtctagaaattataagaacgaaacccaacattacaataaactctaaaaactatttcatccaatttttaaaggttccaaggagaataaatagaaatagtggtagatcaagcaagcaaaataaggaaggagatgatataaggggcagcaactgatgtgacttttaaaaaactatataagtagaaacactagatgataaggtttggtgtttcaaagtcttaagacaatgagatagctatttataaattttaagtaaaattatattaaaaaatatattattttgtttggatgctagtcgcgcaattgcgcgggccatccagctagttaagactaaacgcacatgtaattattatcttaaaaaaacgcacatgtaattaactggtggcggtggcagacgaacgtacattatcactggtttcttttaagattatataggtatatagaaaagttgtaattgaagtcttaaaaattataaaagaatgaaacgccttaaactcttatgtcgatcggagggagtttcgacacgagttttaatctgagaacgtccgtgtgctcagtgctaggaacgagacagatgacaagaaggaagtaaaagtaaaattgctttcgctgtgttggtatcaggtgtgttggcaaatgacaatggcatttgaaataatcgtttccatgaccacgagagtccttgtcagactttagtttgttcgacgaaaaaaaaatagttactactactacgttgctcgcgtacggcaggtttagcattaatgaacgttgaattatgaccaaggtgattatttttgtgctcagtttgttcaacgaaaaaaaatactacctatgtttctaaatattttgacaccgttgactttttaagcacatatttgaccgttcgtcttattaaaaataattgtaaaatatacaaaactatatgtatacataaaagtatatttaataatgaatcaaatgataagaaaagaattaataattacttaatttttttaataagacgaatggtcaaacatgtttaaaaaaatcaacggcgccaaatatttagaaacggaggtagtagtagctagtagtagtagttacattgtgctaactactttgtgtttaattggtcatgttcgtcaggtttagcatttatcaccgtgttgaattagagccaagtagccaaggtgattgtttttgtcgttagtaacttgggcacgataaccataatttttcactgtttcagattttaacacgacttgaacacaaagatgtgctttgtgcagaacgcgtatatggtcaccaactcagcgatgacctttcactttcagcgagctatcagtagtaacagcagaaaaaaaaattgagaatatgccttttattttaacaatttacgtttatatccctacgtgggaagaaattgcagaaatatatgtatgccgcagaccgaaaacgtgggtgcgatcacaaatcgtgttgcggagacgcaggactgctggtcagaccgtccccgcagaatgggcaagaggaacccgcgtctccacaacacgatttgtgagcacatcagcattttcaatttatagcatgtgtatatttcaatgatttcttctcatgcaagtatataaacaaaaaatatttaagaaaatgtatattatcattttttttcagtaacagcataatcaaaacaagggttttgcacaagtcggcagtattttttgcgcataggacatctctataagtgaaaattaaatcccacaaagaaactaggatatgtcacgtcatctaacaaatacttaccgtcagatgcacttaaagacactacatatataaaaagtgattctcggtacatctttacatatatagccgtagagtaacccaccaataaacataccgaataacgtgtgtgttatggattttatgtcaataaaattgcaataaatcctacattcgcaattaaacaacatagcaagtctaaaattatcagatgtgcaggtcatagaaacaatcataaattaataaataaaataaaaaaatatctaccacctacagaaatatatatatatatgtaactaacaaatagaaaaacaaactgatatgcataatccaaaactatatctcaacctaattgcttgaacattgaaccaaatactctccaaagttcaattcttaacaaaatcaaataatataattcaaatccgcaaatagaccaattaaattttaacatacgtaatcattacaaacaatgtactatcatattcgaaaataaaagacaggttatggtcgcctgtaggcacgacttagatagctagtgttaagtgatgataatttctagaaatgtgcagttatcgactcatgcaagcctgctcaaatatatagaaattaaatttagtaaagtttaatgaaaaccaaacaatgcgtatgaatttcgagtggttgggtcgcatttcacagtacggaaaggcctggacaacgcaccgggagtctcaagggctcaaggcttcaagccgatgatgcgagtctttttttttacgggctcaaaagcccaacgattctaacgtagcccatggttgccctcgcttggtccggttgtacggtgtacggtgtaccacgcgctgccaccactaacgacagcgcgccgagcacagatccaccggtcgtcgatggctgtcgcgtacgctcagcgcttgcatcgatcggctgtctgtccggtcaagtcgctgatggctgaagcgaactgaaaatgtcgaagagaacatggtaattttgatcaaggacaagcgcatttcgctggtttactgcatctgcatgcgtgcgaacttggaaagagggttacacattacattggcctcgactagcatacgtgtcgcggcagcctaattagcttgcccactctagcttgacatctctgtacaagtatctctataacaaaatcgttcgaactccacaaggcggaaacgactcagacctcaagacaaaaggagctagaagaagaggaagaagaagagaattgacacttaaaatatatatatcccgaccatcgaccatggtactgacccaggcgagtcatcagcaactcagcatttgttgtgtatcgggtcggaccctcgccggactcgacgcttgctcatcctgtcagggtcgaacaccttcgaaggagaggagccggtcgccgtcgccgtcgccgccgcggccttcacggaggcgtcaaaggtggcggtggcggcgacggcattgccgccctccacgagctctcgcggccgctctgttggtggcgaggcgctccggcgactcgcggcgaacacggccggggttctgacggcgagaacctcgtcggaaaaggaggccaagaggacgacgacgagaaccagcaccgccagtgctaggttgagacctctcattctcttctaaccaagggcgcgttgttggtacaagctaagctagtttttgcgagagaaatctgtgtagatagtgtaagcttcgaccatgttggtaacaatggccgcatcctgtgcctttgttctgctagatataggaatagggaagcagggacacttaggcagtgttaggccacatctgtaactgggatggctgagatctcggtccaaaagcataaagctcaaagagatggacacccaacaaggcaaccaaatcactttatacttgaaggtgattcttgctgagttgctggctcatggtgttgcgcatttgcatgtaacccagtactagtttggtagaaagagaagggcgttgcgggtctgcctgacaagctactgaaatatactcctatcttagacgtgacatgtgagtgactgaggtactccctccgtcccaaaaaaaagacaaaccctgatttctgtgtccaacgtttgacagtccgtcttatttgaaaaaaatatgaaaaaaaaattaaaaagataagtcacgcataaagtattaatcatgttttatcatctaacaaaaatgaaaatactaattataaaaaaatttcatataagacggacagtcaaacgttggcacggaaacctaaggtttaccttttttttttttgacttagggagtaaatagtagcttggtgttttggtaatgcaggattatgcggtgatggttaatcaacatcaaaaaaacaaaggtgaccgtgcccactgggaaaagaaagcacagcatgcagttgcattctgcggtgctgaattctattttagaagaatctgccaggtggaaataaagatgctggggaatagctagctacactacagtgtcacttggaggaatttaggaccaatgcaagactgtcactgggttacctctctactgtctctttctttggattataaaccgtctctttttttggattgtagatcagccaacccaagctgttgctttctcttctttgtgtactttggaagcttctctctgaataaaggagcacgcctccccatgctgaaaccaacacaacgcacatcctgctactcctgccgtgctttaccttactgtgccatatagctgttgctttatgttgtgttattctacagtatcattcttggcttcttgtcgtgtaacaccatttttaccttgggaaatttttttcccttccgcaatgaagcttgttttgccttggattgagtggatcagtccaaaaccaaaagccaatcttggcccgttcaaagatccaaagtgggaaccaagccacgccacacagcgaaaagcctcccactgttgccgctagtagcgacattcccttcttcttttgctttctttaggtaatccccctagggttacttaggctgcgttctttcaaaggagattggggagattgtcattcgttttccgcgcgcacgcttcccaaactactaaacggtgtattttttttaaaaaaattctatatgaaagttgctttaaaaattcatattagtccatttttgaaatttaaaatagttaatactcaattaatcttgcgttaatggctcacctcgttttacgtatcttcccaattttctcaatcccctcaccatcaaacacagccttagagcaaacacccttgttaaccccccaaaagagaaggaatttcagctggttacctacatatacttacatcaatgagatcatcaggatggactgactgcatcataatcttcaaaggattatgacgtataataagcagaaactctgatgtatattgaggcaccatctatggagaggagagagagagagagagagagttctgaatcgattcgttttagtatttaagaaacaaacgaaaaaggcttcaggttggaagcatgaacagctcagcaaatgcgatatttacaaaagcaatagatcggggatgccaacttactgctagaaatacatcagatacttgcctcttctaaaggcaaggttacctccagagtttcagcgcctctttggattgtcaagctcaccttgtctccaacgccataatcatccagaaccctcgatagatcagatttgcctttgatctgctccaaaagatccaacatgagaaacagagactggactaaggctaccttagtacatagcatccaaggattctgacagaaggctataaaatcagtttaatgttaaccaatcaacacttacaggtttaccgtccacggcaacaatgacatcaccaagaacaatgttaccagcaaaacccctactggtaggaacaagaccagctttggctgcagcactgcccccaggaacctgcagaaacagaaatattatgaacagaatccagtttggccaacagaaaatatgggttacaccaactcagtctacctgcaatattagagatccagtgcgaacattaagctgatatgcgattggatctggagcaaactccacattcaagccagcacggcgaaccttaagagaggagtgtaagcataatttaaaataaaatagaatacagaagctaactgctaagcacatgtgtcggcaatggaaaagaaagaaggttcttaatagcaatctaaaatttatctgtgctcaaaatttttgcaacaaaaacattcaagcaatagtgttcacaaagtttcaagagagttttcaggaggggagggcaaagttttgggccaaactcagaccaaaattaatttaactatctttggaaaaggtccctatagtatttacaaaaacttatcaaccgaaagtttcctcctactgctaacacctaaagttgactctgagcatgtttcacagcatgttggtctaaaatcatgacaaccacagttattgattattgataaagaatcacaatccataagatgccatctaatgcatgaaacatatacctacatatggcatctccataaacataacacattattctaaggggatgattagaaaatacgtatgttattaggttgatgatgatgttattgaaagatatccatgcaacatacttttccaaactgaattaactgaggagctattttcagaacagttgatgacgggatggcaaaaccaacaccagcagatgttcctgcgacattgaagaaataatggaatctcagactaacataggaatttaagttacattggacatagttggatctgaatatctgatttatgctctaccaaatcaacaacaaaaacaaatggtctaatgcacagcttcaaggaggtgattttgagtcaactataatcaattatgtcaattcttacagcccattaggatgcaagcaaataacaatttcaaagaatgctgtgaatccgaatataaacatgatagatgataccactcactaatcatgccatcaaaatagaaagtcactcaaagtgtgccatcaaccagagtactctgggaaatgaactgatgtacagggatcgaggcaagctttgcaatgtgttatgatcattttagtttattgaggatgaacttttactaattggacatattctcttttgaatgctaagtgcagtgcttgacatctgtagagaaagcatgaacatctactaatgttacctccgcaaatcagcatgaaacaattcagtgctatttgattaatacatttcatgttgagataatctaacctgtctgtgtgaaaattgctgtattaataccaatcatatgccccttcgaatccagcaatggaccaccactgcatggacatacatcagtatacatgcttagtaaaaccctctataatacattttcagaaacataaatatccaacacatattgtataaaccactacttacaacatgatccttaaccctagatgttcattgccccagagtacaggtaatgcatactaaatcacttcaaggacgagggcatacatggtcaagctgattttgaccacaaatatgatcaaattctaccctaatatagtaaactggtagcaacaaatattaccactatgccaactgccagagctgcaatttagccccaatctatgtgtcctgactttagatgcgatgctagaaactcaagaaagtaagaagtaaaatacttcctcttctgtgtcctgagtcaactgttttgcactgttataggcaagtactatcattttgtgcatagtagaaaccataaacagtaatacagtatagccatcaagtaactagtgacaaaagtgtttatgcttgtcagtaagtaatatacagatgtaaaccagtacaactaatggtagtttccaggttgggttctgagaccagaaaagggtaatcagttgataaatcattaaagaaacatatctacaaacctgttcccagggttaatagctgcatctgtttgaattccacctccaattgttactccagcttgactgaaaatgtctcgatttaaaccactgatgacaccaacagttagagcatggtcaaagccaaatggatttccaattgctaaacactgttgaccaactcttagagctgaagattgtcccacgttaattggcttcaacagatctgtaggagcatccacctattgcatgtccataatccatatatgaggtactatgtctgacaacatttgagctcaggtgaaaatcacaacaggactttacgcactaacaaaccgtaaaattatctaatacagcccttccattggttgtccttgaactagattccattgggacaaggcaggcataagatgagtaggtaaataaaaacatcttggtatctaaaaacatacatatactatttccgtaaaagaagaaaggacggggcaaacaaaagtatgtattcttgacctctgaaaggaacctccccccctccccccccccctcagtttcgtaacttaactcttcaaaaaacatttcaatcaaatagcatgggacccctaactcaacagaagaaaatgttgtgttactgtcacaaataaactattataccataacaaaacaaaacaacaaaaagggaaaaactgaagcagttggctaaagagatgaatttttacttatgaaactaaaactccaaaagtatcatttttttctttttctgttacttccactttctactccctttttattttcttagtccatgacatatgccatgtgagataaaaatgagcagatagttaaatccttggctaacgacagaaggatattaatgagagtttgaggcatgtacatgccaggccaccagggagatgaaatgaattgaatgactaatataaaatgttgcacaccgaaatgagatgagagaaacctatggtaaacatagtgatgatagatgacaattctctatagctaatcaaaagacttctcaccttgagaacagcaagatctttagaacggtcagcaccaaccaatttgccttcaaaatttttctgtatcctttcaggtagatataggagagcaccagagcattaacgattagttggcttgcatatacaaggaacattgcaattgtatatacattaaatcatgaaactatcctgtaaaatgcagttttattagaatttacccatcagcagcaagaatgttgacacgcgcaacaacttcgccaggctttggtttttttgaaagggcattgccaaccactgtcattgcaccaacaattaaaatgaataagatgagtgtgcaacagggtgaaagggtcaagcaccataattatgtatgaaggaatttagatctctcacatatgatgggtttttaatttactgactgccataccatggtagtttgtaacaatatggccggaatcatcccaaactacgccagaaccatttccttcgggaatctataatgaatattaagaagtttctttcaaacaagggcttctaaaatttctattaaaagtaacaataagactctacacatgatatctgcgaaagatatacaggacatcaagacaataaatcagcaattccttgtctaactttagcttgatcgaatcaccagttcagaaagaaagaatgccagacttgtcctatcctagtgcttctatggagaatactagtgatgcatttgtcaatttgagcaacaactaacacatactcttgactctactctaacctataacacgaaagcacattttagttttacctcaacaacaccagttacattgagctgagggcgcagagttgcatcaaaaatgttgacaacagagtaagtatttgtttcaaaaagctctgcgatccgtttctgccatgcaagccataaaagaagaaatatccaaagaaatgtaaatatatttttggaagaagtaaaataggataaagtgggttcaactaagtactgacctcagttggaaacagtggaccagatggaaaaatctttggagtgacatcatcaattttaacagatggatcacccaaagcaagtgctgtatttaaggagttgtaagttacaaagcatgaacacttatagagtaaattaaatactacaaaagcaatcatttgggtaggtgacaactgacaaggatcgagttaatttctattaacacctaaattatcatgccacttagtccgaacctgagaagtaccttgaagaatgtaagcaaaagcaaaacgatgataatgcaacaagcttcctccttgacgcaagcaatacaggtttacttgacatttcaccatatgtttccatcattgacctggaatataatttcagataaacataaacagatagagtgaataggaaaacggtcaaccaactatgaatacctaatgcaggtgcacatagtcacagagtgagcgccgtgcaaaagacaaatactactaacagaacatgagaaaatgtggacgctgcttgatggtgagttaactaacacgaatgttctcgcacatcgaattttcccctaaaaattcatcaactactactctactagatatcaaacggaacacaactggaataatcaataatctcccgctagaagcaaccgagattcagcaagcgaaaggtacccaaattgggccatcctacactaactacgcaatacagttatccagaaccaccagattgtaccgatgaaaaccacccggttagaacaaaatttctggcgcaggggcaaggggcgggcatacctcggggccgtttcctcgccgtcgcgggtgaagggggaggaggcggcgcactcgatagccatcctccggcggccgccgccgccgacgcgactgcccggggcgcgcgcggccggagcggcgcaggcgaggcagtgcatcccaggttccgagcaagcaatccagagccccgcggggtctcgaatgggaggagtggtgggggtgcgtgcgtgtgtggcttgcgagcgaccaccgtgaagcgagatgatttgaaacctcacaccaattctggggcgtgacggactgacggtatcgtgggggatggccggatgggagaggtgtacgggcatacggcccagaccatctcagcccaattaaacaggccacacgatgctgtttttgacagagccccctctttccaaatagcccctatttttgtacttttttttcagaaaggtccccatgtatttgcactcagtccccttaaggccttgctcggtttaaagagtgttgaagaggattggaggggtttgtggggattaatcgaatatagcctaagggttgaaaacagtatggattcggatactcgaatggataccaaattattttagcggattgggatttggtgtggatgtagcgttgaaaatgatatagagtcgaagataacacggcctataaacgaatcaaaaatatcggatgttgcatacatatacaacgtaatacaataataacaagaattagaaacacttaacatcacaccacacaataaagctaattagacttacaaactagatagagagcttatatctactattataaaaatttaagatgtttttatcggtactttgatacgtcatccgtgtttgaatcggttttaattttattttcagttttaatctctgtatctctatctctacttaaaaagaataagaaatttccaaagtcggtaaaaaagaaaaagaagtccgactaaaaaggtaaaagaaaagtccgactaaaaaaaggataaaaaagcttctatcgttgtaagaaagaaaatcgtccgactcaaggaaaaaaagggggaaaaagtctcgccagtaaaaaaacaaaaaaaaaagtccgtttgtgtttttttactggcgatttttttttcacgctaaagagtttttttcctgcgcacgcgttattggtttttttttctggttttttcaatcacaccgcgcctcccgggcgcttttgttttttttttgtcaatttttttcaccggttttttatcccatgcgattttggtttttctcatctggttttttttaatccgatctattcgcggcacgtgtaccaagttgaaccctggcgacgcgctagcgccatatcgatcgtgcgttttccctccaatttgattgcaaataaaaaaatcgattcctactcctccctcatcattctctctatgattttcctcgctttattttgtcggatttaatctaacggttgccgatgatgacggcgatctttcccgattatttttatcccgagttttatgctctgattttgggtaaaacggaaaaaggtgagtggccggataaaaaaccctcaaccaattttgggtgattgaggaagattcgtccggatttgatgggtcgaaggaagcaggccaaacgaaggaggtagcggaccgacctagggctaaaaacggcttcactcgtgactgggtcgaaacaagcaagctaaatagagggaggtagcggactggcctagggctgaaaagtaaggaatgctttcgccccaaaacccaagaaagattttcattaactttttttaattataatatatagcgatcccaatattagaattttcattaactttttcaattataatgtatagcgatctcaatatttcaatttgttgctcagctcttaatatatcattgaaaaaacgtatttactcattgcaacgcacaggcattttttctagtaagagaaaaaaacaaacaaatcatttggttgagctatgatagcaatataatcatatggctagttattaaaaattgaattatctggatagcactttgttagataattcgcattaaaaaatcggataatatgcatcattgaattttagcaataccatattctaatcctaatacgccagattttacaaaatattttaccatattattagttctattggattcggaccaaaacagaaaaataaccgatccatttttcatcccttctggtaaaccatggacctcgaagtcttaactccctcaaaggttaagataaaatacggagaaaattctatccgtgatccaaaaatttatcccaaatcaaagaataccacaaaattttcacaataccaatcaataccacataaagaaccaaatgatgcattcatctttctctcctcatcccctctcatctgatctttggagtggattcatcctcttccggagcttgagatagatgccattgtcgtgtctgccattgccaaggacgaggtggtcacaccgaggcttcggctggagctcgatctagatggcgtcatcgctgctattgtcgtagtcttgatgattaatcaattcaatcttggctgtcatgagaggagaggttagatttcgtggtatagatggaaaatttggttattagatttcgtggtatagatggaaaatttggttatctttgtggtattatttggcattcaaaaaattttgtggtattctttgattggagaaaatgtttgttatgggcggattttcttaaggaaaaagtacaccaaaggtccctcaacttgtcatcgagttacaaaatcgtcccccaaccacaaaaccagatatgaaacatccctcatcttgaggaataagaagcaacccataacaaacatttgctccgagaggagagaagtgagagagggagatagaggaggaagggagaggatgggatgacgtggcatcctaacatgtggggcccatgtgggtcacatgctgactcggccactacgtgggataaaatcgggctcaagaccactgagggacctaaagtaaacggttttgtaagttgagatggatgtttcatatctggttttgtggttgggggatgattttgtaactcgatgacaagttgagggaccttcggtgtactttttccttttctcaaaggttagctatcaaccccgccgactccgctggaggcccaactcggcccacggccaattactgggccgccgcctgtcgcgcgacgcctctcccttcttccccttgccccatgtcgccggccgcctcctaacccgacctactaccctccatggccgccgccgccgccatcgccgccgcactcctccgccgctccacatcctctcaacaccaccggcgcatcctcctcctcccactcctctcccacctccagcgggccgcgccccgatccccttccccctgggacccaccgccccaccaccgcttcttcttctcctccgacgtgaccgccgagggggacagtaagccgcggccgcctcttgacgggaagcagctatggcgcgaggtgtcgacctcggagcccgccaccggcgcgtcgcgcctcccgaaggccacgtgggacgccgtggtggcgctcctccgccgcttcggcaaggacccggctatgtccgaccaagccctcgcgctctacatccccgcctcggcgttccccacctacgcccgccgcttccgccacttcctccccgcgcgcctctccctggagtccgccgagcacctcctctccctcccggccgacgacgcgcacgccctcctcctcccggccttcgctgagttctgcgtgacccacctcgcggacgagctgaggaagcacgagtctgtcatggccgcggcggacctcacggcgccgcacgcgtggtaccccttcgcccgcgccatgcgccggcgggtggtgtaccactgcgggcccaccaacagcggcaagacgcacaacgcgctcacccgcttcgccgccgccaagtccggcgtgtactgcagcccgctccggctcctcgccatggaggtcttcgacaaggtcaatgccctgggcgtctactgcagcctccgcactggacaggagatcaaggaggtgccattctccaaccacgtcgcgtgcacgatcgaaatgctctccacggaggagccctacgaggttgcagtggttgatgagatacagatgatggctgaccctgtcaggggctatgcgtggacacgagccgttcttgggctcaaggcagacgagatacatctctgtggtgaccctagtgttctgaagattgttcggaagatttgcgcagatactggagatgatttggaggtgcatcaatatgagcgcttcaaaccgcttgttgttgaagcaaagacactgcttggagacctcaagaatgtgcgctctggtgactgcattgtcgcgttttcacgcagagagatatttgaggtgaaactggcaatcgagaagtttacgaagcacaagtgttgcgttatatatggagctcttccaccagagacacggcggcagcaagcaaagctgtttaatgagcaggataatgagtatgatgtgcttgtagcaagtgatgctgttggtatgggattgaacctcaacattaggagagtggtattctatagtttggccaagtacaatggggacaggatggtacctgttgctgcttcacaggtaaaacagattgctgggcgagctggtcggagaggcagtatttacccagatgggctgacaaccaccttcttgttggatgatttggattatttgatccagtgccttcagcagccatttgaggaagcgaagaaagttggtctattcccttgctttgagcaggtggaaagttttgccatccagtttcctgaccttaccttcaatgaactgctggataagttccgtgaaaattgccgcgtcgacagtacatacttcatgtgtcaccaggaaagtatcaagaaggttgctaatatgcttgagaggatccagggtctctccctcaaggatcgctacaatttttgttttgctccagtgaatataagggatccaaaagccatgtaccatcttctgagatttgctacaaactatagccaaagccgtcgtgttagcattgcaatgggaatgccaaagggttctgcaaagaacgacactgagcttctggaccttgagacaaaacatcaggtcctgtcaatgtacttgtggttgtcacaccattttgaggaagatcattttcctcatgtgcagaaagctgaggaaatgtcaataaatattgcagatttacttgctaagtcacttgccaaagcaagctggaagcctacatcaagacaacaagcaaaaccaagacgagaaaatgaagaagacaacgatgtggagcaggcatcagatgataatgcaaagaatgattcagaagatggttatgaaaggtcaatatcacgtataaaaccgttcatgaggtacagcttccaacccatatgtttcacagatatgctgattcagcaaaattacatacattttttttctttcatatagttctcgaacatatggtactttttaaatgcaatagctcaagatatcagatttgtcttcttatatcaacaaaattagtattttaaggagctactgcaatgcatctgtggaagtgttttattggacccaagaacatctcctgtaaacgaccacagctattatatgaatctgtgtgatggcaaaattagagcaaaccttgtctatttcatgagcctataacataaagtgttctctttagtctttacttgttgaggatggtaaattggtaaggagtaaggacaactatattttgtatgaagtcaatgggcatgctggtgctgaaaacaggcacttctttcatgttcaaactaaaaatatcattatatgcccactaaatgtgcttagaattaaatttaaatctgtggaaaggggctgtttgatatattataatcctacataaaggttgctagttgctacaaccagaaaaaaaaaaatctcatttgcatattgtgtctgctgacttaaggccatgaagtgctatgaatgtgtttgcttttttttgctcatgataattgccaggaaagttgtagcggtatgtaactgtttgtcaccagttttcaatgctggcagtaacttttgattaaactagtggaactatatggttatatcattccattggaaactccacagtgtttcttcaagtttcatgacctcattcattttgttttggctaaactaaattgaaaattcttaataatctacaagaattttatcactgacattggtcattgatgtttcactgatttgaatgatcgcaccttgtaatgtaacactagatcagcagggtttttttttttttcatattagttaagttcctctgaagattaagtccagctaagtttcctgataatgcagaaatttgcttttcatttgccttttttcaaaggaaaatattttttccaattattatcatatacgtacattgatatgtttgaacgaggtgaaaaggaacatctgcattcttgttctcaaggtttaaaaataccatgttaaaagaagaaaaagaaaaagatcgcagagttgattgcgtggtggggccagattttgcccaagtaatttcgtaaatttagaatgtataaaacaattttcatttagaatgtatataacaattttcaattagaatgtagtttcagatacagttatgatggtattgtttgtttccttttgcaggaaaaggctggatagacctagtcaggacccttcttccttgaactttgtggcatgaattacttgtggcctgggtgattaaccccgactgattgcttcatgagatcgtgtgtagccaagtcgttgcagccatttcaacctcccagaactggcagttcatctatcagttctggtgtaggatggttggttatgttggctgaagtttggaattgatcttatcctcaaaatgacactgaagccatccagaggtgtaagctagtatgctttagtggcgccacgggatactttaacttcagttttgtagattatttgcacgagaaggatatatcgacatgaattcatcagaattaagttattagtgttttcctgatatgaacaagggagtaagggactgtggtaataagttagctgggggatatacggtttttttattgggtattcacttagccttggatgtaagggactagaaagtaaacttgttttgtttcagttctgtttgaatcaatggcagcggtataaccttctgcaacgttctcacctgagttttccagtgctcataaaaaaattcttgtgctcagtcagcacacaggtgtaactactgtttctaatcagggatgaacgcgtccatgagcactcatcggcacagtgtaacacgagactagaaaataatatcgcactttgcccgttccataaaaaaacgaacttaatttttcatttggtgcaataaaagggcatctgtttcatgtgttttcaattcctataagattaaagatacatgctactctctcggtccctaaatatttgatgctgttgtcttttttaaacatgtttgaccgttcgtcttattaaaaaaaatttaagatttttttcctatcatttgattcattgttaaatatactactaccactactactcaagtagcttaggataggttagctgttggtgtggtgttgtagttatggttttcgctcagtttcctaattaaccgtgcgctgtaaggtttgatcctgttttctccttaaaatggaatatcttcttcttaatataaaaagtcagcaatggcctgatcgtttgaaaaaaaaagatagaaggtgttgagaggattaaattttaatatatatattttttcatcgatttttgtatatatttacatgcctttgaaatatatttacataaatatacactctccgcgggatagaaacgagccaccgcaccgtcgacgtcacgcggcacaaaaggcgcaggatcgatgggaggggcggtggtgcggcacccacacgcgtgaccgcatgtgtgtaacatggatggattaggtattaataatacaatatatttacaacaaactattatataaatagattattagattgattatcgatgatattttaattaaacttcctcttcagagaaagaaactactatttgtttcaaagggacctagcccataagaaaatgaggcccaacccaacccaactcaaaccggcgaatctctgcgcgcggcccgatataaaagggctcgcaacatacagcacccaccatcccctaacccctgaccacccccccgcctccgcacccgcctccggttgcctcctcccctctcggcgggcggcggcagcagcggcggcagagtcagcagacctcgccgggaagctaaagccctaaagctcgcggaagggtttatcgcaacgggcgatggcggcggcggagcagaaggggaagaagccgaggaccgacggcgcggaggccgagcccgtcgacgccgccctgctgcagtccatcgagaagctccaggagatccaggacgagatcgagaaggtgagtcggcgttggatcctctagcacggcgtggttgctgctgctggggcgtttgtatttttttttagggggctggggttttgggggtttatgggttcgcggagcggtcgcggctcagggggcgcgcgggatttaggagaagttcgactcccgattctgattctgttgtgtttatgatatcgtttcactgcggaacgaacggttgatgaatgattggtttactatggctgggtagacatatggtttgggagatcgggttttcaatttttcggttctctctatggctcaagttgggacataagtgctatgttagatgctagatagcttgtccatgttctctctatggcttgacctgtttggaggcctgatattgtggaattgtgaaagttagcagtagatgttgtgcctgttttgttctgtcagatacttaaaatcagttgactgtgaacccatggccattgaactgtagacgtctagaatagattgtgctacagttaaatgctttatgagcactttgagatgcatgtggagctcattggagagtagttagctgcaaaagttttttcacattcaacttagaggttggaggcttcaaaatgtggtcagaaatgctttaggaaactcgtctgtctttgttcaattcctctggcaatttaaattagttctataatgtaatcgcagaactgtacaagctaaattgggtgctctaatgtccagaaactccacatattctcagacaaagctaataggtgcaaattctcggtttctctggaatgagaaaaattcttgcatgacttggttcatgattacctgatctgcacaacattgcattccagactcccttgtctaccagatattgtgcatcatggattcagcttcgtttcaggctttttatttgacttcataattactccattctattagttttagtatcaggattagtgatttaattgaactaagtgaaaattatcataatcaatgatgcaatctctaaaattgtactgctaacaaagtgttcctttccagaattattgtttgagtacctacaattccaatttcatatgttgattggacctgatacaatcagctggaatgtttagtgggttttgaatgttaggctcttagttcattgcattaactgagttcaggttaatgaggaagcatgtgataaagttctggagttggaacagaaatacaacgaggttcgcagaccagtttatgttcgacggaataaaattatcaagcaaattcctgacttctggctgacagcggtctgtaatatgtttctacaatgatttttatttcatgctctttcggattgaattgttgattgattaaaacctttcatctacttattaattatgctatctactgttcatcttgcagtttcttagccatcctatgcttggtgaactattaactgaagatgatcaaaaggtacctttcttttgtggactactaacattaactttgatatacttttaaatcaaaagtagtatgaggcgtactaaagcaaggaaatattgattttctcagtagtcctatgggaacaatcgacgcacaatgaacacaatgaaatatattactagaactacgtcatgagctttcttattttttattatagattttcaaacacttggagtctatcgacgtggatgactcagaagatatcaaatcaggctactccattactctcgtgagcttctttgcacttgcaagatattatttccttatttcttttaccgtgattacaattgcttgtcattgaactgtagacattctcccccaatccatattttgaagatacaaagcttacaaaaacatattcctttagtgacgatgaagcagtcaaagtaaaggctacctccatcaggtggaagaaaggaatggtatggtacccttttgatcgatctaagtgtttctgttgctatgcttgtgcaaagagaacctattaacctaataacatttttaacatttaaggatattgccaatgatcgtgcgtacacgaagaaaggggacaagcgaatcttaattgatgaaaggttgttatttctatctgtttcacaattttggtcttctcttttctacttggaagttggaagaaatagtagggaccttctataaagtaatcttagcatgctagctttattccttgtttcattcctggtaaacctgctggttatgttgcttgatataattcgataaccgactagcaactgccaaaggcacatgatagcattcttttcactattttgttagctatcatttatatgaactatctgttttttgggtgcggtggaggctttctgccatgtctatatccatttcttacttttatataatattgtgttctttgtttgtcacaactgggttcttggcagttaagttgttaacacgtcttcattttcctttgcagtttctttacttggttcaatagtgaaaagaacagaagttttgctcatggagctatggatgaggtataatcgtcccactggctcgtgctaaaccatgattgtttgaaactttgtttagttgtaaattattcgaagttctatcacaagagttttggaatatcctatgctctgtgaagatgttctctgagaactttatttgcacaggtggcagatgtcatcaaggaagatctgtggcctaatcctttgaagtacttcaacaatgttagtctttctaccgtaataagtggtttgttttatttctgttattcctaaatcctaatatcttgtcctatccgacatctcatttgcaggaatttgaagaagaattagagctactggatgacgatgacgaggtaatcctacctcacatttgtaaatatataaagcgtgatagcttatcagtgtgctcataatggttactcccagtacaacattgcatgtcatcctttcttatgctggtgatattttaacttttcagtaaggttattttagcaatatttttttgcgcttgactggtaggtgaattattactgttgaactttaaccattgtatatctgtatttatcctccactcgcaacatttttaggtatctgatgatgacgatgaggaggaggatgatgaagaccaaggtgaaggagaggaggatggagaggagaactgagctctctgtcatgtcagattcttttggcctggacaacttatgtctgcagaaagcggagaccgggcctcctggagggctgaaacagcagggcgtccccttttgcggcgttgtggtgctcgacttagctggcagtgtagggacttgctccgaaaaactttgttctatggagaaataactcgagttcaatagatgattttgttgcatgcgcgatcgaaatgttgcgtgttgtttggaagtgttatttaccttgccgttggattagtgtttataacgctattatatatagagaatgatcaaattaaattttgcagcctctcacgcgccgactgccagagttaattttccagaatacctgaatctgaatggcacacccttgcctttttgctctgttctgagtttccctgcgcggcgtatctggagcattcagtaggttccattccaagctgaacaatgttaccaggaatgccgtgaatcgggatgccgacggatgacgaatcctctccgaaaatactgtttcttctctttccaacaagatgtcatatgattatattatgttaaaagaaaaacatgtgtttcaaattattagaactcaaagtttcatatgtgatagtaatatgtttcaatgcaaatctttagcgtgtttcataaaactatctgccactcctctctctcgtctctcttcacctcatccatatatgcatgtatgtatttagtgaccttcaaaacttttttctcctaaactacttatctaatctacgatccgatcccactgttatattcgttgcaattaaatctttagaacaagttatcgtatgattatattctgataaaagaaaaacatatgtttcagtctgttaatacgtaatgtttcatacgtgataagtacatgtttttaacatgtgtctccactgtgtttcagtgattaaagttttttgtttcgtttcactagtgatcaactacaacatttaaccgaccgatatttttttaaaagaagatagggcgccccattcaaggaattcttcccaacgctacgtgagaatgtgagatgggcggttttgtccctaaattttttgctggaagcagttgaattcaggcggccgcgtgagatgggccgctcgcttcgccggcccgtccgggcctccgagcgtccccgctcgtcgcctcgtcccctgcctgcgccgcagtggagcaaccggcactaccgaaccgctcggcgtagcatccacgcagcgcaggggaaggaaagccgaagcgcggccgccgcgcgtgagatcgacgcgcggcgacttcgccaaccttccctataaagcgctgccccaatcgccaagcccaccgacctcctcctcctctccagtctccaccaccgacttcttcgtttgatctcgggctccggaggaccggaggatgtccggcgagagatgcgccgggcggccgctgttcggcggcgccatctccagtaccttccccgtccggttccaggtactccctcgcctcccccaccatcctccttgcgaggcggcggcttctcgttccttcacgctgtactgcgcttaccccccccccccccc

SEQ ID NO: 60912 - DNA, 553 bp, Oryza sativa
caccagaacaactaggaacacatgattgaattgcctgatttgctgaaatattcggaacaccatcactaccttcagtttttggttcttgatcgctcagtccaacatctataaccagtttgcattccacaggtttcattgcaacattatctatgtgattgttacattttctttgaggatcctcgttttttgctgaatcgacaatcttgtccaggtaatcttcctctgcagcctcgctgttttcagaagctttctgatcgccgtctttctttaatagtgagagttcttcagggacgttcaaaccagccttggagaagtgcacagcacgcctacgtttttctttcaaggtctcagcctgcagtagaataaatgtctattgaagctttgttttgtacattgagaaaacagcgaatccaagaattatggctatatctactatacttgaccgatagtcccagaagcatggagcagagaatacgcatcatctgaaatcttgtgcttcctgtcatgcaggacaaccatcagaatacactatactatcagtccagacagagta

SEQ ID NO: 60913 - DNA, 607 bp, Oryza sativa
tatttatttcttttatggtagtatagtttttagaagaaaaaataaattagaagtacgattcactttattcgtcttattcgtcttgcttgcatcccgacgcctgttcttgtaccccacttatgaggtcagcaagttgatgaaacctttgtttggtgtaacaagctagctcagtcaaagttttttgttcaagtcgaagtcaaccggccagttcgtttgatacacattctcagagatagacgcctcagctcgcaaaatagagacgggaagaacagagtaatgatgcaatctgcttgactctcgggtgttccataggtgagatatttctgaccatcgatgcaatttatgtagacatttctgtggacatgcatggctgcttttccatcggtacctagtccatcaattccctttatatacatatacagtacaggtccatggaattggacgatacatacgtacatacagtacttgcaaggtttgtgagagcaaataatccatacatttctgattcaacacgaaataaaataatattatattaagtaaggacaaagaaaactagtggaggagccacgcacaaactatgggtttggctgaccccacaatttttgta

SEQ ID NO: 60914 - DNA, 2233 bp, Oryza sativa
agatgcagcagccaatatgttcagttgtggaacttgtttgcaaatcctcctagactagcgacttctgagtttatgataaaattgactttgatgggctttatctggcatcaaacagttggtttattttcatatttaattgtcaactttaagttagaaatttcatctggctgttgcatgatttgttttgcttattaatttttttctgtgaaagaatgttattgaatatgttcagcttactgtcagcaccgaaatgtgaccatgtcttgagatatctgttttagttctctttttcatgtgatattaatgacaaatcagtaccttagcgtaacaaaattgcaatgttgtgttcagtcttgaaatgatgagcacatcaattttggtacactaattttgtgttttgctttcagggaggttgaataagtgcctgtcctgcccttctctacttgatttggatgcagtacattctactgtaccaagaataatgccttgggacttcccatgtaaattatcagaaacaatatacatggaaatagacaaaacaatcgtgacagctgaacaaaagaaaaaacagatggaagtatcagaatttgaaggcctcgaattacaaataatgacacctttgaccaagggaagaagtgctggtaaaacaagaaaacctaagaaatccaagttaaagcatggccgctctgctgattgtaatgatgcttcaccttgtaagaatgaccttgacgatttccatgatagtccagatatccctcttccatccaatcatcaaagaatgagaaataggcgtggagtagttttgtttgctgagtctgatgatgatctagctgatgcacatgctgccaaagatgccacatttactgttcaagaaggtagattgctcccacaatcttcagagctgccctgtttatatggccatgggatttccaacattgttccagaaagtgttttcttccaacaatcatctgtgcctcatttacatagggaagtgatttcaaatcaattatgctttcctagcgaatcaagggcctttgaacctgccagttctttccaaaaccagcttgaaagcaacatgcccgggtccatttcacaaatatgtgatacctttatgtctcagggcatttcatgtgtgcctgagtcatcgttcatggttggggggacatctgcatcaatcagcagtgatgatcttttatcaagtctagtgtccaatggtttgtctgcccttcgtaatgagagtacttacactgcatctgtagtggcactagaagacactaacaaggtggagaatcaaatgactgataaacctcaaaaatgcatggaagatgaagttggtgagacttgtgaggcttatgtggaattggctgacaggaatgatcatgcaagctgttcaattacaggatatcaattgatggatgaatgcagtcgtgctgaaagtgtttggttgctttcagggaaaaaaaacaatgactcctgcaaggtcgaacatgtacaagatacttggaacaggctacggcagtgccatcctgtacttccatgtgacatgaatcacaacagatcagtttctggagctttgaagcgtgtttcaagagtgtctgatttaatatcagaatcagatcttatgctcattagctgccacccttttagtaatgtcagtgtatttttgtctcttttgagattcatgtttctgtaatatggtattgaagtatttataattttgtgcaggatatttcagatccatctttgactccttacactgagtctgatggcttctcgtacagcaagcagcttgagatgggatctatctatgctcagcatggtctttgcatttttctacaggattcccaagctacagatgatggttttgttgattttttacaagagttgttatttagcggtacaactaccacatctttgggtaaatttgttagctctggaatcagctgtggtgatggatctgggaacatttcccatgtaaaatacccaacaagttgtatttctaagagaaggtaagcattacagtgtgtttgcggtgcattttattgcttatgactgatatcatatgacgagctcaaaaaatatatatacacatgatggactatcttccttatagttggagctccatgttgatcccttagctatgcttgatttatcgcatcaaccaggagtatgagtagagtggattattttattggtcacagtaatttctgcagcttgcttcaatatagggtca

SEQ ID NO: 60915 - DNA, 675 bp, Oryza sativa
tggcacgcattatattctctcctctgatctcctcgctgagtctcgctacaagaaagaaaaccccaaatactcaagccgcgtaaaaacgtcgcgcttagctggaacccaccctcttacagcgaggacacttacctacgtggagcaccgtctcgtcgtgacagctacacttccgcaccgctccaggcactactgctactgctcgtctcggtctcgctccctttctttccatcgagagggcgacgtagggtgttttttttttccgatcccactttaccataattaaggttacgtaaatggtgagagtaacaaaagtgtgacgaataaattattattggctataaagtatgataaaattgataaaagacttaatctacgatacatggaacatgtattgaaaaaatatgctgtcataatgataacagtggaccaaacacgtatactttgtatccttttgcgatgtactaaaccctgtattgcataataaagttgtttaagttattaaaaaaaccaaacacatatttaacagtcacatgcaaaatatggttgagaatcaaacacaccccctaatataaggatgtctcctacttacctttttttaagctgctatccttttgtcatactacgtactaaatagtattttaaaaaagttatatataagtttttttaattaaataa

SEQ ID NO: 60916 - DNA, 8856 bp, Oryza sativa
ttttttatctggctgaaccaggtattggaatgggctgggctggaattgaactctagtttggaccaattttatccaaatagactccgaagtctaattctattgttcttactactggactacggctcccatcggatggcctaatcaaccaaagaaaaagctcaaatttaaattttcaaatttaattttgagattgattttgagatattttcaacgtagtttctttttcagcattggtttttaagtcacaaagaacacatatataaaagttttacctataaatttatttttaggggaaaagccaaacgatggtgcctgtacggttggttatgtagcaacaaacagctgataaaaataaggaaacgttagtttttttataaacttctttcttctaattcattttctaaatcatataactacatattctcaaaatttagctgagaatctaggcgagctgaagattttgaactagacctacagcacatgctctagctaaggcgtcacatcaaaggaagaatttacacgaagattatattattttttttagaatatcatataaaattcgtgcgtaacaatgaattcttcaaactggacttcagacttttttatcgataaactgtaaaaagaaaaaactcaaactagtgttagtctgttagatatgggtccttctcaggtttcccttaccgtcggtaaccgcggggtacgataatggttactagcggtagagtttggggaatttttttaccaaattcaaagtttttttaaaaaaacatgaatgtagttcttgatttttagtggcaggtggtgaagaatttttatttttgaaaaagagtaatataaaatcaaatttgagggaaaaactaataataaattaggaaatggaaataacaaaaactattggtacttaagttgcactgtgcaactagtccgttaagacccgttagagaaaaatatctccataatataggaaatgtcatgccgaatttttatattttacatttaaacgttaggtttgcagttatcctatatattattctaactatccctaatctatacatttaagtagttttccaaaaaaaaaagcattgttctgtgttcagctacacaattaatgttaccacacaagtatcgcagttaccgcatcaaaccatgcagtaatcgtgaccaaaccaccgttttttaattcaaatgtttaccggcaaaaatcacacggttttcaacggttagcgcggtaaccgtcttactgcagaaggcgtgcgccaactccctccaaacagtaaggggaaccgaaaccctggtccttctaaccaactctatacaattgtactatcaaaatattttactcacttgacccacggataccagtttccactgtaaaactggcaagcattttagataatcttttgagtgatccataaattgaaacaaaagaatatatcagtttaactgatttcacatcggacaccttgacgattgggtgttgtttgaatttgacaaaagacgtgaagaattctcatcaataaaaggtagttcatgaccactcgctctccaggaacaggagtccaggtcgaactaaaaaggagactgcacggtgttctttcctaaacgttaacaatgacattgcaaacataaacataatctcaccaatatagtaattgcaagttgaacagtacacacagctcaccttgttacagcttccggtacccagcagcacagctcgcgctgtcacctaacatcaggcaaggggctcgtcacgtatagggtgtgtttacttcatgaaaaaagttataagtttaaagaaagttaggagtttgtaaaaaaagttaaaattttatatgtgtagaaaagtttttatgtaatatgatgtgatacaaagttaggaatagggggcaaactaaacacggccatattactccaatttagttgcagctttcagtaccagcagcacaggttgcacagctcacttctgtcaccctaccatcatgcaaatcgcaaaggttctgatttctcaaggtttaccaacctgccatctcccatgagctgttttccgacgagtacggaagtacgggctgccgcgggctgcgacgtgcacccgttagatgggctcgacgtgcccatgtatcccccggctcgcgacgccgccgcggcccacccacgattcgcaggggcggaaatccacacggaaaaccccgtcaaaataggcccatccgccgagacgatcatgcaggcgaggcgacgaccaccccccacccccacgccgctgccgcgtgccgccgcgctttttatacgagttccagctccgccgcgagtccgcgactgctgctgctactgctactaccctagcctagtagtagtactactactgctacttcttccccggtcgcggccgcctgcctgcctgacatcgcttcgcgtgccaaagccgacgcgcgcaaaagcaaccaaaagcgaaagcaagaccaccgcctgcttgctgctcggtctctcactctcacggtctcacctcctcctcctcctcaaagccagccattcgtctcctcgtctcgtttcgtttcgcttcatctcgtcatcgatgcgctcccctagaatgagagaaacctaggactagtactgcgtcaccatagaaggcgaatcactactctgccccggatcgaccacccacgccgccgtgattgggagaggagacggacgcgcatgccgccgcagcagggggagtgctgccgccacggctggctcggcgtgggggaggccgcggtgggcggcggcggggaggaccgttctacgtgccgtgccaagcggctgtcggtggacggcaaggcatccacggcgccgcggatatgcatctgggagtgcgacggcgaggccggggacatcacctgcgacatcgtcgccgcgccgctccgccgcagctgcagcgccaaggcaatgccgccgccggccccgctcttccggatgatgacgccgccgccgccgaggccgcagagaggggacggggaggaggccaggaggcccggggaggccatccgcaaggggcaccggagctacagcctcatgctcaacctgcagcttggcataaggtgataccaattgctccatccctttctgctcctcctcctaattcctcaaacactctgtcccaatgtttggtttggttttgttctccgtgctgagctgcagctattcggtggggaagtcgtcggcgctgccgttccagaagctcgccgcgtcggacttcgacccgcgggagaaggtatggacacggttcccgccggaggggtccaagttcacgccgccgcatcactcggtggatttccggtggaaggactactgccctgccgtcttcaggtgccacattgcgtcctaatccatgaactcggagaggaattcgttgatttcttggcttctagagtgatgtgattgttgggcatactgctgctgagtgatgccaggcacctgaggaagctgttcggggtggaccctgcggagtacatgctcgccatctgcggcaacgacacgctccgggagctggcgtccccgggcaagagcgggagctgcttcttcatcacgcaggacgatcggttcatgattaaaaccgtgaaaaagtccgaagtgaaggtcagttcatgttcatctttgagataactaggcagttgtgggcatcctccaccttgtattgtcgtggacttttaaccggctttgcctttagcttccttactggactagtcacgttttaattgcattcttcagttaactttctactagttatgtacctggaagcatcacatcatggtcatttcaaactgcttaaacgatccttttctatttcattttgcaacagatgtctatttcctataccaagatggttagaattattgcatattttattatccacctaaaggagttattccataatataaattataaatccaggttaatacattatctaaaaaaatatgggtcaataatgtaaaggggcacatactagtatcacatggtgagtagtgttgtcttactcgtaaacatattggtccacaggttcttatccggatgttgcggagttactacgaacatgttcgtcagtataagtccactttactaacaaggttttatggcacacattgcattaagcaagctggctgccccaaggtaagcgacaattacatgtggatacataactcattttaactctgttaactgttgttatgtttgaatgtacattatttcctccctaaacttatgtcagcgtatacaactaggtccggttcattataatgggcaatttttgctgttcggaatataagatccataggcgttttgatctgaaaggttcctcacatggtcggactatcgacaaaacagagcgcaagattgatgaaaccactactctcaaggacctcgaccttcagtatgcatttcggttgcagagattttggtacgaggagcttatgaagtgagtttcctgctatgttaacacaaatatattgtctgcaatttcatttgaattgagatactaattgtaggtctgatccttcatgtcacataggcaaattcagatggactgcacattcttggagacacagggcattatggactatagcctattgttaggagttcactttcgtaatgattactcagtgtctaaaataggcatatctcagcacatagctttcccaagtaagttatagcacgggttgctgttggtgtttacaaaatctggcttatgaacccagctgataattcaccagctttgatctaatcttagctgcatccctgatcagaatctactggcaaaagaaaatcatttgaaggtggaagcagtttttgtgagctctgctttgtggaatcaggttgcaaagacagagatttgatagactctcggtaactcctcacttcttacttttcttgtgaccgtttgcggtctaatgtgtgcattccaggaatagttgaaataccttttaagctgttctgtaataatcaatccaaatcagttacagcttggtagatcaccttaaacagaacaatgtgacatctattgcccttttcaggttctagtaatccttcacatattgtcaaatatattttcaatatatttttaattattaaaagctactctgttcttctggtaacttctgactgtagctcattagttgtttgtatgcatcttgacaattttgtagcataagtggagttatttaatctgtcgttgacaagtagttcatgctcctactttagtttgggacataatgctaatctccaccagtgtaaggtactttttttctgttgcatttttctaaggtaattttgtgttttctcatcatgatacctactttgttgctcccttcgtagacaacaacgaagaagcatcatggggccttgcttgtttgtttaagtgaaatgtttatataaagagagtgaataatatatggaactttagttattgcatctcatgatctgaatatcaaatatagaaactttttatccgttgggctaatgcaacctctgccttctcatatcaggaagccattcatccagttgggaattaacatgcctgcccaggcagagcgcagctcaaaaaaaatattagataattttctcctaaatgaaagacacttgttcataaccccaccaagtggaggatcatgtgatgtctacctcttctttgggataatcgacattcttcaggactatgatataacgaagaaattggaacatgcctacaagtccttccaggtcaaccctgactacatttctgctgtagacccaaagctatactcgagaaggtttcaggatttcatccgcagggtgttcataaaagagcagtaagaaaaagtcattgggttcaatggtaactatcccactgacttcttacatcatgagatccattggtgaagtttaggctatgatcgtattgccaatcccgagcatgcctgaaacagtgaaaaccgcaaatgatggttggttttaccatacgcacagtattctgaataattggggtcaacgagctccgccgacacgcatgctaatatcggatggatgggagctaaaactatgtatagctcggccttttggaagacctgtaaaccgtaagtgtcgaactccatgattgcaaagctagttagttcttccataccactttttttcatttcctttttgtgttctttctttggcatctccccaagaatctgaagtttttatttgcttcttggggtgctgtgctgaatagcatgatcttccaatggagtgacccgatggaaatcagctatttgtacatgtacatatttgtcgtgtatcagacaaattattactatttacaaactggtgcatcctgtcaaaatctaaaaaagaacgaggatgtccatcttgccttcgataatatttgcatcctaccttttgcttgcagatgacaatttccttggcagagctgtatggctgggttttcaagtaatgtcatgttcatagttcagaaaaggaaaagaagttgtttgctgtagacattgttgccttctttgcaagcatttgcagcttatctttcgctcgtgcctgcctggtgtgaccacagtcgagagaaggcagtgtcaatgtgtcacttgtacagttgtagtactcctccaccattggccttgtgaactgaaggtagaaataaagcggaagggaggcgacaggcatcaaaaggagagaaagcaggtgcagggaagatgctgggacagatctggtctgctcctgtgacttgtgtctaaacatttttctctcctgtccttctctctgcattacctggccttttctcggctctactttgtttcccatgccaaggcctctagtccatttctccttctccatcctgtgctctttttttgcatgctttgctttgctttgctttggcctggagtcatgcatgactggtaggagcagaccaggtgagaagaaattcagaaattacggggctgaagtgtgatgcatgctgctttcacgcatgactcatcagatgcagcaatgcatgactgatctgactctattgtggctgtaaaataggatgggtactaattgggtaaatactaaggctctgtttagatctaaagtttggatccaaacttcactccttttccatcacattaatctgttatacacacacaacttttcagtcacatcatctccaatttcaactaaaatctaaactttgcgctgaactaaacacagcctaagtgattgtttctttttacaattgccattacctgttgatgtggagtatatttggtgcattcacgcctgtgtttctttgtatggtatttcctgtctcagtgtttgttctgtggggctaacggttgatggaccagtgttgatcggctctgagagtctctgagatgagactgtcgccatggtcaaaaagaatttaactcgtatatcaaggttggatctctcttgctcagaaaaaaagcataatctatctttaacctttatgactgcgcatctgctgttactctggagttgaaaacaattcacggtttgggcaagtgctgttaatattttttttcttcaaaaccatagagcgtaattcctccttttcacaatgtaagactttctagcattgcccatattcatatagatattaatggatctagactttctagtattgtccacattcatatagatattatgaaacggagggagtagctttataaactagttaccaaatctctttctacaatggatacatgaagatgacggataagtatgtgcagaaaactactatcagaatttcattgctttatcatatactccatccgtttcatattataagactttctagcattgctcatatttatttagaagttaatgaatctaaatatatatatatatgcctagattcattaacatctatatgaataaaaagtcttacattgtgaaacggaggaagtaggagtatcttagaaactatctagtgtccaagaatatcctttaagataacatgctgatgttttttttaagataatggataatccagccttttcaccacgttaatgtgtctagataggtgtttttttttacaatttattgaatatttttaaattctcaaatatagaaagccctccgaaaacttattttcaaatttaaaccttttactcacagcatcctgcttggcatgacgggataacactgtcatgctataagcaatgggcatgtcactgttctcctgtcattctagtctatctgtcgtgacaaaaccctcgctacgttgttctaattggcttggcaaaaccgtggtcaaattagtttgagttagattgagatagctcactcaaccgtacagttttacaaataaagtttggggcaattgcaaatttaccactactttaaatcgttattgcaaaactgccactagaaaattgcaaaaataccattagaactgtcattcgagtggcatccttgcaatattgaaaaaaccggtggcaaatttgcaaatgccccataaagtttttggaggggttcactggtggagaaaccatctttggtcggtcgaccaaattccacaatagtcccggatgcaataaaaaccgggactaaagatcatttttagtcccggttaaaaaaaattttatctaccaaccgggactaaagatcatttttagtcccggttcaaagaagttggtgggtcgagtcaggctccaattacaaccgggactaaagatctatttttagttctggttgtttatacaaaccgggacaaaaatgaactgccgagccgcgcgcatgccgctaccctctcctcggtacccggtacccctccctttttttctctccttcattaagactccctctcctcttccattgtttcctcggtatcccagcctcctctcgcttcat

SEQ ID NO: 60917 - DNA, 3483 bp, Oryza sativa
acgggggacggcggccgtccgggacccggtcgggcggcgacgcccgtgcggcggtgtcggagcgaggcggccgcgcggcaggcggccgtgcggcggccggtggggccgcgcccctcgacagcgggcaggcggccggcggggccgcaggtggcgaccggtggggctgcgcccagcaacggcgggcagggggccgacggcagcggcagcccgtattgttttttttaattatttgtgatttcactgatgtacttttggatggataattttgtgattcgttgcacatttgtatggatctgtgatgtatttgatttgtttgtaatttttataggatttgtgatgtatttgatttatgtgtataagtaactttgatttgtgatgtagatttgagatgttactttgatttctggattgggggtttgatttgggatatgtatcccatttgatttgggagaaaataaaaaagaaaaaaaaaaaaaaggggaccatctcactgccgcaaccctctctttagtcccggttgataacaccaaccgggactaaagatcccctctctttagtcccggttggtgttactaaccgggactaaagatcgatttttagtcccgggtatttgaaccgggactaaagatagcgatctttagtcccggattggtagtcccggtttgaaaaccaggactatagggggttgcgaaccgggactaaaaagcacttctccaccagtggttatttttaaaaattatttttaaaaaagaggtttagatttattttaaaaaaactgtagggttaagggcttcctcacccttttttatcttagtgcttgtcttagattatgggccttagtccaacctatatttttaaaaataatgtttgttaatttcttggaatttggttgtctcaggtttactagacctaacatgatccaagtttgatgaaacgaattgtacaacaagcaatatcgtctgaactactacgggtgacaagcgatcgtggaaaaataaatgaagcaacaaaaaattatttataggtaagaattttatatttgttttcttaatacagaggggaacatcagtaaagggaaagaaaaccatagcctgaactcaaatagtcttaggccctatttggcacatctccagttctagctccacctattctgtagctggagcccaaccaaatagttttaacttcaccttaaacgggagtaaagctgggtgagacgctctcacaaaaatgatctataggagcggagctaggggttaggctgctccacaaccacaactacattttagactcaactctttaagctaaatttaggagtaagctaaatttaggagttggagttataccaaacaagtccttacaattacacctcgtaacgaccccaccttacttagtaaggaccggtgacctagcgagcaaatcacggagcgtagaagcttagccaaacaccaaagtgcaattcacggagcaaatcactttttatatttttgttattggaggttttggaggtttagaaaccaatattggaaaaatataatgtgatgaagaagtccaaaattaacactaaaaattaagtttgtaccgtctgagcttgatgcatcacggcatgctttccatgtggatgacatccgaaagttttttaacagtcataggtctttgatgcgtggagaatcgtaatgtgtgggacgcgctgtcaatgataccaaggcatgctaaactaatattttggtatagatagaacattttggaaatcttctgcaaccagtcatgtataagggttccgttatacttactccctctttctcacaaaccaatctcgtacaaaatgtcacacaaaccaatctcgtacaaaatataatatattttagtataacaaatctactccagagaagacataaggatgtccggtgtccaaattcatcgtacgagaatgtatcccatcttatacgagattgatttattttgtaacggagggagcagaaattatcagtagcatataagtattgaagaatggactattgttttgtactttcgtatcaccacacttactccgcaggtttagaaattctcccgttaataaataaaacaaaacataaactgcaaagatgattttgttcaaaatacgattggaaacaaaagttaaagttgtatatggaatccaattatattttaaaactattgtatagaaatagtacaatatatctatgaaaatactccctttgtactaataaaggaagtcgtttaggataatatttaagtcaaaccttggaaatataaatcatgaataactcttaagttgttgagtttaaaaatataaaaattatatgtatagatttgtcttggaaaatactttcataaaagtatacatatagcacttttcaataaatatttttatagaaataaaaagtcaaagttgtgttttggaaatcgtgtcgttgttctaaacgacttcctttacaagtatagagggagtatatggtaagagctgtggaccattttaacttttaaatctacaatatataagttttaagtatatttatagaatcaaaacataataataaaatttgtatatcaaattcaattatgcttttacttggacaatccgctagttactttaaacacagatgacgtgtttgagtcggtttttaagtttattcgcttttggaaatacaaatccgtgtttgagtcatgttttaaattaatttgcttttataaatacataagaagtcatatacaaaatttttaattaaaaaatttttgcatactaacttgttatgatcgaacttctaattgtagttcatgattttattaaaaaatatatattcaagcaaattctaatattaaattttatcttaactaaactatataacaataataatattaaaataaccttcatctattacaacacgtaaaggaaagaaataaaaggaagaaaaatttgaccccagcgcccaaatctcacccgacccgacccaactctggtcttaactccgacgcccgaactcctaaacccaccccgtgcccccgccgtcgtcgccgccgccgccgcagcagcagccttcctccaaatccgcgcgcctcctccggccatggccacagccagcgacggcagcggcagcggcggcgagcagcggcgcctcctctccatccccaaggagggcgagcgcatcatcgcgccgacgcgccgccccgacggcacgctccgcaaggccatccgcatccgcgccggctacgtcccccaggaggaggtcgccatctaccagtccaagggcgcccaggtgagtccacgccccgccccgccccaatcatccccacactttgctctccaactgaagaccgcctctcatggtgcctgctttgttgcagatgaggaagtcggggcccgacgtgccgccgggctacgacccggcgctcgatgctaagcccaagacgaaggcggccaagcggaacgagcggcgtaaggagaaacggcagcagatacggccg

SEQ ID NO: 60918 - DNA, 1803 bp, Oryza sativa
taataggggcgctggagcttcaattgccacggacttgggcgtttccttcgccgggagcacgggagcagcggcgggggcgggcagggagggcggctcctcttcggcggcaacctcgcggcggacaggagagtccctcgcggggggttcctcgcgcggcttgggggtggaggcggaggaggagaaggaggagcggccggccttgtgcgcctcccagtcagcgacggggacggcgaagtcgtcgacgccggagaggccgaggctggagcagagcagctgcacgtccctgcacccgtcgccgctcccgccgatccggaagctcgtgaggtcgagggagcacgccggggagcaggcgagcgacggcgacccggacgcaggcgcggacgcggcgggcggggactgcgggtaggcgcagaagttcgaggcgtcgtatccgatgtgcttcgcggcgttccggcgttcgagccggcggcgccgcctcgacgagcccccagacgacgacgacggcgacggcggcgcggcgggcggccccatcgtcggcctcagctcatggacgagagagagaggggaaggatggttcgtgataagtgccaagcgagcgagactcctcttggcttggctttgggtttgggggagaagaggagagaagagaagggaagacggcaagctgcagatttttattttttttctccgtttcgcccactagctttggcgctgaggttttgcgagtattttttgggtgggtggggggcggagagggggagatcggatggcgctgtcgcattgacccgcatcttttctggtgcgcgcgcgcgctcgcaaccgcggacagatcggccccacgcgcgagcttggcgcggcaccgcagccgcggctttttgcgcttttcgtgcgttttttcttgggtccgggcggcccggaatggctgcggtgttggcgtgcgctcttcttctactctatccctggatcctataaaaaaaattaacttaagcgtcagatgtgacatcttctaagagcatgtataatagcagattattagtcagctataaacatattttaataagataaaagatgagagagaagagcagcgggttatatatctgtagccagctgcaacacggactccaagacgcaatgtatgtatgacaggtgggaccatatattaatagtgggctatactattaaacttgctctaataacgaatctgaacatatatttatctagattcactctcctaggatacgtgacatctaatcctagattattatttttttggacggagggagtactctctactatagtgagtttgagctggaacagtccggtcgtcggggactcggggtgtttgggcacgtgcctgcgtgttcttgccaaagtgaaacaacccaatggtatttcattacgtgttagcgtatgagcgtagttagtcgtatacatgcggggcagatatgcacatagcggacgatttttcaccttgaaattgcagacgctttatgctttaacaccgagtttcggttctgccaaatttactggatccggatcctctgcattttgaaatgctaaagcaaggttccacggtgttttatagtagtacttgggcagtaagatgaaaaatcaaatcaatataggtcgtgtttagttccaaaataattcttcaaactttcaacttttccatcagatcacaattttcctacacacataaacttccaaatttttcgtcacattgttccaatttcaactaaaatttcaattttggtgtgaactaaacacaaccatagtattgtagcatcaatattttaccttacg

SEQ ID NO: 60919 - DNA, 1110 bp, Oryza sativa
tgaaataccctagattctttttttaagcactaaatagtgaataccatggtgtttggcagttattttttaaaaaaatatttgttatacaaatctaaaattacataagaatatttttttgtcctacattgggatttattaacaacattactcttttaaacatagataatttattcaattggatttatcagtttgaggggttttttattccgataaattttcgttaccgtattcgcgccggttcgttttcgctccgttttcggtttcgataatattcgattccgttttcgtttccggtgtttccgattccgattccgattccgattccgaaaaaaatatgaaaacgaaaacgataaagatggattccgtccgtttccgtaccgttttcacccctaactccctccatcctaaaataagtgcagttttgcactatttacgttcaacgtttgaccgttcgtcttatttaaatttttttattattagtattttaattgctattagatgataaaacataaatagtactttatgtgtgactaaatattttcaaatttttcgcaaatttttcaaataagactgacggttaaacgttggacacggatatccacggttgtacttattttgggacggaggcttaacaacacacttatatgattgtggcaacctttgaaaatctgttagttagtgcgagggcattgaattgattaactgatcacttacaatgctcattccctctagaactttgaaaattgatcaattagctagggccccttggaatgaataattgacacaaaaattttaaaagaacacggccctgtttgagattgtttttccaccaaattgttgacgcagtcacacagattgtcttgattagcatgataaattaatatttttgagatataattaaacttcgcaaatactacgttagaatatatggtccgatgaatatggtagaagaatttttttagacattgtattagtagaagtgtagaacaataatctgtggcaaaaatttgggggaaactatgaaaataatagggccataattgtaagataatttgtttctaatggacccctttattcactaaaaagggaaaaaattgggtaagattacat

SEQ ID NO: 60920 - DNA, 6353 bp, Oryza sativa
aatcgctccatgttttgataatatgttgctacagtaaacatttgctaatgacggattaattaggcttaataaattcgtcttgcggtttactgacggattctgtaattagttttttattagtgccaaacaccccatgcgacatcctatataatattcgatgtgacacgctaaaactttacacctctggatctaaacatcccaacatgtactgtcatatagacagtcccaaacattaggggcccttggaggcctctataataagcttagtcgcgcgtccgtgcaatggatgatgtttgcctataatatttgttcatgtgcatagtccatatatggaatgggggtaggcaatgcccctgggttcaaggatacaacgcctgtagtattccacgtcgatgatagagtggttttgtaagccgcccaggacaccaacttgcattatatgtcagccgaatcaattcaacgtgctcttcctactcaaactacgggtgtgttttgtttcttaaaaaagttaaaatttgaagaaagttagaagtttaaaaaaaaagttaaaagttcatgtgtgtagaaaattttttgatgtgatataatatgatggaaagttggaaaagggagaaactaaacacatactcctacgactgcctactcctgccaaaaggaattaaggtggtgtttggatcagagacttaattttagtctctgtatttatatattaatttagagcattaaatatagactacttacaaaactaattacataaatgaaagctaatttgtgagataaattttttaagcctaattacttcataattagataatgtttactgtagcatcacataggctaatcatagattaattaggctcaatagatttgtctcgcgaattagtccaaggttatggatgtgttttattaatagtctacgtttaatatttataattagtatccaaacatccgatgcgatagggatttaaaagttttagggcccctttgatttggaggaaaaacataggaatttcagaggatttcaatcctataggaaaattttctatgaagccctttgaaacaaaggattgaatcctaatcctttgaaattcctatggaatagacaaccctatagagattttggaggaaatttaacaagagcttcaacctcttgctaactttcctttgagtctatatctctcatccaattgctgtgtttttcttgtgattcaatcaaacggtaattcctgtgtttttcttgcgttttgcaatcctctgttttacacttacattcatattaaaatcttacttttttttctatccctatattttctcaatcctatgattcaaaatgcccttagtcatctcttatcgcgtcagctggccgtgcggccaatcacacatgtggaaaatatcacgatggagaggagagatggaccagatggctggctaacggacctgccgctcctgctcatattttaaagcacggcccgatgcacgaggcaccgaaccattgaacctgacgacgccaacgtgcttacgtgccaccccgctgcgtccaaacaagtagtagtacgtgccggccggggaccatatatatgccacacggcgagaaggctaccagaagccggcgtgccagggacttgtgtcctggcgcggcccgtctccggcacatacgcacttggctatacttgccatccccccttgttttttttcctcttccaatacaatgtaggaggagtacgtatgggcgtatggcatatgtatcgcgtatcggggtgatccggtgaactgtaccgcgagattgtgcggcgccctgtgttcatcggaaaatcgcgcgcctttccaaagaaagcagaacaattcgataccgtgtgcttgtttgtcgcatgcttttatagttatagtactatttagttcccggcccgcacaagttccgtgcatcgtactagcagtagcaggcaggtgtaaccttgtaaggtgtgtcgattttgtagtacaatttacagcatgcatggacggcgttgacgccagaaaggacagatatatcacgatagcagtgtggtccgagttggttattttcacatttttagcgtgcgggttaagtaattcctccagattcaaatactggattacttgttaacaaaatgtatataaacacctaatatattttatttagaccaatagtatgtttgtatgtaaaaacggatattgattcatgtgctaggccgctagggtggttaactcccggaaggggaccgaggcatacgatagttaggggtctctctgatatgatattatttcggccgaaattttttgtttttaaattttttcgtgaattttggtaatatttgttcaaattcaactaaattctcattaaaatttcggaccaaaatttctaaaatttcggaaatttcggtatttcgatgaggtccgatcaaatcggctaaaccgaaaggtttaaccctgactatagtacgacacatatgcttttcgtttttggggtgagaaggagggtggatgaacgactctacatttaagtattagagaaaagtgtatggctattaatatttaaactttgaacactcgtattattttgaaaattataaattcctaaactttaagtaattgtataagtactcaaacgtatgctatatcaacaaaatatgttgcatccttaatatagtcgtaaaactttattatctaatcattcaaaatttaattactttatcaattgtcaaagttaacaaccgtactagtcacagtaacaaatattttaaaccagtcgagtatattttactatagctagtggacatttccttataattttgtaatacacatatacaatcactctaatgtaagatgaataattgcatagaagtatagaacgtcataaggtaacaaatgaacaccctcgtcaatcatcaatttgtcgcctcacataaaaatagaccgtcaacaaagaaaatccaatatacttacgaaagttaagtatactgttagttttcaaacttatagtgttgtgccatctcagtacttaaagtctaaaaatacaaaactttcctcctaaatttgttaatgtgaaatgcaagatctaagggcatgtacaatatagaccacagacaccagtggtttcaagaaccaaacaaaggtcatactacctacaatggaaactagtacaaaatatattttgcatttcagcccctatatttatatgacaatccttatagtgtatgttagtatcaaacctattaaaaactttatccctataacaaccaaaagaaatacatatgcacccctaaatactatggatccgttgtctgcctcttccccctctcttttttattctctctctctccctagacatctcgtcgccttcttctccacgagaccatcggcgctttcctcccagtccaccctgctggcgagacccctcccctcccagtgacctcgccagcgagaccccttccctcccagtccctcacgccaccgcgagctccccatctcccatctccttctctctagacgagatgagggcgacgagatcggtggtgcttgagctctccggcgatgagagagagttgggcggcggatttgccaatgagcggcgacgcgaccacaacggcggcgacggttcctctccccctcccttctttgcaagcgtcggcgacggtgcttctccggccatgagcttaccggatccggcggtggggagcagcaatggcggcggatctggcaagtggcaacgcgaccacaatggcggcagtgagcggcgacgacgaccatgacgagatggggatttggggtaggtgcacgaggggaccgatcgaatgagacgacgcgcggggctccgactcctctaacgtgagtcttcgagctgtggcttcgcggctctcgagcccaggtgcgacgcttcaagcgttccctctgcaagcgcatttccagcctgcggaaccacgcattcggctgccagctcggcttggctccgacatggagccgtgaaaccacaggacagagtgaagtgttgtacatggcctaatgtggcttaccacctactccctccgtccaaaaaaaaactcaattcctagagtttgaattttatcccacaaaaaacctacttctaccctcctaccttctctcatcacgtaaaacgagaagttttattcctttaataccctttacctacctatcactcttactacttttttcaatgattaagggcattttagtcattctcactctccactaattccatctactaggagtgctaggaattgactctttgtaggatggatggagtagaccatttctcatctcgatctctcctcgctcccatggagcaatagcatcggctaaccaaagtagagtagagcacttcaggaaggcaaaatggttgtcggtagacactgaccatggccctgttttgaagattagcctcaggctaattttgagaactaatgtttagtcttgaattggtaggctaaacattagcctagggtgatatgtttgaatccataggctaattgagggctaaaaggtggagagagagtaaagagagaggagagagagagggagatatggctgctttttgatggtccccacaaaaaattagccccattagcaccccttggaggggctaatgttttgagggggactaattcactttagccccaaattagcctacatgtttgtatccttaagggctaatttagagctaaaaggtgggggctaatttagagctaaaaggtgggggctaataattagccgatgtaaccaaacagggcccatatcgtgcatgacagtaagataagattaccaatggtaaaatgagtcaaagtgggacctagccaaggaaaagtgttttcataaggagatatcttctcgttttgtacgtgtcacctaaatagttatttttaaaaaaaaatcacaagatagattaatataaaatatattacttcacagacatgcaaggccaaatttaattttcaaaaactgtaacaaaaataacaaatataactgcaaacatactataacaattttcagtttaattggttctttttgttgcaacttgtagaaatcgattttggccttacatgtttgtgaagtgatatatttcatattaatttatattattattttttaaaaaaaaattaataactatttagataacatgcaagcaaagagggggcatcctcacgagggatgaaaatccacatctaactagccacagcagtaatcaaaaggtgaatctcttttaaaatattttacaatattttctttttaaaaatattttaaaatattagaggggcttgatatgcatgttaagtttaaagttgggggtgacaccaggtacaagtttaaagacaaacaccgtgctttaatttgattataaagtttcaatgcaagtctatctcctattcacattttaggaggagtgttgaggagaaattctgaaataataaaacccacatcgtagaaacacgatcagacgctggcaaacacgactcgaacaaaatatctagctgtagaaacacgaaatatcccatgaaaaacacaagccagtgtcaaatttaaacgcacaggtccactcacgtccacatgggcgaagccgcaggtacgagctggacagagcctgacccggacggcgacgcaacgagacgacgtagaaccgtacaccccaccgctaaccccttccctccacgtgtcccctcctctcccctaccgacctctacccactcttagtgcacccacaatagttatctataaactctctacaagaaatccatgtcagtatattttcctatttggaaggtattaaatgaagagagagagcaaaactatctactaacttagagatagtctatagagaaaaacaaggcaatgcataagagagctatagatactgacggagcgtggggctcctcaccgggagaccgcgcagacccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtcccccccaaaaaatcatgccttctaagtgggcaaggtcctcttttatatcttaaggggataccacatgcaccatttttccctctctgtggggacttaccctaccttttcataaatggacggagatttgcatggttgccgttcgagtcaccttctgatgggacggcccgcacctacctccactttcgccgggagcaggcgcgacgcgga

SEQ ID NO: 60921 - DNA, 1064 bp, Oryza sativa
ctcccttccatgtcgttttatgtagtagcccatttaccagatttgaaatttatatagtcacaatttagttttagtactgatgtgcaataaggtttataactttttgtctataagaaatttggctcgtctatatttcactcttttcttcataaatcatgaaaaaggtcatttggcatatatctctttcatacatgttcacttttcatacaagtttgcaatacgagaaattttacgatctttacttagaggtggcatattttctaacgtaaagtttggtacctttgtacttgaggttctgacagacaccatttttacactaaaaatggtacttactcatggatcattatataaagagtgaagtatattagcggtctctaaacttctgccggtgtatcatctaggtccccgaacttctaaaatacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacacttctaaacaagttcgagaatccgaaaatgcattttgagagtttctggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagtggttggagggaaaaatagtactgctctttttttggacaaatttgaatagtagaagtgc

SEQ ID NO: 60922 - DNA, 1119 bp, Oryza sativa
cccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacggcgtgggttcggctccccgtcgtcgccactcacactgggagagaggtcggacgcctttgcttgctcagccatgaggctgatcaagaaaaacttgacgcacacggaaaagtgcgagagctcagaaaacacacgctgagccccctacctggcgcgccagatgacggagcgcggcgctcctcaccgggagaccgcacaggccccccctttgccggttcggccgggggctcagggtgagatctcaagctctccgtgtatgcgggaagatcgcgacctcccaaaagagcatgaaacacaagcgatgtatacaggttcaggccgttgagaagcgtaataccctactcctgtgttttggtggatctgtgtatgaaggagctacaaagtgtgagccaacctctccctcgttctaggttctgaatctggaaaagatcatcccctttctctatgggccaggtcctccttttatacttcaaggggataccacatgcacccctctctttccaaactggacttttcttctcttcataaatggacggagatttgcacggtcgtcctccgaacatcctcctgacgggacgacacacacctacctccacttctgcctgaggcgggcacgtcgtgggaaggcggctgtgtgctgacgacatgagcagtgtcagaccggtcacaaatcggtcattcttgtccaccacgcgtcggcttagcaacgtgcatgcttgcccttcttcaaacaacatcttgcttgtaatggttaggatgaagcctggcatatatcgatcggggctaacgtgtcatctctgggatgtaacacgctagctccagccggggacgagtgcctagaagctctcgtcttgacgggatggggcgaagcgtgcgtcagaccgcctgtcaccacctaacccgcgatttgaccggtctgtgactggtcacagaccgg

SEQ ID NO: 60923 - DNA, 682 bp, Oryza sativa
attcctgcagccctatttcttgctgtgccaaaatggctttacaagaattgtttcttttggccctcagaagcaacttccataatacaaagtttttctttttagcaaagcattgttgtaggcaaaattccagcaatagattgaaggttggttaattgcgacatgcttaaacaagtggcttacaacaagaacaggtatggttccagtaagtaaaagtacctaggcaacagaagatttagtacaaacatgtggattcagtaattagcaaacaaataatagttgaggcctgccactaacatactgatgtatgcaactattgcataagcacaactcatttgccattgttatgctttgtggataacaaaaaactggcatactagacatcttaactcgattgaaggtgtactacagttatggatatggagcacctgaacaacctattgaaagagagagagcagaagagagcattttgtgtgtcaacccgcgcgcgcgcgtatgtgtgtgagagagaaagagagcatacggcctccttggagatgatggcgagctcccctggcttaacaccctgcttggcgaactcccgtgccgcatatccctgcaaaatattcagagagaaattaggaacaggaaaaaccgtactttcgacgagatccggaacagaccaagatcaaataaaaggatccaa

SEQ ID NO: 60924 - DNA, 21213 bp, Oryza sativa
tgccctatacatagccagatgagcacatttgtttgccccaaagttaggggacaccaaagttatgtgtcgccgatgcgatgaagactctgcccatccgtcctgacgaaatacagcggactgaaccagcacagatagagatgcaagccgctcaagaagttgaagtgccacccccatcacccacaggaacacaagaccacacgtccatttttcggtggcagaggcagagcatccaagaaccgaataggctgaagactctttcactggcagtagctgaatgtacactagtagcctgtccgatagttactccattagatttggatttgactgtagagaccacagtagatactgacctgtatgagactttcagatacttgatcatgaaggaagtgcagaagcatgctgtcttcatatgacctgttcagcatgttgtggcattcgtaagactgttactggaatgtcctgttcctgtcaggcctagcattgcagttggtagaactgcttgccgaggtgtcactgtgcctgtgtcacatatatactcccgtaaccatttcttttttgtatttttgtccatactttttgtcacaatggacaaagcagggcacaccagggtttcccaaaccgccggggccgaggttaccgcgccccagcggtaagcacggttaccgcggtaaccgtgaaaaaccgtgtaaaatccatcaaaaattcaaattattttttaaatttatttgaatttaaggaggttaccgcggtatttacattaccgtatccccgcggtaaggccggtaaccgcggtaaccgcgcggttaccggcggtatggtgaaccctggggcacacacgctagccaaaatttgaattttgagaacttaattttagattttctttttagagttatttcatcgtagtctatttttttttacaatggcttttaaaccgcaaacgagacataagtaaaagttttattcataaattaccttcagttgtttctgtttatctttcacgcattaatctactatgggtgggtcaaatgatgagtcaaaattcaacttttctcttacgtgaaatccacgttcttctaagggtgtgtttagttcacgtcaaaattagaagtttgaaattaaaacgatgtgacagaaaagttagaagtttgtgcgcgtaggaaagttttgatatgataaaaaagttgaaagtttgaataaaatgttgggcactaaacctgacctaagttctgtttgggaatcatggaatcgaaacgtacttaggttgcattctttttaaatgcttgaaatagctaattagtcacacgtaaaacgagaaacgtaattagcatagtataaaacaataaacttaattagcatataattaattaaatattaatatataaaaattttatgaataaatttattatattttttaaacaacatatatataaatagttttcacgtaaaatataccgtttaacagtttgaaaattatgctaccgaaaattgagtagctcagctgaaatagctgccttagggcctgttcactttgatgccattttcaaccttaccaaattttggtaaatttgccaaaaaagtgattacatttagtttgctgtcaaattttggtaactatataagaaatactgccaaaattttggcaagttgccaaaattttggtaattaccaaaatttggtaaggttttttttgcattaaagcgaacatgcccttagagcacctttaatagtatagccaactactacctcggaatcacctatagtcaatttaatagccaattcatacaatatttacctacaaacatatactacactttaatatctgatcccacctgtcatacacgtattgtgtcttggagtctgtgctgcagttggctacaaatctgtagcccgctgctctcctctctcctctcctatctccttaaaatatgtttatagctggcttatagcctgttattgtacctgctcttaggttctgttcgttgctggaggttcccaaccagaacagtgtgcacgcaaaacggagtgatccattagcgtgtgattaattaagtattagctatttttttttcaaaaatggattaatatgatttttaagcaactttcatatagaaacatttaaaaaaaacactttttagcggtttgagaagcgtgcgtgcggaaaacgaggcaaatggagctgggaacgagcacttacgaacagagagcatctgtcggtgctggaaacttcttttgaaaagaaaaaaaaaaactcaaaccgaaactaattcccaactcatcctaaccgtccgatcgtaacgccccgagatggaatccaacttgctttggggcgaagcaaacctccctcgcgactttctccctcccctccccacggacaaagaacccagctccacccagaaacaaacacggacctccggacccaccccatccaccgtacacgtgtccacatctacggcccagatccctccaaaagtggagcaggttcgggctaaggctacgcgtcgccgccgcggccgcctccacctcatcatctcccacctctcgccgtcgccgccgctgctatttagatcgaatcgaatcgaatcccacgcggcgcggagccctccacttgcgctgctgctgctgcgagagatcgatcgagaaggcgcgaaccattctcccccctctcggatcggcgggtcgaattggggcggaggagatgctggacgccttcttcaagggcgccggtggcggcggcggcgggttccgcggcgcaaagtggtgagggtttctttgaggggatcttgggtggattcgtttcttgctgaggtttcttttgatttgtttttgattcgatttgtttttttttggtgatggtgggtgtgagtagcaagacgctgctgaagctgtcgatcccgcggatcaagctgctgcggaacaggcgggagctgcagctgcggcagatgcggcgggacatcgccaagctgctcgaggccggccaggaggccaccgcgcgaatcagggtaaggaggagcggggtggattggctgggatgtggatttggggctgatttgctttctggtcgcttacttcgtggtgcaggtggagcacatcatccgggaggagaacatgatggccgcgcaggagattcttgagctcttctgcgagctcatcgccgtccgcttgcccatcatcgagacgcaaaagttcgtcatgttcttcttcacatcattccattgcagtagaattcactagtttatgtgatggtcatagtatggactgttatctgcataatctcatctagataaggccgattttccgacgacatatggcagagtttatggctgcacgaagatattcacttgcacatttctggttcagaaactcaaaagatgttgattaactgcataatgttagttcaccgctaaaacagattatggatgcttttgttattatttcctagctcattcatttggtatgatgatgcatatttggtacagactactcctaagcatcactttgtttacatccaatttcctaatacaagagagagaattttgattattacaccctctgcatgctggtatatggtagttgtctatctctgcacttgttttggtctgaattccctggatagcactaagtacttcttttaataggcattattgatttttttctagtttttttttttaaaaatcaaattcgttcttaaactgtccttctgaacgattgtgtaagacacatcagttacggcttttaggtaacaaaactgttgcaatatttcatcaattggtgggctcaaatgtagtagtgatatcattaatatgtgcatgctacaagatgaatggggctgacttgtgtttcttttcactcctccagggagtgccctatagatctcaaagaagctatatccagcatatgtttcgctgctcccagatgtgcagatctgcctgaacttatgcaagttcagatgatgtttgcaactaaatacgggaaagagtttgttgctgcagctacagagttgatgccagattgtggggtcaatcggcaggtcatataatgagttcaactgaaagaaatttaattatgttatttgatcattatgttgttactgaaatagctggaataaatattcctgcagataattgaactactttctatccgtgctcctcctgttgatgtaaagatgaagctgctgaaagagattgctgaggagcatgagattgattgggatccatcagccacagagacagaatatcttaaaccacatgaggatctattggtaaatatttacctaccagaaaccatttgttagctgcttgttttgaatcttacatgtgttctcttttgctagaatggaccaacctacttcaatggttctacacttcctcttccaaaggagaaacatgaggaaacactagctgcaagtgctgccgaacatcctgatgaagactatgagtctgatactggtttagagtcattggatttgcctgaagtcccaaaagcagccattcgcccaccttctgatactccagcaacccctgatattgacacacacgtgcaaagctcccagccaacttctcatgaattctcaaacatgccaagctcccaaccaacttctcatgaattcttaaacatgccaagctcccagccatcttctcatgaattctcaaacattaaaagctcccagacaacttctcatgaattctcaaatgttcaaacctcccagttggcttcgcatgaattctcaaacccaagtgacttggaagagaatccaacagctaatgctgctttcatgactcagccaaaaggttcagaacatattcctacaccattcgctcaaccaagtatgccagtttcacccaatgaaaagaaacattttgttccatttgcctctccaccgccatttgctgttccctctctagtggagaaaaatgagtccattccgtcaccttctccatctcctccggtgaagccaacagatccaggaatgttcaggacgattgatgaagtgaccccacctccaacagctactgattacttgttctcaaaacaaccagaacagttacactcaacctctgctgagaacattgcaaacattgacttggatgatgtactttctgctgcccagacagctgccgaaacagcagagcgagctgcatcagcagcccgtgctgctgcaaaccttgcacaactgcgcatcgcagatctgaagaagaatagtaaggcttatgagaactacagtgacagtgtccgaaaggaaagccatcctcaatccgaagtgacacagaaaccagtatttgatcaccaagattccttttccagtgacacacagggttatgtgccttctcatttgccccagaggtcgccattgatggaggatgatccgtatttctcctatcccaatctgttctcgtcaaaaccttgagggtggaaactcggtgcgacttagtttttcagcatagttcgaagtgccctgcgatgttgcatcttcagccttgtttaatcttgaatttggctgttgccgggatattctgtgtatgctgagttgatacttaaaggggggtactggcggggtactggcgtactgcagttttactaggtcactgcatggcttgttcaatgtctgtaaattgtaaatgtgtgctgcttgtaccaaatttgtgatacattttaccacctccacaagaaatttaaaaaaataaaggtgaacattgttccttgctattctggaatcttggatggtaagtataatgtctagtgttctgtatgtgccgagatgcgagatgtacctaaatgagtattctatcggtaaactctgcatttgtagtgcttgaaccaaatttttgaaagtttgctaatctttactggaaatagaaacttctcaactccgcaagctgtcattcgttaagcaattgtgtatgcctgtcacattcgcatgctttgagatgcattttgagttcttaagttaacaaatttgtgtgaacgactagatgtgcctgtgtgatttgatccactgattaaagctagtgtatacatattcttgtatgacaatgtgcaattagtacagaggttaactcttgacacctccattcctcacaacctgaaacttaggccagaatttcagtcttccgagagaaaaagatgatatggtctcatccagtaactcacaatctgaataagctgcatgtacaggatcactagtacaaagtacagagcacaaagtctgacagcttattgttctttttcaggacataacacattttgggcgtgaaggacagatgaaacagaaacaaatgcccttctcaactctgaggaatatacttatttccaggatggctataaattgggtctagctgcagagcaattccttcagagttcaatgcagggttattagtgtggagcatctgaacatgtatggttttgttgttcctgagctgtactgttctagctagttttgaggtgtttgtcaagcactgaaagtgagagttggatgaaagcaaactgactgatgatcagacaactccagcagatcactgatcagcttgttttcctccaatatctcaccttcagcaaattgacttgtagctacagcctacagataaagaaaagattttcgaagaatacgattgtgtcattcaaagtgaggattagagggaactgaatcacacccatctggaacaaaagatggatggttcagtttcttctaatatctcacattgaatggttacacgtacatactggtaaaaattcagagaggtgcagacattcagtcaaaattcagagagatgatgacattcggtcacccaacgtgaggattggagggaatcaaactagaaactctgtttatctagtttggtttcctccaatatcttagattggctgatgaatttgtttatcctgagttgcagactttacatgtagaactgaagagcacaactgaaggggcagggctgtgtgtttctacagtgtgtgctggtatcttccagcaggaggggtttcctcatttattgtttttcgggttttctcatttattgtttttcttttgacacttcttcacttgtttactatctatagcatgttctgggtttgtcccactgttttaagttatttgatttattttcatttatttctaattctaggctaggttacatatttggtgtataagccaacaacgtaaagcatcttccgttataaaattacttttcaagtagtagtaagataatcccttacaactaggtggcagtgcactaggtgaggaatagcagtgaaggctgaaccatgggatccgtgaataagaaacaagataagttgtttattattattctagtaatggtccctatgtatgtaaacaacgtgtttcaaccatttgagaaaaagttaagcatatgtttaacatgatatttttgggctcccataagggttagtactcatgctaacaacaaagcaacaggaattgagttgtggtccacgtgaatgaagaaataaagcaagttatttattattgtagaagtggtacatacgtattcaagagaagggttcaaccaatggaatgaaaacataggcttgagtgaatggtaatgtgacatttctcggctccaacaagaccttctactatccgtgctctgtcaacattctctatatatcatggaagaggaaaacattgtgtaccatagcttcccattttctcctagctgcttaggttttcgtttatgcccgttgcctctaacacctgtctcacccttgagtccatgaattcgctgtgaaaccaccacctagccaccaccctttggtccactatgggcatcccctctaagccaagggaacctcatgtccgtcctccttattagaaactcatcagagaagatggtgttgtggcttttgctcacgagcttgccaagacaactctggcagcccacacatctccgtgcgaatctaatggaaaaaagggatgtgcttgtgatagatcgagaaagtaggcgaatgtccaatagtaattcccaattctttattggtaaataccttatatgctactaaaatttttaccacgtctttttattaagccactaattaccttactgactcaggagtctaaacaccgcatatctgacattttgttctattaggaatgagcaatgtatcatagtctcaaccaatggttccaaccttcacgttggcaaaagttgttggaactaccatcaaaaccattgttcataaatcattgatacttggggggccactaccaaaaacactttccccacttttctcccccccctctctctctctctctctccatgaaaagatcgttcttccccaccccgtccttatctctctctctcgtagaaacccatctttgcgcccctagcccatcaccgccgtgcctctgcccacctcgtcctcgcctcccttctctctaaccccctcctcacttctcccccatccaaatcaacgaccaaattaaagacaacgatacctcgacgactcttctccagtcattgcttgctctttctctcccgctaatatcctctcattcctagtcggcaccgtcgaccacgtccaggccatggcttggggtgacgagctccatcgttgcatagatcgttggtggctagggttgatgagctttgtggcgacgcagggctgctcaagccgatggatgccatgtacttgctagatcaagccatggccaagtcctcctccgtggcggcaacaactgttcaccagatcaggccatggtcaagtccccctctgtggctgcaacaaccgctcgctggatctggttgactgcggtaacatttcctggttgacggtggtggcatcccttggttagtcagtccatcctcgcacatactcctttatctctctccatatttcttatttggaccacctccttttcatcggggctactcgtggcttgcagaaagcactctagccactcacaaacctcaagcatggtatctgagcctagctgaagcttgaacccacgacctgggtcactgcgttgggcatgcccttagtagtctcacgtctttgggagaaaaggaggttcaaccgctagaacagtaaaaggttacattcaagtgcctacataatgtggtcttttttacaccatttgaatgcctgcttatgttgataaccttctctttataaggacatggaaacaacaacaattttcatcaacaagaagttgtatatatcttcttctctacccatatatgaccatcttaataaaggcaagactcttccttactggttgaatatattggtggagaagaagatggtacaacttcttgttgacggggaaactattgcttcttccctcttcttataatgagaaggttgttaagagcactaggagaccaccactgatgtaagaaaagccaaagcttgtatacattagaatctaatctgtgtttctttcgtgttaggagaactttaaaaaaatctctgatcatgaagattctaaaaaaaataaaagtagcactgaaaactataatggataaatggataaaaggattttgttggaaaaataaaaaaaatatttccggacttggttcggggattttgaacccgacgtgaatcgaacacgcaaccttctgatctggagtcagacgcgctaccattgcgccacggatccggccttgttaagatgttcaatttaacattaattaagcaactaaaaccatcgaaatcagaaatacgccttgtacacgaatagtgagcaacggattttacgccttcagttcgttagacacgggttcttctacgccttcattcaacggaggcgtaatccgccgaagcctccagggtccaagccgagtagtgcaggtgcagccgccgcttaaaccctggtcccccttgtctcccaaaccctctctccttcccctcgcttccgcctccggccgccgccgccgccgccgcgaggccaccgcctgctgctgcagcggcctacccttgcgtcggtgcaagacggcgccctgcggcttcggttgcggggtgggtggtggcgttgcgggaggaggaggagggaggcgggcggggtccaagctgaggcggctcgtgaggtccatggcggtggcgccgccgctgccgccggcaccggcgcggcagctacggcggtggaaggggtcttcgccgcggccgccgccgtggctgtcctctcccttccgccgcacccgctacttgtcgcgcccggccttcgccgcgggaggaaggtagccgtactgtttatttgtgtgtattgcataagcctttttctttgctagtagttgttaagatgttccgtagtgcctaattcgtgatgaaaaataatacttcctccgtttcacaatgtaagtcattatagtatttcccacgttcatattgatgttaataaatctagataaatatatatgtctatattcattaacattaatatgaatgtgggaaatgctagaatgacttacattgtgaaacggagggagtaaatgatgttttggttaatggatgggtgtatgcatatttttcgcatgttctaatgtgatgatttatctagactgtgtaggacttcggatatgtctcctcatttgagctagtgtcgattagcattccttaatccttatatatatttttattttgttttaagagatctaagcattccttatgtagtcacattccacttcttatagccatacaattattactacagaagtacgaattgcccgataatagtaatctgccaaagagtaactaggttctactgtcactatcctgaatgccgcgcttttgccttattacttgatgatttcacattgcttgggatcttgggtgcttctgaactttgcaaatggttctcgttggcaggcaagattattctcctagttcaggcatgggggttagcaaaaccggtgctttcaggcttggattgtatggcaacttaaatgtacaaagtagtgtgcaagaatgggttgatgaaaccaagaggttatttttcctcaggaccacaaacagtgtcagaaacaacatcactaatggcactactcctctgcgggttggaaatctgcgtcatgatccctcagaagatatcaggagttcaaactatccttccttgtataatcaaagagaaagaggaccatctaattcaattgtaaatagacatgtcgatacagatttggctaagcatcgtgtgatgtatcagtcagcacatgctgtgcctgccccattcagtgttgttaataatgatatcaaaccactgaacatgcttgatggctccaaggaggaaattccttggcacgattccgttacgatggaatcttctctgcctaaagtttccaagtcagagaaaactttggtggttgataaagctatcccagacaaaaaggagcacaaacgcattacaaggaaggtgacgccaaatttcccggacaaagcttccttgtccactgagtcaaaaaatgcacggaagttgcttgctaccatctatgacaaagttttggttgtcgacaatgttgagtcagctaggagtgttgttaaattgcttactacaaagtacaaaggctttattcatgcatgtgacacggaggtatttcgccaaaccctgcttgagttctatcatcggtatatcagttttggctatgttatttaggttttccctcataattgtgagagtatcaataagaagtatatttctgataggtgatactatagtatcttgtttggtcatcaattattgctgacctcaagtgtttgttgttagattgtgcctttttttccctatgtatcttctctgaaaatgtaagttgcagagtttacaggagatgtcatgaagaatgtaaaatattaaatgctaatgctaattattggtttcttctagttacatggtttgacatgctcatagtctacttctgtggtagcaagctttgctcagaattatttacagttttattgcgtatcaagctccaaacatacattctaatttaggatagtacaatattatgcaggtggcaaatattgatgtcaaagaagagacgccagttggtcatggagaagtaatatgctttagcatctattcaggaaattctgatggggaggctgattttggaaatggcaaaacatgcatatgggtggatgtgctagatggtggaagggatgttctaatggagtttgctcctttctttgaggacccatctatcaaaaaggttcacttcgattcctcattttataagttatttatcttggagtaaatttattgtggttatcttctccctttatgtgttggatgaaatgtattagtgccatagttcctttttcctcttctattactactataattacattactccttttagattaggccttagttgcagcaaactgcactaaacaccatttcctatcactcgtaaacttatgctaaacattgaaaataactagatatagttcactattttataattatgcatttcacctgattgtcagcaccataaagttgtgggtttataaaaaaaaaatgaaaaacaaaatcctacctggctacctgctaaaccctacccaagagtgataatgtaaatggactaccttaagattgctgttttagacagacccttctgtgctctgacatactgtctttatatgttccatttttccctgcctagaaaaaattcctgtgcgttgcaacgagtgaaggcaacttgcaaataactgaacaaaattaactgtttaaactcggctgtagctaccggtccatcacctaatgaactatgaaatcatgtgggtatgatcgatgaatataattgtaacaaaaaaatgacatcatttctaacatggtgatggtgtttagttttgaagttatggagtgtatttctttcgtgcaatagcgcatgtgtgcttgcgtcgaccaacatgagtcaggtcataaaaaatcttggtatggtagtctatttgatttgtaggaggcttggagtaaatcttagttaatagtgaggacttggactacactaagggaagagccgaaagacacatggtagattgataccgtgtagaaggattgatgtgacatgtgactcattagtggtgtaccaggtccaaaaagtcatgaataaaatatttataaaaatgggaagagatggagaaaaaacatctatttttgaaaatcacaagggaacaactttcacctcagccactgttcacgcgggaactgttcatcaccagagaggtgaagagcttcatggctagcttgggacagtagacccatctgatctaagtaggccatgaattcacgatcggtcaatgcagccacagccggcccaggtagggtcagcaggaaaaagacctggctgggtggagctagaattccctcactcgtgtactgctgtactgaaaaagggcggacgtgcgctgtgtacaaagagtcaaagactaatgcggtaactgagtagaggatggacgaaaattttgagtacaaaatcatcttcaatttttataatataataggtaaagattgaatagattcacattttcgtacccgagccccatatttcctactacttcgcttagaaaaaagaaacatgttttagacattgacacagtccccaaaatacaactttgacaacttatttatgttatagtatatttgtagtatcaattgtatgaccctataaaattgtaatattatgatattctggtcacaaaaactatgttctattacaaaatgctaaaagaacccaatatagttctaatattgtggaagtattttttgagaaaaatctacaagtacaattttcatgtgtccaatctaattagttaaaagatattgataagaacatttttaaagtttgacttcaaacatgtccaaaacgagatgtttttttgtgactggagggggtagtaattttggtgacaaatatacacatatgagtttcatataccaagattaaatattttgaagatattgatggtcaaagttctgattgttcaacttaatgtatgtccaaaacggcatgttttcgtgactggagcccagagggagtatgaaattaatatgctaattagtagattcagtcttcaatcaatctttgaactgtgcagttcggaataaaactacagattggtcattacccatcaattattattatactacgtatttgtttcttcttggcttgtctgaagtgatctgttctttctcctcatcatgtaggtttggcataactatagttttgatatccatgtcattgagaactgtggaatcaaggttgctggatttcatgctgatacgatgcatcttgcacgcctgtgggattcttccaggagaactgatggtggatattcacttgaaggactaacaaatgattacagagtcatggatgctgttttaaaggacatacctaaaactgggaaggtgtcaatgaaaactatctttggccggaaaaaggttagaaaagatggatctgaagggaaaaccatatctatcgagccagtcgaaaagttacaaagggaggatagagagttgtggatttgctattcctcactagattcaatgagtacattgaagctttatgaaagcttgaaaaacaagcttgaagcaaaggaatggattttcgatgattgtcctagaggaacaatgtatgatttctacgaagagtattggcgtccctttggtgctcttcttgtaaagatggaaacagagggagtgcttgttgaccgtgcatacctttcggagattgagaaagctgctgttactgaacgagaattagcagcggataagtttcggaaatgggcatctaagcattgtcctgatgccaagtacatgaatgtgaatagtgataatcaaattcgccaacttttctttggtggcatcgaaaataggtattcctaccaccttgtataatctctttgatgtctgcttgatttgtatatactttatgccaggatatctttttgaatgcatgtcatttagaaaccactgtaaaaggatatcattaatatgtgttaaaaccaataattgcttgctgttcttatatgcattggtctatgcatggtttaaactgggtagcaattgttcttgtgtgtccaacactccaagacatgaataattcttcatatcaacaagtggtggaaaacgagggaatctatctttgcattctatttgtgctaggtatttcctttatgtaatttcaaagaaaaagtagtaactgtgagttattgcttgtgcgtatttcctgtaaaaatgattgttttctttacatttacctgcttatcattgcttatgtataattcttgtcagcttcacaatctttgtcgtagaaataagcctggtgaaacttggccacaaagtaaagcttttaaagtgccaaatgatgaaggcatagctacagagggcaagaagactccaaagtctcgcacaatcaaacttttcactattgtggaagatcttaaacttttcactacagagggcaagaagactacaaagactggctggcttaaagtccggggggaggttttatggagtttggctggtaaaatacccacagatcatatatataaaattgatgatgatggccaagagtttgatgaagatgggagcagtgtggaacttcctgagcaggatatagaagacacttccccatatggaactgcatatgaagcgtttggtggaggaaagaagggaagggaagcatgtcatgccattgctgctctatgtgaagtcttttctattgacaaattgatatccggcttcattgttccattgcaggtgagccaggatcttagtcatgctgattgaagttgccattcttaagacatcactcattgcatgtacttataaatgataatgcaaatcaatttgtgctggtgttatgtgtcctgagtcctgacagctccaatgttctttcacctcacgctcttgaaactttggggcttcagcatgcaccataaatgtggtgatttggtcagcatgcaatttttgtagggagagcatggaattcagttaaatgcattgtcagtccatcaagtttgaaatttggttctttcgattagtgctgtttgatatcttaatttgataatttaatactttgtttataccatgatcacttggtctgttttgattatatattttgaggcttaatggtgctactactgtagtcttggtgctgatccaacttgtgttgtttgtgtgagggacaactatggtgtatacttggtgcatgataccaatagtctcagctaactgcacttaacttctaagttgcacctactgtttgagtcttgactgctctttatccatgatagggagatcgtatatcatgcaaggaagggcgcattcactgttcattaaatatcaatactgaaacaggacgcttgtcagcaagaacaccaaacttacaggtatgcctcttcttttgcatttgttggaatcttgcatcagtacctcacagttcacatttgggttgtcaataagcacatgatgatggtacaccacactattgtcaagtaaaggatgaaaaatatacaaaaggtctgtatgttctttcaagacaaaagtatgttggtgtcggctccttctcactgacttttgcctggtttgagtgtgctctaccactgtgtatgtaagcagtataagactgctgttccacagagtcactatatgagtgtttttcagagtatatgcttgcattcttatttgcatcaacttgccaccgactgctacagaagggagacttggactgcttagcaactaagttgcatatgctatcaatttcgatttttcgtaaagcacaggaactaatgttaccttcaaacttcagcattcaccagttgcaatataaataaaatgctctgtagaagtatgatactccataatcattttattcattcatcaatggatatgagaatgaaaggcaaaacaaacatggcaaattggcaatataaagtaggaatgatgaaatggctcaccggcaaacttattttgtgtagccaacctcaggcatcaggacacacatttgaattattcatttagtcaataagctgtctgctatttcgggatatttgattattaccatgcttcatcatcaagggtatttggacccttgctaaatttgttattacttctgacaaatgcttcagtttttattgttagagtggtgctatatcgattatgtaaattttatttttttttaaccaagtatatcttccttgcagaatcaacctgctcttgaaaaggataggtacaagattcgccatgcttttgtcgcagctccagggaacactcttattgttgctgattatggccaagtatgcttagtggttctcaatagtaagtttttttacttcacttagcagttccacctgataaaaggtctttttttatgtagctggaactgaggatcttggcgcatcttactaattgtaaaagcatgctggaagctttcaaggctggtggtgacttccattctaggacagccatgaatatgtaccagcatgttcgtgatgctgttgaaaaaaagaaagttctgcttgaatggcatcctcaaccaggtcaagacaaacccccagtgccattattgaaggtacttgagtgtcactaacattttctgacagcagcttatctctcgaagttgtacttgatttcatttgaattacgtaagattttggtcctgtttgcttattgtgataagatggaatatgattaccttcatttgtagttcattcagtcaaattttaattattttagttattgagaaatatatctttgttgcatttttttttaaaaaaaaattgaacatgtgaattctgtgacagttgttcctagtggaaagccacataatttgtcggataacatgtctaaattacacaaaaaagtgtcggatttaatttaatcgaaagatacatggataattgataacctcacttgtcatacatttatatgttagggcctcgtgttttctttctgctttgaagaagttggcaagttgcatagagtgcttttatcaattgttattgggcatatatattccatatgtactgatttttttatatatatatctggacccctggtagaatggtataaggctatatactaataggcatggagttaaaaccaaacttgatgtttctatttctattttaggatgcttttggcgctgagaggaggaaggccaaaatgcttaatttctccattgcatatgggaagactgctgttggtctatcttgggattggaaggtatgggcttctatttgtacaggcttgtgcatgcatttatcatcttcccttgttcagtttttcttattgggtttcatcttgtttttgtacacaacatgatatcgcataggagtattattcagtaaaagttttgttacaatcagttccagagttgtagcttaattgtcctagcaggtttctgttagggaagcaagggatacactcaaactttggtatagggatagaaaggaagtttcagcttggcaaaagaagcagaaagcctttgcgcttgaaaagtgcgaagtctacactttgctcgggcgatcacgccaatttcctaatatgactcatgcgggtcctggtcaaaagggtcacgtcgagcgtgctgctataaatgcaccagtgcaggtaattcctattagttatatcacaatggttgttcttgttcagttttgggatgtctaaatcccttttgtgatacacagggcagtgcagcagatgttgctatgtgtgcaatgcttgagatagaaagaaacgctcgccttaaggagcttggttggagactcctattgcaggtttatgacaataacactcctacgtttacaaaagaaagtacttaggctggtatttgaaggcacagacgaaaggggccaccattgtttctttctttcaaagaatttggcgaagcaaagatttacatcatatttaagagctacgttttgtgttctttcagagtattttattttgatccccagaatgaatttgtacattgtcctcaaatgttatgtctgcatctgccaggtgcatgatgaagtgatcttggaagggcctacagaatctgccgaggaggccaaggccatcgttgtggagtgcatgtccaagcctttctatggaaccaacatcctcaaggttgacctagctgtcgacgccaagtacgcgaagagctggtatgctgccaagtagaatccacactcagttcttctgccctatacatagccagatgaacacatttgtctgccccaaagttaggcgacaccaaagttatgtgtcgccgatgcgatgaagactgcccatccatcctgacgaaatacagcggactgagccagcatagataagagatgcaaagccgctcaagcactcgaagtgccacccccatcacccacaggaacacaagatcacacgtccattttttcggtggcagaggcagagcatccaacgagggccgaataggctgaagactctttcactggcagtagctgaatgtacagaagtagcctgtctgatagttagatttggatttgactgtagggaccccagtagatactgacctgtatgagactttcagatacttgggcagtgtttagttcccttcaaactttaaaaaatttcgttacatcaaatgtttggacacatacatgaagcaataagggcttgttcgtttctctaacaaggaggagatgaaattttcgatactcgtgtacgtttttcaaactgttaaacggtatgttttgtgcgaaaactttctatatgaaagttgctctctaaaatgtcggattaatccatttttcaagtttgtagtaattaaaattcaattaatcatatgttattatcatcttgttttgcgtgaaacacttaatcttcatcttcaggagattcaaacactatctaaatatggatgaaaaaaaaccaattgcttagtttgcatataaattgcgagacgaatcttttgagcctaattacgtcatgatttaacaatatgatgctatagtaaacatttggtaatgacggattaattaggcttaataaattcgtctcgcagtttacaggcggaatctgtaatttgttttgtcattagtctacgtttaatacttcaaatgtaccggtttacagtttaaaaatcatgctaacagaaatcgaggagcagctaagttgaaatagttgccttagatctttcccgaaatccatgttcttctaagttctatttgggaattatggaatcaaaacgtacttggaaaaaagtttaatagtattgccaactattgggttcaatagtcaatttaatagccaattcatacaatagttacctataacatatagtacacaattaatacctggtcccacttatcatacacacgtgtatcttggaatctgtgttgtagctggctataaatctgtagcccgctgctcttctctcttcttttatctcattgacatgtgtttatagctggtttatagtctgctattataccagctcttagagcatcggtcggtgatgcaaacttctttaggaaaaaaaaactcaaaccacccatccaccgtacacgtgtccacatctacggcccagatccctccccgaagtggagcaggtgctacgtgtacaccggcagcgacgccgcctccacctcatcatcatctcccacctcccgccgtcgccgctgatgctgctactgctatttagatcgaatccccacgatgcagccttgctctcgagagccaatttcatccgggggggacatgctggacgccctcttcaagggagccggtggcggcggcggcgggttctgcggtgccaagtggtgggggtttctttggggggatcttgggtggattcgtttcttgctgaggtttttctttgggtgaataactaatttagtcccttaagtttcaccaaagactcagtttgatcctgtaagtttcattttatccatatagctgttctaagtatttagtatttgttttggcttaaaatcatcattggactcactaaatatgccatatggctatttctagtcaacaatttggttagaaaatgtcccttttgcccttaatttgtatccaactatacactagaaaaaagaaacccaaaatgaataaacaacattgcatatgtactttccgttatttcaatatgtgtatatgaaacttgagtctaatggctatcgtatacacttgcaagtatataatttattttcgttttacataaattgctatgcattatctataaaaagaattcgttgcattgcatatgtgtataagagaaaaaattgcatgcaatgaattctttttat

SEQ ID NO: 60925 - DNA, 641 bp, Oryza sativa
tagttcggaacaggatttgttttatacctgtcagagagtaacacaaaatgctgattgtcaacgtcttccagtgcatttgccaacaaccttctctctgcatcaaccatggaaatcttaccccataccacctgcaacaaaaagtaaaacaatggcaccatcacctacagcttcaaatcactacgataagctgaaagtaatcttcatttttataatgcaagctgttaatcttcatgagcgccgtaaaattgtataataccttttcactgcgtatgtctcgatcaataaataagggactggcatgttctggtttctcccttgaggcatgaacatatatggtatatcttccctcatgaccctgcggaaacaacaagagaagacatggtgaattagcactcagcaaaaagaggtggcacaagaattaggatatcctttcaatattagtagttctgggcaataaacatatacaaaagaaaagtcagagaaagtgatagtataaatgttgacaaaatgaatgcaattctacataagcttaattatcatgaaaaccccacttctaaatcttgcttcttagctaggtgcaaatgggcatgcccgtaatactaattacagcatcaacttaaaaatttcagtgtgcttcagtc

SEQ ID NO: 60926 - DNA, 15995 bp, Oryza sativa
atttcaagcaacacgcacatttttttagcaagacatatatacacaaaagcttgtcggccgatccagcaaaatatatacacaaaagcactaactagctcctagtagggatgcaagcgggtcgacccacgaatctacttatatgttaaataaagagtaatctgtgggttttcacgttatggctcggcttgccgcgttgtatagatgcaagtgggtcaattaataaacctatttataggtcaaattagtaagtaacccacgagtcaacccgcgggttactcactaattttgcctataaacgggttcgcgggttggcccgcttgcatccttggctcctacggagttagtagtgactcgcccactgaatctctgactgtaaaagggcagggcattagtagaataattaatattactagatccttgtgttgcaatgggctgggacaaaatagaattttgcaacaagtttgatagttgtttttaaggtttaatattatatatttgaattgaattgatgcataagactaccattatccatctttagagcctagtgctgaaaatggtgggaaaaaaacaaatcctgtcataaaatgagaggaatggatagatgaaagttgaaacatactaggtccactggaaataaatcccataggtctgctttgcctttaactgggggtttgttcagcatgtataacacttgacttcctagctggtcacccatttggtaaggacacttcctatcggaataggtcatgatgtaatcagtaccaaaccagggttgaaatgttaaggggtcttaaggatttattctatttccagaggtccaccaggcaaaattattgcacttgcaccagagatgaatgaaatatcgagaatgattatgttcacgcatgtattctttgtgctcacttaactagaaattctcttgtgcctagtagtgttttcctaaaaagttgtcctaaaaggcattgcacacaatttgatggtagcatgtagaatttggggaaatgtggcactcccatgcattaactttttttgtcgccaaccttagtagaagagattagggcatgcatttccatgcaatacaccattaaattatacttgttacaaatttacattgattatttaattaaattttctactagttcaaaaatactgttgcacaggcactagcagtttttttcgccgggccggcgaatagccggccgatgtatattaagagtaagaaagggaatgtacaatatagcgcggtgcgtcaatgcaccaccattacagacataaaaagaaagctaaaatctcacagaatgagttgctacagagtgacacatggggctaacaagacctgcagctatccaagtctcccattcatcccccatggcagaaaagagctggggaatcgttgcctcgatcccttcgaacacccttgcgttttgctttttccaaatcaaccaggttactagcagtacagcggatgtttagatatcactctagctataagcttccccagttttattttattttactccttatgatttatataccaattctatggtggtttctactactagtagaatcaatccagaccttgtatcttttctcatccaatagatcatgttagtttatcttatcacctgaactaccgatagtagaatattttttctactgatagtagaacttataaattaatgacttagacgataatattggtcgtagaatagtaccaaactaccgatagataccaccgtaaaatactcacaattaattatatgtagttagcttctgtaactcaaatcacttcggttatgatgatctatagaagagatatgtgaacttctctacagaactgcaaaataaatatagatagaaaattaggatttatgtcaagtgaatcattttaatgttattttgaagctttgataagtgaattctaagacatatatgatataacaatttctgctttagtgttcgcatctatgaaaatagaccaagtcctagaactagaagagaactctttgcattattcttggaaggccctatatacaattaatcaagaggggcttgcacggtgatgagaactgatgatacttaccgtggttattgttctcttaccatttattcttgccatatacgggttgattgggacaccagtacaccactggtgcaccaccatttggagcatctgccgattggagattttggcaccatcttctttttaatgggaccattctgattcgataccctgcgtatctcaattggattgtgtggtctctccgtccctcctcactcacagtgcgacctgcacatgtaacctttttatcctttgcatgttttcctaagtgattggtgggaaacctcgtaggataagtgtccttaatagtcatttcattggtatatgtagagaactgtagacctataatgtctctcactctcactcgcagggacgcaggcaacatagccttagctaatgatgaaggatttgctggagttagttggtaccactttcacaaatcaagcacatcctcacactgggtcccgaaaattctgcaccggcctctcttagggtttctatcagagcaatgtgttcttttttagtggcagagagtagtgataaggatgatgataactgctagtgggcccccgtgccgctccaggggcaggggcgacacgggcggcgaccaccgccgccttcctccctcctccacctcgccgccgcccgagcagaccgccggaaaccgcgtggctgcgaggaaggcggcggcggggccttccttctccctcgagggcgcgggtcggtgcccacgaccccgaccagttgggggcggcgacggtgcggcggcatcggcgtcggcgtcagggcgttgggctgggcgcgcggaggcgacagggtgcggaacagctgggcggaggcggcttggtgcggaacggcggcggcggcgccggatttggcgtccctcgccagatccggcggtccggtctcctcccgggacgatggtggcacccaaggaggcggggaagggagatgcaggcggcgggaaaggtggagcagcggcaacgcgcgtcgcctctccagatccgggctgggggagtggtcggcgccgaggaggtgcggagaccggcaggcagaggcagcgtcacggtggtcaggcgacaacagcggcggctcgctcccgccgtggtcgcggcgccgccgtcggtgtctgtcaagcgttggtgttggcttcggtaatgctgcggcggcgcgctctagctggtcatcccctgtacctggctggatctggccgtccgcggccggatccatcgcctccacgccgaatggcagctggtcggcgggacggctgcgtgtggacggcaagcgcggcggcggctcgctggcggccagcctcctgctcggcagggggcttctgccggtggtgggtcttgtcgttgttgatgggcggcgatgtgcggatgtggaaatggcaggacgacggcttgtgctggcgtgaagcaggaatggggcttgatgtccgtgacggtgacttcctcattgtcggccgagtgttctccctctcttcggtttccccccttggccggacccttttctagtcatggggaatgctagggggagggcggaggctccggcttgctgtagaagtttgtggcggatagatggcgtttcgagggtggccaagggcccgtcttgccattggttacaatcaaggtatgattgcttctaagacgtcatgaactattctgcggccatcgatgtgggggtgcttgtatgggtgatgtgaagatgctggcgaaagccttgccgtgcttttggcgggttcgacaacgacggcgcccgtgggtgtcgtttccctccttggaggcgttgtcatggcactctttcatatcctcacaaatctctccaggtgaaaaccttgttccgattttcggacgagtggcggcggcgtcacgcgtcgtatcctccttgggggcgtcgcttcggagaagttccaatgcatcgatgactattgatggtccttttcggttcaatagctttcatattttgtgttcggcgaggcttcccttcttgggtccgcttctttcttgtggtgggcgacacgctcttcggttgtttctgctgatgaagtcgaagttgctcactgatggggtgcggcgacgcttggcaacgatgacatgttgcagtctcttccaaggagttctggtgctggccgtgtgaaggaagtggctcctcagtggcttggctgatgtctattgttggatgccggagccgcttttcgctttggcgattttcgtcttcagtgttgttgcggttgtgaagtcggcgctactaggtcgctggggcggctagctcggcaacgataacacctcttctgcgatgtggaagctgttgtgtcgcttttgtgtttagctttgtggcgacgtcctgcgattgggctccgccgtcgttgttagttgtgtagcggtgggtttgtaattaaccgtgcagttgtatgatttttgggcctagttttccttataaactgggccaattcttttcttctaaatataaaagtgtggaactaagttccgccttaggttttaaaaaaaaaagataactgctagtgggtagcatgagaggtggatcgatctgatggaaatagcaaaaggtagagacccggacctggatagattttagtggtccaaacattctctttcagctagcgtatcttttgtgtgtgtgtatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcctgggcaccatggtgccccatatgagtgtcctatatagtaaatttgtatatatatatatatacgtatatatatatacacacatatacatatacatatatatatatatacatatacatatacatatatatatgtatgtatatatatgtatgtgtgtgtgtgtatatatatatatacacacatacacacacacacatatatatatatatatatatatacatacatacatatatatatatatacatacatacatacatatatatatacatacatacatacatatatatatacatacatacatacatacatacatacatacatacatacatacatacatacatacatatacatacatacatacatacatacatatatgtatgtatgtatgtattctattgggcattatgcttttggacagcaaaagattgatgatttattgttattttttgggtagctttactctgataatgcattgctaaagtgctgatggttagtttgcatgcagccgcaaacaaccatatcaaagagagcgatataatgttactgacgagtgttatagaaaggtagcctggcatattctacattagtaggtcttgtgagttgctttttcttgttcaatgaaaagaaatcttacgacatatactacctctatttttttatttgaagttgattaattcaaaataaaactaaatcagaaaaaagccacgaggaaattagccatgcaactacatacatggtaaatcaaatcggtccgctaacgaagatttaatttaggagttggagctctataaaacatgccgtaaggctttgagctacttggcaagttattcagtgcatataaagcattatgtactggctattgctaccatatatcatgtgtgacaggtgggaccaaatattatttatatcttatatatttatagttaactattgtatgtttcaattgactataaatgatttggagctaggtagctatactattcaacttgctcttagtagagattaatgttgaaaaattaaagactttggccctttattaaatgaggtattggatagtaataaaaggacaattggggtaagatagagaaaaaaaatagtacttcctccgtcccacaatacttgtctttctagcattcaaaagttgtcgcaaaatagttatcacttggaagtactacttatcacatcaaccactttcaattcaaatatcttctcattctaccctcaaccaccatctcacatacaactatacattattatctccgtttcaggttataagactttctatcattgcccatattcatatagatgttaatgaatctaggcatcatacatatctagattcattaatatatatatatgaacgtgggcaatgctagaaagtcttataatatgaaatagataaagtatttattaagagatattatagtttttttctcttaaccttagtacatgctaaacaacctaaaatgacatgtattataagacggaggcaggattactactccataagtaaagtgattgatgggacaatcagtattataaaatatttatatttgtagataaattttaaatgttttaagtacttatatttatattttatatttatatttgtggatagaggtagtacctgatttgcacatgtctggttccctgtatagtttgctcgggcctcgggaagacatgctgagtgcctaaggtgagagaatctttactaaggtccagttcaatctgaattgtgccaggtagcctgtcgcatgtggagacagccaacaaggtgatatttatcgatacatgcattacgagtgatcagacagtagaatggacttctcgtctataataaaaacataaactcgtgaacatgaagaatgttgagttgagttcgttcgacggtattctttgggaaatggtttagccaggtctacaggtcattttggtccaaccaaggaagctgtaggagtaataatattttgacaaaatttgttctaggataattagcttatgttcttgctgctggaaactttaaaaacgtgacggggtctaggatactcataaacatagtaatttactgagggatattgtagccattattttattatttatgagcaaatagagggaaccctgaaaaaaagagatgttttttttaatttgcccctcgagacaacaggttgtaatacaattgtgtgtggtttaaatcagacctaaagccatattcccctcccaatgccctcaccgaaacttagaaattggtggtagcgggaatggcggcagccattacaagctattgccacatgaacaaacttgtcttttctaaatattttttactccatttggcttggaaataatataaaatagtagttgtggtgtctcctagcacattaggaggtttttaggtgtcctataaatgtttcacttttttaggtgttcagtagcaaaggaccatatataaactttaaacgtcttgtattaattttttcctcgtatttttagttcaaggatatgctaaagaaattgctcatagtgctagctaatgatgtcccaattaaatcaaatctagatattacataaaatatgttgctaatttctattggaattgtgcttgtggtgagatccaaataatatatcttgtggtgttgttttctcctgaagataaagatgaagatgaagatgaagattaggattaagattaagttttttacctaaaacgaggtagtattaacgtatgatgattgagttttaattattatataaacttaaaaaatagattaatatgatattttagagaaactttcatatagaaagttttttacgaaaaacaccgtttactagtttaaaaaatatgccaaaaaatcttaatcttcatccactctttttggagaaaagaacaggacattgctcctttgcagctgatgcacattgcacagctaggcgcggccgcgcggataccgttctgccctgcaccactaggccggccggcaacatgttcttcgtttctgtgatcgtcgggactcgagaattggattctccctcacattaggcggacgaacaagccatcccgtccatccaaatcgctggatgcgacgctgcttgaccttctcgtcatcattcatcagtgggctgtctaaagcggttttcttcgtggagggctttcccggtgctggctgcctttacctttcatgagacctggacacatcgaccagcaaggtaaaggtacgacaaaaggaggtgagcaacgttcctccactagcccacgtgtcctctcctgtggctcccacgaccggggtaaccgtgtcacgctgtatatatcctttagagcttaggtttgacactttagtgagactacatatagagcaagttagatggtactagaaaagggaattaccgttggttttattttgaggctgtgtttagttcccttcaaacttctaacttttccgtcacatcaaatatttgatatatgtatagagcattaaatatggacaaaaaaaaccaattacacagtttgtatgtaaattgcgagacgaatcttttgagcctaattatgtcatgatttgacaatgtggtgctacagtaaatatttgttaatgatggattaattaggtttaatagattcgtctcgcagagttatagaattggttttattattagtctatatttaatacttctaattagtgtttaaacatccgatgttgctgtatctaaacaggccctaggttacatcgtttctctagggttccctttttcttgggtttctttgccgggtcggccgaaggaaatatcatttttctaggtgtcttttcgttttctgagggggcgctccgttgcactaacctgtgctgctttgaactctgttggctcgtcctatttctatgtgcgtgagctgctgatttctctgctctttataaaagtcgacataggtgatgacggttcatgggatttagagtcgcacgtttgttttttttttttaacaaattggagggtcatgcatacacgatactgacttataaaatagtatacttaagatttgaaggcttaacttcataaggtgcacggacgtgttttgaccatcacacatggactttttgagacgcaaatattacgtatggaactaatattaaataattagaaggggtaaaactttgaacccaaatcgtctaacccaccaccttgtagagctagccgaaagatccctatgcgttttttactttttgagattaaatcctaataaaaatatgagcacatgtgtcaaatttgagacctaaacctaggtgaccttgtggatagattttataatcaaggattatgaacaactgaattatgcccagttgatatccattatattatatatggccttatcgttccgctgattagaggaataggccaaacgacatatttacaaacgaaaaaaaattgaattttttatatatgtgttctcaacgatttaaaagcaaagattgaaaataaatttcgattcaaaatcacaaaatcaactccaaattaagattgaaaatttaaattttgattgataagtataaccatgtataagcgaaacaatgatgcttatattactttgggaatcttgtagttttttaccaagctcttttcacgtggtaatgtcggctgcatgcaatcgcactctcagataccctcttttcgtttggtttcttaaacagagcacttgtatatttgatttactttcttgtgaatttcgtatgaagcacttcctcttcctcaaaatataaccatgtttaggatttaaaatctgtaccacagtaatgttttaggcagtgattccaattcaaagacgaaatatatgcagtttcaatcaatcaagtggttggcagaggaatttaagcaattttagaattcaaaatttgatcattgagtaatcttaatatttgccaaacaatttagaaatgctcatattttaagataaagggatgcttatattttaagataaagtcatgataaagttccatgacgcatttattattctttttctttttaaattggagaggcacttcaaatccaagagaattgctcgtatttacggctactttttttttcagtggtaggcaacgacgtaaccatcatagtgactagtgagatacggtcatttcgttaattttaaaatatattgtgcagtcttttgagatatttataaagatatggtatgtgtgcacgtttgtgaacacctgcgtttgtcttgtatatttttgaaaaatggtactaccgtgcaatggtgctgttggtgcaagcatgacataaaagcacatggcggtgatgagctcgtctcaaggtgcgcaaatgcaaatccatccaacagccaaacctaaagatcagcgtaagcaaatggcccaaagcccatgggcttcgtagagggcgcggcccaatcttgacccattctgctactctaggccctcccagccagagcactagagcagtgcagcgcggcggcgactcggcgccggcgtcgcctccgtggtggagctcgccggcggaggatgcctccaccgtcccccgaccccgctcctcgccgtcctcttctgtcagttcctatatcctatcatccttgtaggttacgattttttttccttccacatttcttcgaattttcttataatcatggtgcttagttagggctcaacacaatgcccatggccgatagacgtttacgcgagcgagcactggagcgcgatcctttctccgttcgtgtgatgaagattgttcgcacactgcacacggcctaagcgatgtcgataaatttctccctttgcacttttgctttgccaatcgtgatttggccaatcggctcgaatcaatgaactaatgtggaatctctaaaaaaagcttgataaattcctccttttgcagttttgccaatcgtgattcggggtcaatcggcccgaatcaatgaactaatgtggaatctctaaaaaagcttgcacgctctggtccttgtggcacgtgagcactcaagcttctcctcatttcaggatgaactccttgagcctccccaggaacatcaccaggataactatcagcttaccctcctcggtccacctgccgacgaacccgtaggaagcatctttgcaagtggcatcaggcttcaacaacttctggcaactgtatcctagtgagtagcctacattgccgaaagcgctgtggaaataaaatggcgttatttctgtttgcttgtaagcaaccaaaaaagaaaaaaaaatgacaggtcgtagatttgatatgttcttgcaaatttaattatgctggttcagtggttcttagtgatcatactaggcaattcggattttcagtgatgtaattttgatgtagccatagtttctgttatgggcagacaaaaaaaaaaggatgtgaacttgcctgattatctcaaaaactatgctgaagatgttgaaatttagtggatcagaagaaattgacttcctttctgttatgcatgccaggaatgtgaacattgctaaacaagaaagcttgttaacggtaaaattcctccacagtgctctgctaatcgagtttgtctttttatctgtcaagggctggttatcagcattggcagtgagaaatgaagcatcggaaggaaggtacctgcaagcaagttgattatctgttaacaaggagtaggaaacatgctgttccacataaaacatgttgtatgctgcctacttttcatttaaacccttgtcagaagttctgtcctatttgttcaaagtagtctcactttctctattcaacagtagttatttagatgcagatttgaagttcataactactatttcggtgacgtataaaatcgataaaacctagcaagctgcagtggtcatgaatgcatgtgtttagtaatcttcaaagttataaatgatgaagctatcaaattttccaacagtttctcctgataatttgttatgttcctgtaataactaatctaagtgttctactgatttagttaaattcattagaagacagggtttggaggagatactaacatgacgactgcaaatagcaacagagttgatggagaaagtgttgatatatcaaggatagattcaccggcttgtcttgtattaacactctggaataataatcctaccaatttctgtaaccaattcattccctctaagctctctgagttccactcaaacgagcaaataaacattacttgcagtagaatcagtccagtaacactcagaacaatgtaaacagaatttctcctcacatgcaaatgtttgtagccagtctccccaggatgctgaaggatgtaagcatactctgcttttccactgaccttccccaaaacccatacgcatagccgcaagagtggtgaaaacaaggtgttgcctgctagaatctgcgggatcactaggagcaaaaggacccagttctttctgaagggttgcatgttactatttagtggcgtgaagccacagtttgcgaacgaggacactgctgtgaagatgcaaaaggtatacatattgatctccttacttttcagtacatttcttgcatctgaatcaatccaaaagtaaataataatgatgacagaactggaaatgacagtagctacgaaataacctgtcactatgcgaaccaacacagcgcaaggattatatgttatgcttttgttttgctgtacctggttttgcgacatagtttcttctgattggccacattccgtaattttgtgatccccattgtttgcaggactgttgaattcaatgtccaagctgattgaaggtaaacttctctggctgttctcatttctgttggcattggcattgttgaagtagagccctagcattgatgtgaacacctctcctcccattagcatcagaaggatcagaacccagagttgcctgtcagataagtcttccatctctactgttgccatgctcgagacagtaagtgtagacacagaggtgaacaataggtccaaatcctttggacctggcttaccctggggcttgagattcttcagagcaaggaaaccagcaaatgagattatcacaaagtaaacgagctgaactaccaaagggttacttttgcaaaccagaaaactataagattgtttgacagaacttgccacacatctggctctggaaatgagcttcatggacaggaacccacagagatgctgagctttctcccaatagatccgaggcacctccgaattcggtaacaggagcttcatggctatgtatagtttgatacgcttcaaggtatctagcactaaacttggtggatgcattcttcaacaaattttttgggcttatagaaggtggtattggagttggcaacccatagtgtgtttcaatggcatatttggtaggtttctaatattgttggtacttgtgtaacgctgcccaatgtgaggatgctctgagcttaatatgtaggatgaaacaatcaacattggtggtgtgtactttttagagtcccaagtgtttggtctatatttgtagcaagaggagtacgttcagttcgcacaacaatgatgctgatggtaccttagttagcatattttgtggctgtggaacaagccaatccagggatttttggtactccgaaaaggactcgtggcaatttttcctacaacaacactattctcttgattaaaatatttcattttttttttgttacagattggtctatgtgattcccttcttcctgagcagtcaaggaagtcgctacacttgccagtgaagttggtccatgcatctgtgtgcagcagctgtaacctatcgacaattcgggacctcatccgcactggtaaaatgtacaagcattaacactagtgtcactgaatgtttttttatattcttctctctgatctgaacagttcagttcagaccccagttcagtcggaatggatacagcatgcaggtgagattggcaaacggcaatggcaactgatcgatcgagcagccgaaagcttcgatggaccactgtttgagtgatcggacaataatgcagtggatcacgcagcaataattgagagaatttttttcctttgggctccccgatttagtggctgggagagctcatgtgcggacaattcaaatccgtcagctactacgcgttggtttgtgctttgattggctcaccatctcttctacttctgtatgtcttttgcctcgctgaaaatctcagctgctattgagctcccaattgtgccactgacaggtacatgtaactgtttcttaacgacattgacgcgctcacgcgcatgcgccgctgcactggacacgcattgcacgctgccgcttgctttctatggacttcagttaaagcttgagcgtatggctgaagaggagtaagagaaagtcagaaagattttatctcgacttgttagcacgtttttccaaattattaaacttacctatcaaatggtatgtttcgttgaaaattgtctttgctttaaaatatcaaataaatctatttttcatgtttaaaatagggagaatagctaatatggtcactaaagtttcgctcctgggtcattttagttcttaatattttatattgtccaaacaagtcctttaaatttgtcatgtgggctaatatagtccttggtcccaccaaaatcgccacatggacatgccatgtcaccttcctatgcaaaatctatatgatttgtccaatttacccttacgcataggaaaataaaaaacaaaaggaaaaagttaaaaaaaatatatggtatatgcaagagcaaaaatatacctcaaaatggtgaaaaaaggaagtattttttcctatggttatgtctaattcacccttatatttatttttctatgatatacgtaagggtaaattggacaatttattatagattttgcatgaatgatgacatggcatatccatatgatggttttggtggacccaaagactattctaggttttatgacaaaggttaaggatttatttagaccatttaaaaggttagggactaaactgatcctacagagaaactttagggactaaagtagctattatctctttaaaataattaaaacttaggacctgttcagatagatatcatttcaaaccataccaatttttggtaaaattgtgaaaatatgtgcatctatttagtttcttactaaactctgataaataagtaagaaatcctactaaaactttggcaatattgtcaaattgccaaaaatttggcaataccaaaatttggtaaggtttattttggctataatccgaagagaccattaattattcatgcactatagttcaactttaacctgttttttccacagcggttttaaactgttcaaccagcattttgccaggatatttgacaccctctcaaggatctgaggttggtagagagaatggatttggctaacatggagtaccggccagcatgtatgacagatgtggacacggctatttgatcgatgataggtaacatgatgtggaagaaacatgatctttgtttccttctgctgatcaataatctttgcgtatgtggatgccgcccccacgatatatggacgcacaactagcagtgaacaaaaaagttcgaagctgatgactccgatcctctcgaattcgttgttttaataagtaagctaagttagctgctcataaattgcccggattgattttctttacggaaaggctaacgatatattgacagaaaatctatctctaaatcttgcagattttgaatcactggatgaactttgcgattcgtgctccaggccttatcctccaactccggcgacctcctcttcttctccggcgccggcgacaccctagactccggcagaggaccctacgggttagggtactaggttgggatgggggtgggagggggagggggaagagagaggag

SEQ ID NO: 60927 - DNA, 1825 bp, Oryza sativa
ccatgcgtgatggggagcgttagctatactagcgtcgatcacggtattatgcagtcacgtgcgggtggaactgcggatatccgagcgcatataccactttgcttaaacctccatcgatcgatcacaaggttttctgctcatccagctatcggcctagctaacatcctagtcttttaataacaatcaacttaattgcaacgccttttggttttgtgcctacaagaattatgtaggtaaggaggcactagggaggcacacccttcccataaaattttagttttaaatatgaatagtcgagattacattggcgttcagatcacttatgttatgttctcgttcttaaaatgaaagcttcatttttttagctactacgttcatctgaaacttcttaacccaatagcatgtttagtttgattttacactaatgcctaggatagttttcatctccacactttctagacatataattgttcatgtttatagatatgattaaactttctttaaggacagaggggtactctcttgtgagtatttgagagtagagaattagagaagattgagaagatatacaaacgagatacttaaaagttatattaatatatttttttaaattaactttgatatattcgtttagctattcgaggaatgtgtatacaaaaaacgaaggacttttccatccaatctgcttccacctaacacaccctaatctgacgtttgttgcacgatacacctccgctgggccacacgaaaacgagatacacacatcctgcggagcatcaacgtacgaacggtcgccgtacgttcgcctcgcccaaccggcacgcagcttgcggggacgcccgaaagaccgaccgatccatccatccatccctcgtccccggctccccgccaccaaccgcccgggaccgggaccgtgcccgcagcagcagctggtcccgcacccgtacgtgcacgagcgcgacgtcgtcacggttgttgcagccacagcgcccgcccgccccctggtccccctgatcccggcctctcccggccgcgcgcgcgcgtaccgtgcggcgtcgtgcgtgcgtacatgcgtgcgccgtaaccagcagccgcgcggatcgatcggtggcgcgccccacgggccacgggtcggccctccttttgaggttgtaaagtacgccgtgcttatccgcgggcacgtacttgcttttccccattttgtctttttttctcttaccatgggacacactactacaggacgattttttcgtacgatcaaaatagattttcataggtaagtagtgggtgatccacatgagtccttatcgttttgtgagaggggcttgtccctctctcccaaacaccccaccccctaaggtgtatgcaaacaaaaaaatatgtatttttacatgtcggtaaaataaacgtgtacggtgtgtatgtgaaagttgtacttttaggagaaacgaattttgcaagtgcgaacagtctagagggaccctcgtccaggaaaaaaaaatcttttctaggtgacagtgagtgttgtaatagtgacagtgggtaaaaggcgtgcgaagtgatgggttcgtagtacaaacaatctacagctcttttttttggataatgatctgcagctcttgttgtagtactacgataagcggataatcatgcgtaggaacgaaacaaaaagtttcacgcgaaaaagggatagctgtgatgttgaggtttggccagtgtaggccacaaattttgacaatttaaccctttaaaaaatctaattttacaaatgaatcctcatcaaaacttatttaaaaaataacccttttgttcagcgtcaaatcgt

SEQ ID NO: 60928 - DNA, 6567 bp, Oryza sativa
tttttatttttcccatagcttttgcttcacacgttgtttgcaatgtgactgtcaacatacctgtctgttaatgtcaacactaacatgatctggaatttttgacagaccattagaccaagggtgacatggacgtgtgaaaatgtcaggcaagcaagcaaggctagctgtggactatactattgttaatccacgctggaagcttcacccgaatacggcatgtggaaagggatatggttaggtgtgttaagttcacgtcaaaattgaaagtttggttaaaattagaacaatgtgatggaaaaattaaaaatttgtgtgagtagaaaaattttgatgcttgaaaagttgaaagtttgaagaaaaagttggaaactgaaccatgccttacttacactcttctattgacctaaatatcttgtccatactgtaaatgattttatccatgtattattatatttgtgaattctcttatattttagacgtagatagtagttgtagaaaaaatgcttaagagtttgcacgtactgctaatttatgggtcaatctgggtacgccgtacgcttgcttcttcacgttaagaattgcagcattgttcctggagaaggaaaatggcgaaaggccgaaagttgcatcgcatgtgttacatgcatgcatgttttgttgaccaaagcttccgtccaagaacgtgatctcagttttcgtttccatttcaagcgaagaggccggggccctctgtcactgtgtcacatgcatgattttttttttcgaggaacatgcatgatttgttgaccatgcattaggcctaattaatcatgctgccagaggaccagtggtggtggttgcattgcatgtatgtagctcaaaaactcgccaattaaaccaaaccaaattgctgaacttgttttcagaaactggtaatcagtacaagacgtgagatgcacgcgtgttggattaagcagctaccgcggtgtaaatcagccagcaacacagtttggttaggacaaattaaaagattctgcaaatcagcgcttatcttcaagcgcggtataagaagttcacacggttgatcccttgtacagcttctactgcctctcactgtctggacgatatttcccacgtttgggcagaccagactctcaggaggcgacgacgcgatggcagctggtcagtgcatctgtgcatgaacgagcaggtttgatgccgacgcgcagcatgaagaaattcggcgccggcccgttgttgaggcgcgcacgcacgtttgatgcaattgatgcgtgcccgtagtccgtagagagagtgagagactggctgaagcgtcaccgagtccacccgctgtcttacgtgggagcgttgtagccgcaattggcaattaaaaggcacagctctagattttaaaattataatattagacttaaaatttatatgttaaattatagtagtttgaaattttatatttcatctaaaatatataaatacaataattcattcaaatgttaccaacgaaatcacgaatctaatatatggatttgtgaagctaaatcttgatactcgtctaaattcataccccatcccaaaataattttatttttcaccgtcttattatcttgaaataactttatctttcaagcaatcattgtatttgagtttgtgaaaatgagaacaaatgcattaggactagttaaagcaaaaggcaattgcattgagatttgattaaaaaaaagaacaatagttttttattggtacgtataagatgtgtgaaaaataaaagagtaaatttcagaaaactgtaactacagtgacaaaactatcgtttgacaaaactatcgttttgctacaacattagtgacttgtttcagtttgctgcaacaatagcaaaactattggtttgctataacattagtgacttatttcagtttgttgcaacaataacgtgggaaattatcacaaaactacaaacttttacgtgctatactgctacaggacatgtaggtgacaaactgtatcagcatatcacgaaaagttacagttttgtgataatttctcatactattgttacaataaactgaaatagattactaatgttgcatcaaactgatagttttgtcactaatgtagttttctaaaatttactcaaaataaaactattttgggaaaatattttgtgatagagataggtaccataaatccataatggcactcaatcaaatggtttaacccatatatggatgctcacccagggggttcacaacattcgctacctctcgaagggctaggcttggagcatcctttttctcgtagcaagagtctagtggggaagtaaaatgcaatccgtttttatagaccgtgtttcaaaatgtcacaagtcgggccacgtaatgaaaatacaactccacggaagcccccgtgtaaccaacaacatatggacactgttagatttacatgacagatcaataatgcagggagcgcaaacaagtacagaaatataaactttcatggggttattggtcttcgatttatactctgaagtttcaatgtgccccagaatatctcatcgtgctctacctataattccgttgcctaaacagcctattgccatgactttcagcccttatactgctacaggcagaatcgctgctcctgtcagaaccttggatcaggcaggtcaaaaatcagagggcagatgaaaaattcctgtgctctatggttcaaatctactcttgtttcccctgcttcctcccgaacggtcgtaccgtcggtgttgcaatgcctactgagtgggctttgctattgtcatttaaaggaccaattcgcaatgggtgggcttcggtattgaagacccactcatcgaaggatatgactgatggaggagagaacaggaggtataggtacttgagagtctctgctaggaagaagctttgcatcatgttatccttctcgccagtattcacctggagaccaaaatatttgacaagaatttgtgtaagtcttacactagcgctcagtgggaatttaagtatggatgctatcataaaaacaattaaaaaaagcttacatctctcagcccaacgtaaccagattctatgcgggagttcttttcaaatgcctggaatatgtcccacccccagtcttggtatgttttgttccccgtaagacgccacaagtacataagtgattcgacagtctcaggtctcaggatattccatgatgtgcccacgttcatatcctaaattaagaagctatcatttagagataaatgatggaatagtacgtgattattatagagaataaaataagagctgccttgctacctgtccagtatggaaaaaataattctccccagccaactttgtaggagttgtttggtagaagttataacaggtccgagcaagctaagaagagaacaaaaaattatatcaacaaaaaaccatgtctgtaattgatcgatttggatatgagttgactatgagacttcatacacattaaagttcatagaacgaaaagaatattagacatgaagataaaaattctttaagtatctagttaacaaataaggatttaagactttgaatatacaaaagtgagaattcctaaaggacttacctctttcgcaagattcataatttcttcagccttttcagtctcctcatagccagaggcccccagtgccagcataccaggggcaaaacatgcaagctcatccatctgtgctagtcacaagccgaaccagtgagaactcccgagagagaatgaaagttaagtccaaatgatcctcttgttgattacagccaaccaaatgggattatttaccttgtcagacaatgaaccaccattcttctcgcaaatgtagtagtaattagagggtgtagtttttttggtcaagcttagtaggccttccattgatgtctcccacatttgtctagtcaaaaatcatataaacagttatcaacatgctaaatgaaactgtatggaatttccagtaaaagaaatcagtgaagggaatatgaaaaggtgaaaagtgaggcttataggctcaaacctgtaatgctttacatgctcagttttattcccctggacccaaaccttgagcaagtactcgtagaagctgaaccacaaatgtagttagctccatttttcaatcattctacactcactaaaattagggtatgcaacagaaaatttatgaacaatccaatagagcaagttgcttaaaggtttgcacaaattaacatggaaagtactaatgttaatcacagaaggaccactatgttttcaggaaggaaatagcttgtttgaataagtgagaatagaagtataacctatctcccattgcaccaaatgtaattgttgagtacgacgcagttcctgaatgagggtttatgtatatagggagtaagccatcgcttgggtatatcttctgaagctgtctgatgacattctctgcctaaaattgtattgtatcaggccaaactgtgagttcaatattaagaaagccaaaaagagattttcaggcaggatttaaatttatataaattatatacgggcagatgccattttttgtagggctttgcttacgcacactggttagcaaaatattataaacattaaaagaaaaggcagtaataaataagtacgggccaacataaaccaatgatgtaggatacaaatttacattagggatcaaagtttttgatggaactcataccaattgatttgatccatgcaatagcatgtcaaataaataggataaggaacaaggttatttaggatctataagtaggaccaatataatcaaattgattatgatttggatatattttctatttccaacttataacagccttttctttgagacactattttattcttgaaaggagatctaaagcaaacctggcgtcatctgatagagagaagtcagtatatatacttaacccacaatactggggtcaagctaaattcaagaacttttcaggggaagaacatttgtatatgaagaaggctatgattttgaaggccatccagaaaataaaacactttaaatatgacttatgaactatcacaaaaaatcatttattcccgcagtcatgatttgagtacttatgtgtgtcacaaaaggaggcatcaaggagatttggttccagtggttatgaccatagcatcaagtgaaaaagggatgcatgcatgcacatcaacaacaaagggaacaatcaaagtattatatatgattacaaggtcctttttgcttgctcaagagtcaagagccaggtggttagtctcacgtcgtggtttggtttgtgggtcgtggtcattttatctgtttgtgtttgtggtcgggtttgtgacacgcatggttcctagaactcagtgtgtgcgtgtttggttttgcacgcgtgttctaccccctcttcttcttattcgaggaaggaaatagaagccatgttttgcacacaactggttgcacttaatttaccaagataattgcataaaactggcaggatgtatgaaatatgagtaatctgtagaaccttttgttgatacttgggatcaccagtcctctgtgacaaagctataaattcaagttgctccgtgccagaatcagcaaggatactatcaccctgcagaaacacacaatgtacatggttcaccatccaaagagagagaaaatagtttcaggtcaaatgcatttataaacaatccattgagcaattattgatgtgtttttataaagattatgcagctctcttgactattcgagaaaaaagtgtttttacaaagatattggtaatatcacattaaacttctaatttgatcagtttttttaaaaaaacttctaatttgatcactgtggagataaggggctgaaacaaattataaacatgatgaattaatcataaagatgtatgtgatgacatgtgattcaatccctcgaatgaaaacagagctctaaaggaacaacaaagtttgcatcattatgaagaaaaatgggatgctgtgaacatggttaaaacagttagctgtaagcttcagtgtgcttagaaggaacactccatgtaattgactaccactagcaaaatagaatctattactcacattggtccatccaggattatgggctcgtccatgagctaggttgattctattataagggataccagatggtgtatcccaagcaggtagtagacggtcagtaatatctttggccttctcaagaaatactttgtcaccagatagatcatatgcactgaggaggcctccaacaactctgaatataaaaataaaacagaaacttagaaaaaactagatatacttttatgttctaaaaaatgtggtctgcctacatagcatcgatcaaagaagtcaaatattttaagaaaaaaaatactacaacaatagtaaaccttataaggcaaccttatggtcgtttcaaagacacttgcatcgtaatccttgtcaaagcttagtgaatcggccacccagctggcatcatgaaatagacatcgactgaattagagtatgacataaatcataagaagatactccactctgtaatggagctataaacaagcagattag

SEQ ID NO: 60929 - DNA, 6238 bp, Oryza sativa
tgcaagtagttcatcaacaaggtaatattcctggagctttgaagccatcaatagtggagaactaaatcataactgcgatatctttattcaacagaaaatcgttgaatctgaactgcaagatattttcctgtacaacccaatatctgccatccgtatattcatttgcatttactagcactagactgagctgttcaacaagcagcatttaagacaacctcgcaaataccctactccctccggttccattttaattgacgttttggacaatgacacggtctacaagatacatctttaatcttacttttctattataatatatataataaataaatgcatgtttatttttattatagtactttaaaagacaaatctatatatgttgttctagttcttttaaaccaaatatttttaaagttattaatggttaaagttataaaagtttgacctcaaccttgtccaaaacgtcaattaatatggaaccggagggagtaccttgcactttcacaagtataatttaaagccattcatctgtagcacttcagaatgaacaattcaagatggtgacgaggcacctttcagatagcataccttacatttgtacttttaagttctaaattctacaaggaactcaaacaataagagtgaacagaggaatatcaaaagtatatgcatactccaggagataagatatgagttgactcaaactgaaataaaacatgccaacagcccaacagacccatgtgattttcaaacagaccaactaatccatgttttcttatggtttacagaagagctagattgacttgataaatccaaaggatgaaaattgatcaaaatatacattcatgactcatgtgtggtatccttcaaattagctgattacttacaagcctcaatgaacaagtgggaaaaaacaacctaaccttaatttcatcttgtcaaacttaaattgacataacaccaactacatctctgacatttgttttctcctcaaaatacataacactataggaatttgtgatgatatcctcctctaaaataatcacaaaacagaaatttttagattttttagactacaccaatctcagtgagtatgctgtaaactaacacatcaaagagcataaaataacccagttctccaaatctacaccttctattagtcctaaaacatagaaacgtaaaactttacttccacctgaaataaataggaatagttcagaccttcccatttacttaatttaacgagaaatcgagactacgaaaatctcactgtaccaagagtggccgagtacctccactaatccttaaactaacactgaaagagttcgaacattttaaccgaattatcatcacagctgagctaaccagaatgcactccatgtggttgatttgcaaacttccagattctcgtcccaccagtaatccacagaacacaacaaaaacgaagactggatcctgaatcctggaaaaaccacactctgctccgcaagcgcacatgtcccaaaaccacccgcacaagctctcgatactcagatccagcgaccaatcatcaccacaacaaacaaaaaaaaaaggaaatccgaagctaaggcgggcagcaaaaccggtcagatccccgccgcctcaacccggatcaggggaacttcaacgggtgggagaggaggcgcgaacctcgtactcgcggacgagcgactgtcgatcccagaaggcgaaggtggcggcgacgaagacgaagaagaggagggcgaggcgcttcggccgcttgaggtaatacgccgggttgaggtaccgccacgcccccgacgacgacgaggaggaggaggaccgacgagccatggacggacgccgcccgcggggaggagatcgccggcacccgagctcgccacctccggcgaggtctccggcgattcgcgcgtgtcacgccgccgcgtgggatgtgttttcgtgtgtgtggcgtttgggggtcggacctcggtggtggctcggtcgtcgttgaacggggcctactgccggtaaataaccacttggtcattagagcaggtataatagcatatgctataaaccagctgtaaacatattttaaggagataaataaagagaaagaataacagcgcgctacagatttatagctagctgcagcacggactccaagacgcaaggtgtgtatgacaggtgagaccaggtattaatagtgtactattttactattgtatgaatgagctattagattgactatagataaattagagctagtagttggctatactattaaacttaaacttgctcctatacactgattttccccctttttaacttacagcattcctctttttttttcttttgaaaatacttcttgtccttttctcgtaacaaattgatgttattagctcattcatgttttttttacatagtagacttaattaaatagtataatatatcaacactatgttaaattaacatgtgtaccattttcggccgcttgtgtttttttaagtgaacaacgccccaagcaatgtgatgtttctatcaatatagtccttcaattttgtattataagtagtttaaccgttgtggaaatataggctgatttgatttgatgccctatcaaatcattggtagtgctaaatcttagttatgttttgacactatcaatgttttggtagatttagactatatgaattgtattagctatggcaaatattgacatcaatccaaacatctacaaactactatttaaattgccaactatttggttgggcaagttttagcatcaaaccaaaacagccctatatcccatgaacgctaatcagagatttccgtgtgagtgggggcgttggcttgcattacattagcatcatagcgtgaaatcccactgtttcatgaagaaatgctagcgattgattaccggtgaacatactcgtttctatctctccattttagtttttctacataaggcagagcgatagaaacgataaactttttgcctctccattttgattttatgaacgtagacagcacgccatgtgtacaggtgggtaggagggatcaggtacaccaaattggtcggatggagcacgtttttgacgttgggtctcacgcttcggtcgtcgcctcgatcaactttccggctcaaagtgctctgcaacagtgcaactctacactgttcgcatcacgggcccgcatgctcgacatgctctgcacctttggtgcatggcaacctactcctctcacaacacaacgaccatacatgcaaaggaagtagcaaaagcagcagcagcttacgatgttatcaatcggaagtagaagctctcaactactagccatcacgccgttctcaacaacggggagcgcgaagaaaaacacgggccaagtgtcattttcgaccaaactactagcgccattcttgtcagaatcttcacggacgttcagagctaagaacagggacattcacaagcatttgtcacagcctacagggccgtgcagattaatgaaagatggggaatatacagcgtacaggttacccgaagtggcagcattcagtactatttgtcaccaatccttcagaagtgcaccggcgacgtccttgtaactgacctttttcttctttggagcaccagcagttggatctggggctggaaccccggtactctgtgtggagcttcctgcgtgtggtgccggaacaccagaactggatgcagaactcgctgaggcctgtggcactggagccacgtaactggatgtggagcttcctacccaaggtggattcgtctcagctttggcttcggcaaccctgttaccaacgtccgtcttcatctggccaagcgatggaatcatgtccaggagcattgcgtgcagcggatcaaccatctgttccatcttctcgcacgttgcgctactcgttgtttcagcggtgtctcttctaagaactgtttggttgcgttcgtgttttgggctgcttggtgtctccgtggtactcgatttgattcctttgggctcctgctcatccaatgtgataagctgggcacctggaggtggttcttgatccttgtcatgggcatgttcttccatcttagagatggaatctgcgttcaacttcttatcatcttgacctgtttcaccaggacctgtttcacgatctatctttgcaagccactttcctctttgagcccttgatcttcggaccactctaggagcggttggatgtgccccctggtctctgtcactgctatcttcttccatcttagagatgtaatctgcatccaacctttgatcatcctgtcctgtttcaccaggatcactttcttcagattgaccataatcgattttggcatgctgttttcctctcctagcccttgttcttcggactggtctagcagaaactggtctttgtcaaagctatctacttccattttagagatgttatctgtgtctggtatttgatcatctagacctgtttcaccatggtcactttcttcaggctcaacatcatctatttttgcatgttgatttcctcttctagctcttgttcttcggactggtctaggagcaggctttgcagttcttgaggcactactggatggccttccccttttccttggtgcatgcttaacatgagatgtatcagccttctcattttcctcaagcttgtcattacaaggctgaacagtttcctcactgaaaacaaaacagaaacttcagtaaaaaataaaagatcgataacaataaaaaatgcagatattgcgaatgctgaaatacaaccatcccgcatctaccttcgttcaatttctatttcttctagtgtatccggtttaaggctgtaagtggtttcaggcagccttgtttgtttttccactgaatcttccaaccacttgttactgacaacctgcaatcttttgtcatgtagataacgcctctcggcaggagggaggctgcataaaccagtattttcataagttttcaaatttccagctgtcagtgtttgaagaaagaaattcttctatcatagaacagaccaaaaaaaaattaataaataacctcttgtacagcatgtcaaaattgtaggcttgtagaactgaaactataatcaaatgagtagcgggagcaagaatgctgcacacttgaccaccatgcatggtaaggtcctgcttcactctcttgagtgcaagatcagatattacattgtagtccgcattcctccagaaaagaagagcatcaatgaataaagaatcacattacatgaaagatgatattgaccgcaaataaaacttacaccaagggtgcatgatagaagtagacacagcaaccctggaagaagcagaatctctcatctgcgcaatacttctttttgtagtggtgtaccatgtttgaatcaacaacagctctgtccatattgctgaaaatctgaacaatgtacaaagaaagaagaatcaccaaaatgatcactgtatttagtccttatctattggttctctacttggataatatttccgagcacaatagtagttttcagacaaacttcttaatatcaaacttgccaaacttcttagtaacaaagagtaagtagcttatgaaaattgggaaatatttttccaaatttatcgttggctgttatcatacaaaccccaacagggaccattggatgaattttcgtatgtttggatggatcaaaactatggagattaagcagggaatccctcatactagatttctagtctcatatacttgtagtattgttgattgcacagattttaactacaggaataccaatttagcacccagaatgacatatctggcattatgaattacagccaaatgcatatacgagataagcatttgctgcatacaggaaaaagaatttacctgcttgaggtcagaaatatcaatgtcccagtagaaatagtcggcatatgagtcgatctcttcaggaaatttgtgccttgcaaaatctgcaagaaagaggatatacctgcacagtgaaatgagttagaatatttttgacaagaaaagttgatgaaagaaacatgggctgtaagcaagggtcaaacttaggctgcaaatgaagaaggcgtttttccttgcaacagtctaagatccaggaataatgaatgatccttccctgccgtgtggctgcctgatatttgatacctgggaaaacacaagagaataacttgaactaaattactcaacatttagaataagagaaaacataaggtttctcaacaggataaagttaatacct

SEQ ID NO: 60930 - DNA, 1027 bp, Oryza sativa
agttggagagcaaatcagcatgttgtacaagaacaaatctttcccgagcataagacttttaaagatagcaaagcatcaatgtttatccataatttgattacctcagatttgattgttcgaatatcgcttgttatggatattatgactgacctgcatttagtgatgcagtatatcagatgcttcctgaacctgacagattgtctagcaatacaccaagaactcccacataaaacttacttatcagggctttctatccaaacatctggcctctcctttgaatggtttgtcacttcataaaatcttggtggttttttggggtattcatttttcctgattcagaaatagccaaatatgaggggataaagtgtccaagttcacacgctctaaggaagtgcgtctgcaaaattgtgataggatgcaacagaaaaaaacaaacaaaaaggtacctgaaatgaggcttcaatttggtgacaagagcgtcaagctcttcatcagaaagaccagtaccgactcggcaaaaagaaagaaatcttgcaaggaaaaaaaaacattaaataggagacataactcttgacctgacagagcataactattaagactaacattaggaaaactgcattcccgttgttattaagatctccacacgtagttttccacagacaccgccaagtataaaaggagatggtaggggaaaagggtgttcttaccttttgggataactattgtcgtcagaaggcactgcaagaccaactaaaaactgggcaacctataacaggttaagaatggtcagcacttttttatagcattcttcttgaaaataagaatatcaccaatatatgctcccagtaaaacaagaaaaatgcagttttttgtccttgagtggttaggacagatacatgcaaaaaagtcttagaaaacatggtaggatatatagcacccttgcagcatagccctaatgtcgaaactggaacaatagataaactgtgtaattcaagataagagtatgtacacacctctcctcctcgac

SEQ ID NO: 60931 - DNA, 13338 bp, Oryza sativa
  unsure (1)..(13338): unsure at all n locations
tgtagatatgctgtccaaaatcaggaggcaaacttgcacttgcagatgtgatttagcttttcaacccttcaaggaattgccaccagttcgtgatcctgattatctaaaggactagtttgtaatacatgcatgtagataagcaaaaggttcgatcgaaatgacaaaggggagaaattaaagtaccaaaaagggaaagcctggagaatttgtcctgcacaagcagcaaaaacagctccctggtaacaacaagcacatacagttacaatttacatgatgatgcacaccggacagaacttgtttggaggctattgcatcataggatgcaaatggtaacattaaacttcacatgatgcaaacagaaataaactccatgtggttgaacaatctattattagtaaagcgttacatgatgtgcttcggagcttgtttggaggacacgtagcactgtaatatccccttgttttgtgcttattaaaattccatttcttacctccttcaatgcaatagttagagctcctaccccttttggcatttttgctgaaaaaatatcatcatcaaaatgcattaccaggtgagtcaagtgtgttaggttctaacgtataaggcagatctctagtattcctttgctaaaaaaaggaagatctccagtaacaccttttccagtcttactagaatgtaatcgtacataatagtacctttttttgcccttgcatggaactacagaacaatgcatgcaatttatagtaacacagaccatttttttattttatttcgcagcccatacatatactaagtctaaggatgttctcatgtgccatatatgtgaatagcgaataataaggggagatctcaccatttgacaacacaatgctccagctaagattggaatcctaacaaccttacaaacaagtctactgcagtgatgattgtatatgccacgacagctaaaccacatcatatccgatgctgcaagatgtcatatatataaaacggaaagcaatactgccaattgctgctaaaggcaaatatgttagaagacttttgcttccactgaatgatgttttttaagaatgatgttaactacagctactgctgaagattatctcaacaaaaaaaaaagctactgctgaagactaattatatacacgacaacactactatatacgttgttatatgtacattatttattgcataagattctgctaattaggcgatgataacgagctctgaaagaaggttatattgaaaacaatagccattgtgtctctccagaaaaaggaaaagaaaacaaaggcataaagcatgaatttaaacatcttaagcagatgcctcaaaacaaaggaacctttcttttacaaagttgaccatataagattccatccacctaaaattcatcattaaattcctggagtttgaatcctgaaatttcattctccacctcaggttctgtaccttgcatgcctgttgaaggaaaactgagggctggtgccttccagttcctcatattctgttggcatccattttttttttttttgacgcaatgttggcatccaatttaataataataactgaaagatggctcatatatctagttcacagtcttgcaaacctttctcaatatggaacgaacttgtgctgtatatgaaacatgtgaataatctgggatcaactggatgattcagtcaaatttgccaactataaataaaactatcaacaggtattcaggaatctcaatgcaagaaagaatacataagagaaattaggattttctccactaagaagaaaaaaggaacctaagctcaaagcgaggtcaaacccaggtgttgtggagggtggagatgctgaccttccaccaagctaggctcagttacataggattgttgaattaccgaagtatgtacatgagcttcacaaaattgatgaagcaacaaaacaacctttctgtattcagagttgacactaattaacccagtcaacttggcataataggaaacaacatgtattggagaacataggtcgcaataacaaccaaaactaaacatttctgtgccctgcacatgtggctacatccccgttgcagaaatagtgaaatccaacatttgcagtattcaataatcatgagtgaagtatacataaagttgtacagacatgcaaaaaggaaaatgaatgccagattcatcccacacgtcaagatccaaacaaggcaagttgtacttgggacatgatgaaccattcacattggttcttgtcttcttttttcctttacttctagatcaaacttgatattgaattgcaggtttgtagaactttgtatactacggtaatgattttagtagcaattttcaaatcattgcaacacagggcattcgatattgggtacatgaattcccatgaaacagaaactttctttttaaaagcatcaagcacatttttattataatagattggaaatttacattgaggacacaaaactgcattcaaattgaaagtgtacacaaattttgccttgtaaagtaaacttatatatagctatatcttttgtactatattgcaaaattactgaagaatatatatattgtagttgcctagaaagtcataacgcaatcaaaatagatggaacaatccaatgttttcttcttcttcttttttgcggcgaagatggaacaattaagttatgattacattttcagaaagaatcttcaatgaagcattcaacaaatcaacttacaagcagtcaagcagaataaactagcaagaagagcttctaacaggactgcaaaaacccataggagtgattatatctaaatgacaatgcaactgaaaacaaaatcttaggatggggagacattaatgtggtgtttaaatgtttcattgacaatatgacaatgacaaaaggaattagtatgtgtcaaataataaattctaatgcacatacggaataataagaggatggcacaatttttttttttgggagcagcttagctctagctaattactgggttgtttttgtgtggtcaccccccacctatcctatcttcttactgtttttagagaatatgcaggaattgtgcttcttcgctttgagataggaagtgagataggccaatcctgtccatcaaatattccaccataaaacaaaaacattgcaggaaacgaactgaccatttctaatatgtatagagaactagccttgtatgcaacgaaaaataaaataaaaacctataaatacaattcaaaagaacatgctgctagtatcttaagatttttaacaactggagggggaaatatatttttttgccaggtcggccagcaaggccgaccaaatttcattaagataaacaggggtacaagttacaaaattgttactttgacaatggttgccgaaagcagggcgagaattgctaaaaggctcagttcttaaaaaaattgccaaaaagcaatccgcatgcagaaagaaaaacctgatactagtgctgaaaactagccattagcttcttttaaaaattttgcttgcgaggggaaaatatatgttacctgcgaacaccacattgccaaaggtgtttgttacctgcaaacatagtggacatagcgtgtgcgcgcgcacacgcaaccagacgaaggtgaagcaagctcgttgaactgtactcacacacacaccccaaagaaaaaaggtaacacatgatatatactccctgctcaacagtctgctttccacgttccttgaaagctgagagcatgctcagtctgcatggcaatggttgacagtatcagcatggagcgtacatgtgcagagcccatatatagagccacacatggactatggtgatcagaagaattcagagctgacaggttgcacgttgcaactagcaacaggatgacatgtagtaagcactaggcatttctagactattcgcttgtgcattacacaggaaccaacctactctgccataaaaaccatgctaacgagaacgttcaccattgctcaaactgacaactgaagccgaacgtacatgcagcaaaacgcacaggtaatgtctgggcctccgggcaatggagatacctggaagacatatctaaacaccctccgcagtttctatgtgcattttgcctaaaaaattgattctacctatcccgtgagaccaattccccacgagcgctcgctattcatcaattgattgaagcgccctcgtaaccctcagtaaaggttccgatcacctcatctgaatactggactggaatgcgtaccaatcaggcactcgacaagcgcacacgcgtagggttcgatcgcgtgctcacgtggtgcgctctccccgcgccttgacagatcaaccggttaaacccacaaatccaactaaccccacacgcgtaagcaccgcgatcgcgcgcccaattcaccgttcacgcgtccggaaacggaacacctagcgcacgtccggtcctccggtgcgagagaggatgtggctgtggagacgaagggtgggagacgaacctgaacctggagaatccaccgcgcccgcccatccacctgctccttctcctgcgtcggcgccccgctcgaggagtggttcgccggctcgcccgcccaccgcttccgcccgctcaaatccggcggccgcatacagaattgggcatatccccccaaccaaatgcggcgccgcggatttagccgcgccacccgtacgccttgaacccccgaccaccccgcagccgcgtggcggcgagatccgggaggagagggcgcggcggcgcggcgcagcgcggcggggagtgggggtttcgccgcctcggaaaggttcgagaggagcgggaggtttcgggtgggcggtggcggtggcgatatggcgcgcggggtacagtggccgggccgccggggggctcgagacgtgcgtgtaattaatggaggagagagacagggattccttctccatcctggccgttgataggatgatccgatggctaaaactgactagacggcacgctctacggttttctctgcaaggcagaggatactgttcacgcattgtcagagcctgtcaaaaaaggccttttaggattttgggctctgccaattttgcgtaaaggcccataaaggcataaagaaatattatttgaaataagttcaccggaggtccctcaacttaacagcgagattttttgagatcccttaaccacaaaaccagaaatcttcacccctaaactatacaaaaccgttcactcaaggtccctagacagtatatatgggtggtttcgctgacgtggcatcctagtcagccaaaaaaaaatttaaaaatacgtggggcccacatgttagctgcacattttttttcttctccttccttctccttctctcctcttttctctcttctctatttctctttagtgagggaggccggcggcaggcggagcagcgcgtgcggatgcgggtggcgcagcagagggcaagcgcggcagcggagcggcggcaggcgcaagcgcagcgggccgagcagtggagcgcaagcatggccgcgggcaaagaatcagagggcgagcgcggcggcgggtggagcggcggaggccgagcatggcaccggagcggaggtgggcgagcgcggaggcgcatccagcctaccccaaccgaccaaagcacgccctttgccctcgaccataagccccgccgccaagtcgccgtcgccgtcgccgtcctccccgtcgtcgtcgagcggcagcgatgacttcgcggtgctcctcgacgcggagctcgagctcacctccgccgctgactcggcctccgccggagacacctccgccgtcaacaacgactatgaggaagacccctcccaaccttccctccttcctcctcgagctccctcatgccggcgccggcgcctgcagggatgggaagccgacagtgctggccgttgtggtcagctcgcttgccgcggcaacgctggtcccggcgctaaccggctgatgcgtctgcggatcgatgccctggctcatgagcttgcgcttgatgtgcgtgttccacctgcagaaccaatcaatcagcaccaagaacacaagaagagctaaccggagcagatgacaacacgttgaaatttgttttgcttacttgttgccgagaagggcgtggaggttgatggtgagctcgtcgtcgtcgtcggtgaagttgctgcacttgaggtcggggctgaggtagttcatccagtggaggcagcagctctttcggcagcggagcaaccccatcgccttggggagggagagagggtcgacggggagagcgcgtcgctcgcccggcgggcggcgacggggcccgtggtcgagcacccggcacgttcgaacatctccgacgcagagctcgccgtcgcgccggcctccacctctcctcctctcccgccgccgccgtcgcgtcgaccgcctctctctccctctcccgccgccgccatctccgctccgccaccggccacctttctccccctcggtcgccgtgcctgctcgagactcgagagatttcggagagaagagaagagaaaaagaaaaaaaacagagaaatgtgggacccacaccattgtctcacttacatgtgggccacacatattaaatttttttttgctgactaggatgccacgtcagcaaaaccactcgtatatactgcctagggaccttgagtgaacggttttgtatagtttaggggtggagatttctagatttgtggttaagggatctcaaaaaatctcggtgtaaagttgagggacggcggtgaacttattccatattatttcatggtttcggaagctacgtattgttgggccatagcccaaactgctgatgttcacactcaaatttcgcatcaaatctcttgtaatttaggaaaattcggaaatctaatggcaaagttttgcggcggtgctcccgaagcttttcgtacacgccacagcaggttactgtagtagcagctatcacatcgttctctgacgtgtcgtcagctctgcacgccgcgaaggccacgtgtacgcgcccggatcgacacgtgtacagccacgcactagaccatctcgaactcccaaagtcccaagctctacgcaaaacgcaaaagcatggacgaatcaaaaaaaatccaaactcttaaaactcgcgtcgaattcaacctggtccagcaaaaacaaagtctcgatcgaactctgatgaagaaaataggaatgtctctggacaaatcgtgacgcgacccagcactcgcatttgcatacaaaaacctgaggcacgctgatgccaggcaaacctgacgaagattagatacagcagcagatcgattctacggcgaggacagcgagaagtcgatagccgcccatacgcggccgccggcggcgagcgagcgagcgagcgcgccatggcgaaccaccgagctgtgatcgcggccgtcctcgttttctgcttgtgcttcgttcaggtggcccggtgcgatgtggtcgccgccgccgtttctccgtcgtcgccggagcaggcgcaagagcttcagatgctgagagccaaagtcgcgtcgttaggtgagtcctgttcttgtttatttatatactcgtattttgaaaatttattctgtttgcattgttgaatatcgcaaaagatatgatagatcaccatggttttgttgctttgataccatataataacttggagctaccaaaaagttcaactcgttaataagagtcgttataggacaagatgatagtttggttgttccattaaccggattaacactgtgcaatggaaatttacctgattcattgttgtttactgggtgaaagaattacgttctttgggtttagaggatgagatcagtgggaggaaggaggagaccttgcagctggagaatgttgtcagggagaagtcagcacagattgcggcattggtgagcgagctagaagttctgcaggtgaattttattctgttttttcaccttattgtatgaaattctatgaattactctcttgaattttaactccgtatgctatattaacttttttggtttggaaactgtaataattaactgacaataacggcataaaatacatgactgctagttgaactctcccgtttagaaactgttggttactggttgactgtgcaacattacttagtagtccctccgtcctaaaatataacaatttaggtgtggatgagacgtattgtagtactatgaatctggataggctcccatccatccaaaagttttatattttgggacggagggagtaattaacttgaattttagaacaatgagtttcgagtcatagttaacatgatcacttcttgaataggaccgctcattatcagtgactaacagaagtggcaaactggcacttgtcataatcatatagtataacctcagcttagactaatcttttttttcggaactcttattcctataaatgttatctcgacttttttctttttatgctgttgaatcaggtgcctaatgttgctgacgatgaatcagtgctgaaggcaaacgcccataatgagatgcttgagaaacaggtaagataatcatgatttcaaaacaatggtattaattaagcctgacaaaaatggttacaaaactgacatacaactgtcaggttctgaggctgggtagtgatttagaggaccaagttaagaaaggggaatcactagaagcccgcgctagtgaagcagagaaaagtttgcttgagcttactcagaagttggaccatgtaagtactataagtacgcaatcgggatatactgtagtgttcagctgtttttcacatgtttgtaacgtaatttctaatttgtatcatacaggctgaaaagataaatatggagcagaagaaaaaaattgaggagcttaaccatagtcttcggcaagtccaggttgatacaaaaggtgtacaaatgaaaacaacctgaacaatctaatgtgcttatctgtgctttatgtggtttgctcaggataaactttttgaagtggagagggaagcaaagttgaaggcggaagagttgatgaaggtatgcaaattctgtcatcttctttttttcttttgtgaggtgtcctaataaaaaaaattgatgttctctttggtgcatttctttcttattgtcttgttgtggaatgattcatagatccgtcctcctttactgtactctgtacatctggcaaaggtacataagcatttgagtttgttttcaggttcatggcatgtggcttccacattgggtcatggctcgttttgtgtattgtcaggtatagatggattcactggaatgttaacgttaacgtagttttctacttcaagttgagcttgtttttgtgcacttgcaggacttggcttctgacaaatggcagctccatgggaagcctgtgcttgatgctctggcgcagaaggttcgtttcatttttttttacttaattaactattcctcaaatgtttctaaatgattggcttaatgtgtcaaccggacagatttctgagaaccttgcacatgctcaaacattagtggagccgcacatgcaaacaacacagaatataggtttccgaattatctcttctatagacttgttaggagtaaaaaatgatgtacatcctatagactgatggccttcaaacaacttcttttcattgttgtgtatgacactatactagattttttagtgagcgtaatcggtagtcaagttcatgatcatgttttgttgaactgatgcacctcaattcacttttaaaccactctgacttgcattctttttttctaatgctaaagaaatcggttcctgctgccaaagcacatctcaactctctgaaaaaaagcaccgatgtatacgcatcggcaatagctaccaggagtacccaagcctatagagtttgcagagacaccatccaaccatcaatggccaaggcacaagaatttgcagatcactattggcaggtagcaatgcacacacccagcagccttttcatctcattctgtggttaacctactaaagtctcgctcaatcactctgaatctgaatctgaatgattttatccttctaggaatccaagaagttcaccacaccatacatcaccaaggttgtcgcagcatctgaacctcgtctgtcaagagtatgtgccgtcctcgaaccttacacgaggcctgtcatatctgcttggagaaagcttgttatgtcagcaagtgtaccccatcgccaggtaagcctttctaaccagttaaccctctcacaattcttttgctcatataactcagggatcttgtcgatgatgctacacaggttcagaaaggaatcaaacacttcgtaaacgataacgggctgctgaaatctgattcggccgacaggttcgcatggttcacggtaagcttcttcggtagtgtaatctccctcctcaattacgcatcctttggaacacatgaattttacacagaattttgttcataccatataaaaactctcaataatccccccattccggggggcttttgccatgatatgcaactctcctgcgcattcttggaaaaacaaaaaaacaaacagaaattagtttctcatgctcttccagatctcaccgttttgagctgtttacactatgcaggcatcagctttggtcgctctaccgatgttctacacctacaagatgctctcagctgctatatggtgagatgagacctaacctaattgtcagtgccttcctaactgaaccaacattctggagtggtgattcgactggttgccggtttagctaactgatggcgctgatttgcaggaggaaagctgtggcagcacagggcagtggcggcacaagatcaaaaaaagcctcgaaccgcaggcgcacacagagagtggacagctagacttctagaagtgttctcaagttgagacattagtactgggacatgcgtttctaaaggcataccgcaaaatcctttatattttgatatgaatatataataggaaactacggatagactgaaatgcacgcataaatcctgtacatatgacgttcatgtgtcatggttgctgttaatatggtctgacatggtgtatatatggatttgattttttttttaaaaaaaacacactgtacgcagccgccgtatgtatcatatatacgcataaacacgtatgaacgtacataacatatgtaccactatgtttttgaagattcgactcatatattttaagataatgaaattatcgtatttatctcgttgtcgatgtatatcatctatcactatcactggaaaaatacggatttggattttctctgtctatgataataaggttttggtttgtttctaagtttgggctcgattggaatcgatcaaatcgaagaagagccggcctcacgcgcgcaactacacaagaccaaggacgacgacggggtcaaatgcgttctgttttggtgaaaacggaggggatgatggagacaataagaatggatttattggtaggaatacgtgacgtgatattatagggacactttgagattgtctgttgggaggtcgtttgttttttttttcctttcttgggtttttttccgtcaaaacagttttctatttttagaaaagaatatagataaaaaagaattaggaaatatagataaaaaagaattaggaattaaggatgcgtacgggaggatgggttatattttttctagggtaaattggaaccatgccattataattttgcaaagtttgagatatgtcatccgtatctcaatgacatgtagaacccacatgagtcaatgacatgtagaacccacaatgggtcagtatgacatatctcnaattttgnnnaattataatggcatggttccaattttccttttttttaacacctaaaatgaaactgaattagcacatgattaattaagtataataaaatacttaaaattaaattaatataatttgttttcagattttctataaacgattaaacgagagtcggaaggtgcagcagagaacggagccagagttttgtaaaaaaaaaaaagaaaataaaatctagccgtcatatagtaaaatacaagaggcggtttttttatttccttttcttccgtttactcgtcgcggtcgcaggggcggggcagcgttgccgcgttcgatataaaccctccccggcagattcgcgatcggtttccgactcctctctcgcgccgagcccgagctaagctgcgcgccattgtagctagctttgatcggcgtcggcttgttggggggaaggggcttgtgtggatctcgcggcggattcaccgagcgattcgcctttttttccgtttgatccgattcggttcggttcgatttcgattcccatccttttggtcgcgggttctgggatctcctccgcccgcgcggcgtgcggcgtccgatcctgcgccgctgccccggcggccctcccatctcggttcgaattcgagctgaaggtattcgttcgttgttcttctctcgtagcccatccttcccctccctcccctccgcgctcatcgtgctgtagattttgatatccatctgggcttggattgagattgggtttatttttttgccccctccttccaattattaaccttctgttcccgattttcctgtacgtggtgcagcactaatactagcaatttgtaaatttcccatgtcaggtccgctccttaatagtgtgttgttttttggctanagcttatcttcttgttatgatagatagcgcatgccttcttccgtgttggatcataaagatcgatttttttattttttatttttttgctgtttaagtgatgcattcgtcataccttgtcgttcttgttatgtttcttgttatgatctactagcacccatgctttccatgttggaccacaaagatccttttttttttactgctgtttaagtggtacattcgtcaaacaagcttcttaatgttccaacaccattgagtggagcaaaaaaaaaagaggttatcgtctgttgaataccaaaactcatgtaatctgatgcccctttactgttgtgtcaacaattctgaaccaaactgtaactagctttcatcggtaaatattaataagacacaaaagatggagaaaaaccagacaaagtatctcccatctttttgtaacatgggaacaacattttcacaatagcaccttttattcattttgcagaagaactgatagtagcaagaggtgtcccccctcaattctagctctgaattgcaggaaaagctggtaaaatcttagggtaatgggagtcaagccttcacagtgaagatttaatagatgaaggcacaccaattgtggcagttacctatcaaggatatgaagtctgctcctctccctcgcggacgaacttctccgaaaaaacatt

SEQ ID NO: 60932 - DNA, 1420 bp, Oryza sativa
gccaacttttgttttttgaacttttaacttttaaaggaataatcctcaagatttccttttttttatggaagttccttaaatatctttggttcaaagccatttcaacttgagcaaaatagttaccgttttgatgttttatctttgccaaaaaaaaaagtggtttgtgcctatattttcttttattttgttttgccaataattgttgtcacatgaaagaatgcatttgaacaactgttctaaatatttcagtggttctcagtcaagcgtcagcatgcattgatgataattgcggacagtctttactatactaagttcaagcttcattgtaaggtaaggtcccaatttttaaaagcgtatctgcagatattgtcacataagcctattaaggttggaatatatgcactgtgtgctagacttgatttatactatacaattttgttaaacttcagagttatgttccttatatctctgtacttattcccctgtaatttgacctttgatgtttgtcatttagacgttatagtgtgttattttttttcttgagcagttatatatgttattgaattatcttttaccgtgaggttgcacttaatattcgtctgtgcaagttttgaatctaaaaggcaactgttaccttttataggccctataggtgtttgtgtgcatctgtgttgatctttatgaattgctaagaattattgtactttgataacgcagatggatttttagtgcggctctttttccatagtttaccataataataacttagagactctgtgttgtctgctgcaaatattggcgccgttgtgcaacatgtctgatgaatgatgatctattctttgctcttttgcagcctgggatggaagatggtcgcaactgctatgctgacgagcattatttgccaacactattccatgtcagtacacaaattgacttcatatgatgaaatttaaccctgttacatgttgaaaaattatatatttttttagtaaatttaaaaaactacttcctccgttttaggttttaagatgttttgactttggtcaaagtcaaactactttaagtttaactaagtttatagacaaatatagtaatatttacattacaaaatttgttttattaaattaataattaaatatattttataataaatttatcttgggtcgaaaatattactatttttttctataaacttagtcaaacttaaaacagttttgactttagcccaaagtcaaaacatcttataacttgaaactataacctgaaacggagggagtactactagtttgtcgcatcaatagcatctgattttatcagaatgctgcaattttctatatttgacaagtttgggcccacatatcatacacaaataaagtactcatgctgttgcaatcgggctcatatgtcatacacatgtaga

SEQ ID NO: 60933 - DNA, 25842 bp, Oryza sativa
  unsure (1)..(25842): unsure at all n locations
gggagtaccaattaatagctttaattaaccaaataattacagttttttgaaatttactctatttttttaaaggaatgagtaattacatcatcccgtaaaatccactgcagcctttttatattgtgtacttgtatttgtgtcaaccagatgatagatccaaatggaattgccaactggtctgtgactcatgttgactggtctgaagggaagtggcatccgaaagcttatcgggcaaatgatgttacatacgagcttctgaagaatataacagtatgttcttcgtattactgtttatcattaataatataatagcataattcataatcttacttttaacactgtgatctttttctttgcagtcaattgacatgagctaccatatcaccagcgatagcaaggtacctctctctctctctctctctctctctctctctctctatctatctatctatctatctatctatctatctatctatctatctatattttgtatctttattttgcagtcaattgacatgtgtattagctttattttatatcttttgaaagtcatatattttggtagttaattcccatacttgttcattgatactttgtctatgacttatgatccacatgaatttaggctattttacatatcgacagtaggaaggtgttatctctagaaatggctatgtgaaattgattatgcttctgagcacctgagatcgtgttagttacattattaacctagtgtaaatttgtaattgctatgcaaaattagcagtttctagaaaaaagggtgctattcccctgtggttctctagtcctaaagtcagcaaaccaccaaataaagatactcctactaggcttgtattttttttttagataaatgccaatccactgttcaaatgatctctttccttccatcttccatgtgtcaccgttctctatatgaaatacatttttacccaacatactttttgtgattcataaaaggcactaatgcattttgcatgcctgtgcagaaagtggttacgcagaggccttgcttatggaatggagtgaagagaccgtgttacttgtttgcgagaaagttctaccctgaatccataaaccgcctcatgaactcattctcaaattacacccgtttttgagttctgcagagttgcatgggtaccctacactaaaaaaattcctccatactagtggatatataggagatattctgttacaggaatctttgtaaattggaagagaacagcagatttattaacaatagctggtataggaatagggagaggagaaggcatacgccgcagcattagggtggttcagatctccacggtcaggccattgccactcctgaatacaaatttctttaggttcaccttgttttttgctagcctatttctcttgatttctagctgcagattctgtcatgtacatgaagcttattgtataactaggggagaagtcattattgaggcccatttttattgatttatccataaagctttggcaaacctttgtcttatcccaattgttcatgtttcgcgctgactcacacattcctacgctttctaacgggatgattggacaacgctttctaaccggatgggtggacagattagtcacgattgcttaaaaataaatcaaatattgggtataaattaaaaaatagcttaaaatatacctcctttattttttaataaaataagtcgttgaacttttttcttcacaatggttgacctncnnnntattcaaaaaaaattacgtaattataatttattttgttatgagttcttttatcactcatagtactttaagtgtgatttatatcttatacatttgtataaaatttttgaataagacgaatggtcaaacatgtgagaaaaagttaacggcgtcgtctattaaaaacggaggtagattatcttgattatgatgccgttgactttttaataaacatttaaccattcgtcttatttaaaatttatatacaagtataaagaaatttaaatcatactcaaagaacatttaataataaatcaaatgataataaaataaataataattgtatttttttaataagacaatggacaaccatatctaaaaagtcaatcatacaattaaaaaacggaagtagtgctatgtattgatgtaaaaagtttttttaaaagaaaaatcatactttagtgtagaacgaataatccatatatctataaattaattgaatatctcgtggcatgctccgagctccagttttttctttaaaaaaacagggaaatgatttcaaattattcagaaaaaaatctgcatgaatattcttttttttttaaacaaaagaaataggcaaggcaggcttcagctatcagcttatcaccacacacagacacagaaggaaatgtcggcttctgcggcgcccacgcacatccgcttctcctccgccgcacctccatcggccgccgctctccggcggcctcgccgccggtgcgccacgcccgtccgatgctccctcgccgcagcgccgggtctccgggcgccgcctgagctcatcgactccatcctctccaaggtgatgctgaaacatcatctctctgctcttcttgggtgcactctttccggattcctagcttctgctcagtgctcggtttatgcaatcttgtactccacattagaacacatttcttgactcagaaattaacgagttctggtgttccatagtactaattttaacctcaattagttttttcttatcttacaccaaaaaaattcggatttttgtataaatcctggagaatattccttattattggtttccaattacttacctttttccttctgtcattttcagtttcttgtatatatatattttttatttatcagactcgtgcaagtaaacctccgtcagcaattcatcatgttaatttgatgtcttaattgccttaacatgatatcaacaggtgaagggaactgaccgtggagttttgctgcccaaagatgggcatcaggaagttgctgatgtcgcactacagcttgccaagtactgcatagacgatcctgtcaagtctccactaatatttggaggtattgaaagagtgaaattgccccaattctccaaataatatctccaaaattgattgtgtcactgactgacaaccagtaaagtaacaacgagcattacattgaggtttgggttgtattacaacactgtaaacctcatgccatcctgactaattttcttgcttattgcacttgacctgacctaccagagtgggaggttgtgtactgctcagtaccgacatcaccgggagggctctaccggactcctctcggccgcctgatattcaaaaccgatgagatggctcaggtggtgcaagcgcctgatgttgtaaaaaacaaggtgtccttctctgtctttggtttcgatggtgcggtatctctgaaaggtaaaaaacagacaccatctgtcaactcattctctattcagactgggcgtgacaaatctgcacagcaatactgaatgtgatctcatgaagttcttgttatgttgggcatgacaggcaagctgaatgtgctggatggtaagtggattcaggtcatattcgagccaccagaagtgaaggtaggctccctggggtttcagtatggtggcgagagcgaagttaagctggagatcacctatgtcgacgagaagatcaggctgggaaaaggatcaagaggctcgctcttcgtcttcatgagacgatgatatgagggcagcaggcaatgtttgtaccatcatgtcctttgagaccacaagagggtagcaccatagcactgatgctacgacaatatgtttgtgtgtacaatactgtattctgttgtaaaattcagaggtcatgttggctagtagtgttcttcagacctccgaattagagattgtattgtcatttccaatcaaaatgacaaaatgtttgtagtttttgtgattaatgtgatggttaaattgtccagactaatgagcatggttatggatttttggtgaaccctgcaatgaaattgctgctcctagtatatactgtatttgccagaaggtttcaacatttttgtaggcaactattggtaacggaacacttttggatctacgagcaccgtcagatctcaattaagaggtcaagattgttccaaacttccaagtgcatcagtatagcggatatgccgcctccggcctgcagtaacgtactctatggagacagaacctgtacagtcgaaaagtcgcctctcgagaaggaaaacgccttcttggaaaaaccgtcttgttcttctcctcatccacggcgagggggcgtcccctcgagctcgcgggtctctcgtctcctcgatggcggtgtcgccgtggagctgccgctgtggggtcagccgctcccccggaaagagcagaggcgcaccggcaccttcttctcctggtgcagtacctccccgctccaactttttcttcaccattttgctatcgcgagtctaagtgtctaattgtcctagaattcctatttcttagattgttttgtgtatgcttaatttatcatggattttgtggtggttttgataattctgagctaaggttcctactcttactttgggtgtgtgcagacaagagatccaagtactcggcacaatcagtggtaaggagtgcaaaaaattcccccctttgatgttcgtttcttctcaattataagtatttagttttcgcttttattggtcactgcgtacttgctaattcctcgaaagctggaggctgctggctgatcttagtggacatatataggcgagaacaacaggaaactgcttctgaaacaaggattttgtatcagtagattcagcactatatctgaacattttttctgaaagtgctttccatgtcacagaactaattttcccatcaattaaatgaattagagaaatctgaaggggttgaaaccttctgccaaatacatagttttcgtaatatattctccatatgaattgcatagcaaaagcaacggatgaatgtctaataatgtttggtgtttgatatctcttgtggtcatgtttgaagagagcaatgcctatgcgtgtgctaacagttggaaagaagaggtctcgaggggcacagctcattgttgaagaatacaaggagaagcttggttactactgtgatattgaggacacacttatcaaatccaacccaaaactcacaaggtaggatactctatagtcgattcatattcattcccaaacgctgtttatattgtatagtcctagatattagtagaaagggttttgattggtagctttacacatcattccattgacgttggtagaattgagtttagttctctcaaagtcaaatatattttactggagggagtagttattttttgttaagaagttgatcactgatgctgacctctgttcttctttttcctttcagtgatgttaaggtgcaagtggaggcagaagacatggcaatgatgctgcagctcaagcctgaagacttcgtatgtttcagtacctccttatattctagagatcatatgtagttcatcttgtagttttcgttatctgtgtattagtggtttgacattgatgtgcatatttaggtggttgtgctggatgaaaacgggaaggatgtcacgtctgagcaggtagctgatctggtcggggatgctgggaacacggtacgctctgtaccttgattcataaatttttatacatatttgtgttaaaagttcaaacctgctggaaattttgagggataccatgtttcagtaatgtgtgttcttcaaacgttttaggggtcgtcaaggctcacattttgtattggtggaccgtatggttttgggctacaagtgcgagagcgtgcagatgcaacaattagactatcctcaatggttttgaatcatcaagttgccttgatagttctaatggagcagctctacaggtgagcaatgagcctctccatccatcaccgaatatgctttgataattccaatggggccactctttagtgctgggtaatctacgcaccaaatggcgttaggcaggtacaaccatggaacattccaaataagatagatcgatgtaacacatgatctatctgtgagtaatcatgttcatgcatatctatcagcggatagtcctgttaattctgatatcaactattcactaggggtcatttttttgcagggcatggactataatcaaaggacagaagtatcaccactagccactagaattgagttgcattggcgtcatgttgcgcacttgaacagatggaaaattggaagtgcaggacatggagatcgtaattcataaacgcatcagctttcaggtgtagactatagtggtcatgaattcatatttgtattagcattcatcttaagaccactacatgcacaaaacaaattacttacatatttgtctgcttggtcagatttggaggcttggagcacacggcgcatttttgcttggtgattcactgattctacaacaaaggcacaccagagggtcgaacattggttgtaatcaatgcagcgtataggcattgtagtccgtagattgtatagcgcagagatctcccatatatcaatttttcagcagtttagacaaatctttgttctgcttatactcgcgaaactgctattcatgtacaatgctttcaattgcactccaagtgagcacaaagcaacgaaaacgctttacaagaagatcaacagacggacagtttacagcatttcactatgttccaccgctcagtgcaaaatggtggctttgtgttagtcctgaaagcgaaaagtatgttataaaatcgagctatatcatgtttagcagaatttacaacagaagattatagattcttgtggtgagtagcaaatcaaacctcatacggtcatatctgctaggacatgacaatcaacaaccaacacatacaaacagttcaatcacattttacatacggtctgttgacggctgcagaatatacatacttctgcccatggaaagacccaagttcttcaagtcatatatagtcatattattctagatagtgaaagtggtaactcccagcaagtcatatactcatgccgcattagaaacaaaatataacaatagcacttggaagaaaacaatattaacaacgccaccattttttgttctataacaaactcttctttgtgctgctttgtaccatttttctgttcacgcctatctcacaataaacagttacattgccaatggaagattaggcagtgatgggattagctctagtcattgtgctgaaagccagggagaagtgatgcaacaaaccctacaacaatcaattggacctctttaaagacgcctccaagccaattgcgcctgttcccttctccatcgacttcttgctggttctcattagcagctgctgcccctggttcctggttctctgcagcttggtcattgtttgctgggtctgcaagatttccccctgagaagcaaaatgatattttataagaacaaacatatattgtcacttcaaaaagaatgaatattattttataatgcctgctaaatgtgaaatatcactagatgctgcccgttaaatcttgaatgagaaatataacttctcaatattgcctgacaatcagaaaatagcctggtatattagactaggaatctaggaggcaccattacacaaaccaagggatcaacaagacaggtggactaaacatccatcctattttaagtatttgtaacattattttgcaatatctatatgttcttataccatccaagtttttagaagtgctttaaactaacagtataaacctctattaaggatttggcagcagtagaaattttttttacaatgtctacatggtcaaacggtgaatctggtggttgcaatgatgcagtaggatatagtacaatattgaagtgtagtttaagatatctaccaggcggttgaacattgccatcattctgggcagctagcggagcacgattctctgggcgagctggagcctgtggaggacgagcagcagcacctcctgctcgctgcagccatcttagtaaaggtgtaattgcgccagtttgatatctgcaagagatggaacaacccaaatgtaacgacatacaatgaactaaacaaaacaagtcaaaaaaagcgattgggcaaggaagtaagcagggcactcacaagtaaatcactgaggcaaacagtatgagaagaaacagcctttgttttgatccttcctggctaaacagaaagacaactgctgctaacttgatgatcagggccaagtcaagctgaaaagcaaagtgaaacctcctcacaacaacttgtctctgagggccatgttgttgcctagcatcctgtgcttgctcttcaccagccacagcaccgacactttccctaacaatacaaaggatggtataagcaaggaaagaataaactcactactaactttgtggaacgcacattaatgttctgcaccatttctaggaacccccaaatcagcatgataaggcaataaacatattatgaaacagcaaaggtttagttgttctctcaaaaaaggtacggagtagattttaggattcactaacatgggcaataaatttaaacttttgagctgtcactcattattaaccaagtcagatagtaatggaaagttcatggcatcgtatagaaggcaagaatgtatctacatttgaggaataaggttaaacatcaatatctcattttggcatcaacatatctaataacataaggcagatgaatggagttcttcagcatgtgctgtggttcataaccacagacgcatgagcttctgtatacaaatttgctgagttgggcattaatcaaagtaaattcatagataaagcagcatgacatataaggaactcatgaatattttcgtcaattcatgggttgccaataggacaataaggtagatgaagtataatttaatgaaaaccttaagatattgtcacccgtgaaaagagctttgtgtttgtagtagtcgctgctcttactttacttacaaaaagccctaccgaaaaaaaaaactaggcatcccgatctcaaaaccctttctaattttgttccagatttcctccctactatcatgttgattatggtgaaggcatgtgaaacaaatgctcgagattctaggcagtgaattcgtatgccgtaacagattgctcaggattaggaggaaaaagcttacgttggaatcctgtaagtgagtggcatgagagtactccccatgaattgattctgctgtatggcatagatccctggaccctgagcctgatcatccaggctctgctgaggatgcatacccgtcataagcatagggtacatcaccggaaacatcaaaggagccccatttatagcgccattctgcattatcatcatcagcagcaacatgaatataatcatcatactagtcaataaccacaaatatttttcccccgatacaatagtctctaccaattacatcaaaacgatccgatccgagttgcaagaatctaacacaatcggagactaaaaggggtttacaattatgcacccaactgcatcaaaacctcgaccaaacttccaacttggacgagccaaaacacccataagaacccccaaatatcccacctttccgacaaatcacctgtcatataatcccaactcccaccaccaccaccaccacccccgaatccccactaaatctaggcaccatcgaacaagaaccggtcttcccaactacagttccacgcggtgaaccccagacagaaaagaaaagggaaaggaagaagatcactaacctggggaaacccgactggttcgccggccgtctcccccgccaccggcgccgccgtcgaggagtgggcgcggctctgggtttgcgcgtcggcttccgccatgggagacgccgcgagagcgagctcggtgttctgcgggttcgatctgacccacccaaaggatccacttcttctgtggatggacggcccagattccataatccacgtcactggaagaacccggaccgtccgatcaggggagccgggtagactttcacgtcgcttgaccaatttctccctaatagccactgaccggtgggaccaccctttcagccatagcaagcgccatccatttggtcactgacatgtgggcccatctcccaccggatatatcttcttcgtcttcttcttccgggaaacagatcccttcactctgtgcggtctgcagttgttccactgacttgtgggccccacttttgtatgacccacatgtcagtgacactgcacatagttaggggagtctcttctacttcttcctcctcttctccgtctcgactcttccatccgcggctgcttctcccgctctctctctctctctctctctctctcagccatggctcgcctcctctcgcgaaccctagccttggcccgcgcggactccgccgcggtgccctcctacggccgcctccatgtccgtggtgtctcatcgaaggtggagttcatcgagatcgacctgtcgtcggaggacgccccctcctcgtcgtcctcgtccggcgtcgaggggggcggcttcgggccgcgggagatggggatgcggcgactggaggacgccatccacggggtactcgtgcggcgggcggcgccggagtggctccccttcgtgccgggaggatcctactgggtcccggagatgcggcgcggggtcgccgccgacctcgtgggcaccgccgtccgcagcgcgattggcgccgcctggaacgcggaggcgatgacggaggaggagatgatgtgcctcaccaccatgcgcgggtggccgtcggaggcttacttcgtcgaaggtgagttgagttcgatcgaattaggcaattagcatttctggattgcgaaatggaagttgtaaaggtatttagcattttgtttggattgcgaaatggaagttgttgcgttgtttttctgtaagtagccttggttaggagcaaaccgcgggtgtttgtttgattggtgaagcattggggattcatgattgtttaggttgagagtatagtgaatagttgaagtatgaaacaactgtacatggattaccttcccctcatttgcaggttgaaattagagtattacggtattttagtagtttattttggctttggagtgtcatgtatgaaccatggttctaatagtttttggttcatcttactagtactccttttccttcatgagcttgacaggaagaaaactctacacctagtttggcttcgcaaatttgatccacaactattttagtactagttaattcaaaacaatttagacagaggttccagtaaatcttccatccacttgattcatgcagatgctaaacctggatttctctgcattaatatttgtttgtgagagttactaactaatctcaatgtcagttatacataaccatatcatgaggcatcagaatttcttccttccaaatgtagattctgtaattacctcagtaacaggagcactcagcttgttgttttggcagaactgaacttataacaggcactttctaatagtttgtacggctgtacgcgatgactgacgagttaaaatgagcctaaagaacattgtgttggtaagtttaggttgaactgattttagaatttatgactgggttgctacatatatagtttgggttcaattgttcatgccctatatgattcgttttcttgcaaatattgagtgttcatgccctaattgtgcatggtctagaatagatagaaatactgagttgctaacattatgtgtttcagattgtcttgaaccagcagttgttgggtgggcctcatgcttggggagttttgtgtatatgggctgagtttacctatggctgggttgggtagatttcaggttttcagtttatatcttctccatgtgtgtacattgtgaacctttagtattggaacctaaatgatttttctctacacgtagcattatgttgaatacttcctaatcagattaattacttctgtttaaagggaaattttctcatccagtggagagttcaagaaaagttgctactcaaactgatgaagaggaaagctaatttgtttgcatcactttagcaggggtaagttgtttcacattctccaagaaaatgcttactatcactactttctccttgtcctatactccaattgttgtgcatttgtgatatgacttaagtaaaattgccatatgcaccagcacctggcattgcaacagtgttgtttgttgtaaaaatgctaaactatgttaagtgttttaaagtagacataacagtacagaactgttcagcttggtggatacgtagcccaatagcgtgcatttacaaccaaataaaaaagaggaggtaacttgatgtgatattactgttttttgtgtggcaactggcaaggccccttgctgatccagactccaaattcatgtcccaaaacaccttatcccactatacagtgtgcacctggagttataagagatcaggacatgaaatctaacattctaaactgcatctggaataagctttgcttatcttcaacttcattgaaagacaattctttcaatgaagttttttttttccgtcaaaaaaaaacttcattgaaagacaattctgagcctggagtgtttatattgtgcagaccccctgagaaataggaagcttggagctgtcgagttctgctgatgttgtacatacagacagctatgaacgtgagcaccagcgtgtcatctcatcagtcgcttcagaagatgatgtgcccagtgctgttactactatcaaaatgccatgaacatggatccgtgtattcctgcaacacagtgccttgcgctatggtctttttttctgagagcttgtacttgtacctgtagaatgtagtgtatgcatcaagctgctgctactgaataaaagaaaaaagaaaaatatatgttgtgggttgggctgaatgcctgtaccccatgagcacaggatgctctcgatcattgagcgtgctgtgcacgtcgtgggcctccaactaaaactgtaatcatccttgggcagaagacggcagaaatcttgaactttttgttttgtcttgttcttcggctgataatgctgcttcttctgataacaattgcccctggaaatgctaatatgtaagaagagcactgctatacgtactaactttctttttaacataactctttacaaacaatgatatgagctgtttgatttaactagatggaagttaagcaagatgtattcacatcatacatgtagtgttagtgaggaaaaaaaaagtatgtatggactttttcatgtaagaaatggcacatctattttccttgaagaaatggcataactcgtgacacgtacatgctacttggcccggaaatggtagagcttagtagtgatgtagattgctgaatggtgggttaagagttaagacgcaatcgtcaagaggaagttcgatcacctcttaatgaaacagcatcttgcattcagagttctgacgccacgttccactgaagaaaatgacgctagctcccaactccaacacccagctgctccactcgaagacctgtactgattcttgcagagctcaccgggatcgtgaaccgtcaactaatcgaatgtgggttcgttcgtcaggtgtaaacgtcgcggttggtgccaaggccggtcggcgctgaaataccatcaaatacgtagtatgacggtgccgtatgaacaaaaatacatcatatgtccttgctaactctcacattaccagcattgtggtgttacatccatgtcaattgttgcttggatatcaatcggatctcgtgtagttgtgtaattatgagaaacaacagtgtcatccatctgctagtctctccagcatttctcctttggaatagctcatgcatgatgcatgcatcattgggcttcccataagagagctatggaagctggcgccatgttcgctcacagtaccgatgcccctccctttttctctttagtggttgttggctgatccaatcatggaaccttcacgttttaatttgaaccgttttggaatgtgaaatacaaaagcaaaaagatttgaaaagaagttcaggcaatggaaagagacatgcacatatagttctattatccatgggccatacgattgagtgcattgcactaccatttgcccaacgttctcattgcgttctttgggtttttgttcagtgttcacaacttcacatcccccaatagatcgatagatgctactagtacatttttttctattggagactacgaacttcacagagctggcaacttggcatatccaaatccaatgggctatctttcactacaaaatttgaatatttgtatatgtgtttatgcctgcacattcggtgaaaagtccctgtttccaatgcatatatataacactcatactaatacataatgagttcatccccagtcaactaactcgtgtgtcttatctgtcttttctccaatcttttttctccccctttgggccgcatgtgccggagggagactctgttcgtttgttaggggatagcgaaacagattgaatattgcacctggcagctgtatccgtagagccatcgttttctcactaccaactctccgacagtttagtctaatctagtttagtttttatcattttttttcttccaaacagtttaagaaaacagcgaattgtcacactgagttttgtaggtgttagttcaaaatttaagtggcagaaattatatgactgaaatgaaaattatggagggagtagaattgtgtctgaagtctgaacatgtttgtgatatcttcagaggcctttatatatgcccaactttgagaatcatctgtgatctgtccttttctggaggtaaccatcataatatttcacaccaacaccagatcatcgcatcatgctctcatgttagggctttgtctcctcccctgttctattgcagggcttgataaaaataactgcactgaacttatctcaacagctgcatacttctttctgagtttttgatctttgagaattggcacagtaagctggctgcctttggccttttcttccctgacctttcttcttgtctgttggtggcctgatcctccggccttcaatttatcatgccatgcctagtgtctttgcgtagccttaacattatccttcaaatttttcataaaggtgaaactgtactcggaacaccttttttcctttcgattcaccatcctcaaattattaggggaaaaaaaggagatccattgatgcaatatgtactaaatgaacaaaaaaaaaagcataactagctcagtaactaggttatcctacataaaccgaggttgcaggatttggttgtcacgacgtgccaacattgagagtaggaggtgagggagtgttttatctaggtttatgggtagtgatctagtcgacggattgatggttccttacatttcttatatcatttttattttagaactcgtgggtgtgagcgtatttgttcgcattctagttatgcatatgtcacgagtattttcgatatatttgttgtatcaacttaatgtaattgcttgagttcaataaaagcttccatatatcttgaaaaagaattaggtagttttgtttatgtaaaactttggctctaccatgtgccaatcacggtgcatagtttctggggaagaaaacgtatcattaaactgatgttttggccggtcatagactaaatgaatattgtaatctcttcattgtcggtgcatgattcaatattgctcgatgatgaaaaacgtgtgatccggtgattccttctgcacaattgtcggcttaagccaatatgtcctaattttcatataattattaagagaaaatttcagctgtcggtccttagattatttctttccagtttgactttcagcatctggtgttctactgttttctgaactttagagaagatgccattaactaccaattgcatacctagaggaggtgtcttacagccagattttatctcattttgttgatacaagttagtttcaaatacactgctagtttggtgataatcaccctatcgatatacaataatcctgacaaagggaccccatgatgagatacatttgcgtcaaatctgcatatgtttatctagattcagcaaaacggaacatgcatatgcaattggtcatattccagtggctggaattaaaatcagatagaccatgcagagatacagtagtgtaaccatatcagtgctagctgctgtgcatgtacactgttaggatatttggatgtaccaaaatacaagcccatgatacgatgacccacctacagtgcccataacgtggtatgtcttgtccgagcaatgtaactagaacaaccgtatgcttattaccaagtggatttccctacatttatctcaggtagaaattttatctcatgtaactagaacaaccatatgctattttttattctgtgcgccaaactagatttgtcaagaaactcagtggtgtgagattaggtacacaatctcaccacttaagttcgctctttgttgaaaattatgatttctccctctgttccaagaaaagtaagattttctcgcgtttaaaatttatcccctaaaaagttaatttacaatccttacctactttggttcacaaatcaagaagtattaaacaggttttattttttcaatgcccctaatctattcaaccgacaatactattttccttttagtgatggacactttggtctttatcttatattgtactaatttgataactcttttttggtgacggtagtatagtaaataaatttcttatataccactaaaattttatttatcctcttgtttaccactcattctctcaatgaagccaatgacaaacaaaaatctacaccaaattttaagcagcaaaataaggaagaacatcgttgttcgaaaatgcccccggacaggcattggatgcgtcttgtgtgttgtggccgcagcacaaagccagaaaaggctgacgaatctgaaaactttggcacgttagctgctagcatactccgaggttccattccagctacaatagccaaactgaagatcatctaaccagatgtgttgtcagacacaaggaaagttgaaacaagatctcctgagggccacaaagcgaaaagtgcccgcaatactcctacctacactggatatatatgatcataagaactagtgctcctacattcatgcagttttgagtctacatttatctgttttctcaaagaacataataattagaaatgtaatagatcagtaaacaaagatgcatcgatttttcttttgttttaaattttatttattttagataatggataactggtttctacattcaaaatagatgtatacatcatgatttgttttaaattttattttttgataatagattaaaacctggcctctacatctatgtacacaactaatagtgtcatgatttgttttttttataatggataaaacccctgcctccacatccaatatattgtcatgatttgttttaaatttattttttaatatataatggattgtaagtttgtaacccggcttctacatctaatgtacacaaccagtagtgtcatgatttgttttaaatttgatctgtacgataattcctgagatctgcggatcagaacacagctagtttcatgattcataatgagttaaaaaaaacttattatatataggtttgctctggtccatcagatagtaccttgcagtactggtaccgcatggtaccgaaatcatccctgccgttcgctcgcaaggggcatgataggaacctgtggaaacgcaccgctcctgcaccgtgtgtacaaccaatcccctcgagcgttttcctttctctcttccccgaagcgcaacatcgtgcggtgcgactccgctgattcatcccgtggagatgcgccgtcgccatcgttgttgccctactcgtcgacggcgcagcggccgggggacggggagaagaggaggccccgtcaacctgtacgcgaaggggtccggctttcctcgacgctctcaagccatctggtcctcggcgccgccgtgattctcgtcgtcgactgttgagattaatccttgtgtgctagattagtgtttgttttatttggttagttacatatccattgtgtgatcatgcatgtttcggcctgattggaggctataatttcctttccttgtaatcgcatatttaagcaatacaagagtcgggaaaaagctgcctagttagcagcaccaaacaagatggtgttcattcctatgttcgcgggagttttgtgtgtgtgttcttgccggcgacgtgagttttgtgtgtgtgttcaccgtgagcccttcgccttgacggccggaggtgttctcaacggcagacgcggcgccgacttttccaatggacgctccgacatcagccgctgccgcttccgccttggagacgagctcctcctcggcggtgccgagcttgtcgttctcgacgcggtcatctggggccgtcagctgcacacttctcttctccacgctggcggtcgccgtggggaaaatttcaccggtgcggagatggagatggagagagaggcggcgtcggacgaaacgatcaaagtggataagacagaatcagccatgcgaaaatacagaaatacccttccacctccacatcctaatacagtgccactacaaggacgagttggtacctcgcggtacctagcgatgacagccgttggatcctatccactcaacggtgacgatttgataccgctttggcctgctgtacggtaaaaaaaactctattatatatgctttattagtagtgtgcggctctaaacaagctagttacctagctattatgagagatcttaaaaaacacaagcacaccggccgattgatgattgtctccaccaccttacatgttggaaagcctagcattgtgcaaaatcttcagtccttcaaagctcacaaacaactcactttgtcagtttatttgtcttaaccaagaagccaaagataaactttacaaatctctctctctctctctctccaagatatactacattactacaggacatacacatgtacatacatccctgtgatgatcttttgatgcaaatgaggcatgcagctaattaacaaatacccctaaaacacacatcccatcaaacagcatgcagcgagccagtgtcagtctgtcagagcatgtatgtgttgcatggggctactctaattaactagctagggctacccagttagcaaattaattagttgatgaataataatagtagatgatgccaaattaggtggcaccaaccaggcaatgcatgcatgagatgagagaggggccctactaaaacactagcagctcagttcagctcagctcccctaaccatgtgggctttgagctcactaatcaccctgtatcatcatatcatgaccgtttggggatgaagaggaaagaacaacaacccaccctgtagcatcacgtgtacacgtaccgtatttctggcggtcgacaggagccgaccgttggttaccagcacgcataattctcctccctctacctcttaatcatctcatctgcaatttggtgtcctcttaacacttgatctccatcgatcgatgatcatgtcgttggcaaccatacatccgttcttcagagatttgcatgatcagggcgggctcttatttgattcatctgcaaccatcgatcgagttcaggtacatcacagtacaaactgaagtgcagttgtaagatgtgatgtttttctccgagactttcagtgcaatctactcaaagatggcagtgtaattaagcagggttttgtactgcctagaggattggagttatgattaattcatggtcgcttgcaagcgattatgaattcgatgatcagttggacgcattggtacacgattcttaaatccggtcgctttctgaagcatggagcttggaggctggagcaggagctaattaagagcttgtttggtttagtaccctaccaaagtatttgtagtgccaaaacttagacatgttttggcactaccaatattttggtagggtagcattttaggtgaatggatttggattgatactaattggaagccaaattttatattatactcaaaaaagttctagaattatgtcaaattaatcatgggcattaccattcacttggcttcaaaccaaaccattacattcactattcaaactaccaaacaaattggtagggcacattttggcatcaatccaaaatggccctaagtttttttatttttttgtgtcagctggaggttgctttctgaatctgtttaatggcctcctctttggagagtgagagagaaaagaaacaaagagtagttgagacaagttgagttgctgttaggagttgtagcaggcactttgtgctttgtgtggcttcccttttgtagttttgccctttggaaacccccatattgggaacctgaactgaccacaggtccaggggcattgtggtcattcaacatagtcagttgaataattgatcgtgtatgccatctgtttgagcggtatactatgggcatattcactttgattaaaaaaaaaccttactaagttttggcattaccaaaattttagcatagttgctgtcggtgatatgggaccgggagtatcgtgaccagaggcttgaggcagacacaatcgcccacgtggcctggcaccttcggggcgtcgggcccgagggtgaggtgtccgccctcctcctgatttccccgagggggggggggtcgggtgactcctgccccggccccgagggccgaggcgccccgaccccgagggccgaggcgccccgaccccttgtggagttagcgccacatgaatgggttgggtgaacacggtgagcctcacctaaccacatttattgcggtctggtcgaacgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttctcagcggcccgaacctgtatacatcgcccgtgtctcgcgtttcttcctagctggcgatcttttcacataccgagagagcttgagatttcaccctaagcccccggccgaaccggcaaaggggggcctgcgcggtctcccggtgaggagccacgagctccgtcatctggcgcgccaggtaggggataccgctcggggggggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggccagcgagcgacaaaaagaaagaggctggtactcccgccagggagcgcccagccggcaagtggtgctccgtccacaacacctccctccacgatctcgcggactgtcgcgcagtcaaaaacttggctgagcgaacgaggaagtgggaggaggacaggaggaaggaacgccgtgagggcaagtcgccggcaactccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgtgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccagggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcgggccacctcgctgctgcgtccaagcccgagggtggtgacgagaggcttggcacctccgcccccaccgccccgaggcagcggatggtcacatgcgccgaggtcccggtcaagggggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgtatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagacactttactctcagatctagcggaaatttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcttcatttcgcgcacccccgccctgtgttgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaatgccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgcgggaaggccgctcctgtcatcctccgaccccgaggtcattggcacagaagacgagtgcgccccgagagcccacttggacgaagaacgccccggggatgcggcccctagcgaagaggatcggccccgccgaaaggtgcagcggtctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtttcaatccccgaggccagcacggacccctctcagctgcctcacaccgcccactgggtgatgcagttcgacggttctctgtctctccagggcgccggtgcgggggtcacgttgacctctccgaacggagacgtcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgaccggcccccgaggtccgtcggagtccaggcctcgggacccgaagggagcgctccaagctcccttagattgattgcttggatctctgagatccaagcatacctcacagataagactctacttgaggaccgtgaagggagtgaacgtgtcacaccccgaagttttcctcccaggccaaaatttgaattttcaaatgaccccaagaaaatgcaggtgaaatcaggataaaaccctaagaaaacaatgcaaataataatcggattggacatgtggaatttttcttgagttctacatgtcgaaattcattaacaggatttttagtggaattttcagagctcta

SEQ ID NO: 60934 - DNA, 18057 bp, Oryza sativa
tgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggtcgggtatgtgtcagatgaaggtttccccgaggagtaggcttcgtccgtgccatcgaggatgcctgtggagtggtgttcccgctgcagtttagtcaaggcttagctccagttatctttcgttttccgctgcatttatgtaagattttacaatgtttgtaagacgtggatctgtatgtcaacattgtcgtttgtgtaccccggctggtcctggacggggattttaatgcacattctgcttggaattctattcgggaatttctgagcgtgacaagttggtatcagagccaggttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtctagggttttagtaaaattattgggatttattcgtcagtcagttgggatttgatgggtgaaatgcattcggtcctagctcggtatcatgggttgcaaggtatttatgctttgttcgttactattattatgtatctaatttcccattattttatcgttatgtgagtctgtcttacttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgactttgtggcagagctggcacgtatgacactggtggtgggctaccccgacgcaccggagtacacgaccattccaccgctcagtggcgagcttcctcaccgtgtccgcttggaggtccatggctacgtggggacttgcctcgctaacatggcgggttgaggcatctggaggcacagcagatcacgcctgtcaggaggcagcctacttgatgatggccagactacgggagcgccacaactacatcttccacgacacggcgtaccgctaccaccccagtcgagccaacggtgatggcgtcagctccttccgtccgacagctggcgagaacgacaccacctttggtcacatgtgtgctgtgatgagaggattggataggatgcactcggacctgcacaaggcgaccaaggccttgaatgatgggaagctcatgaggatcgtcgctctgaaggacgagatagcgcgcctgaagaaggagaacgctcagctaaagggtctcccagcaccaggaggagtccggatccgcactacgccccgtaagaggacgactgcacccgtgcgcatccagcttgcgcccaggaacccacctccaccagcagctcccgcagctccggcagttcccgcagttcctccagctccagctccagctccagctcccgcgttcactctctccttcgctccagcatcagccgccagaggtccagccagtggtaccggaggttggttgtccgctactcccagtggcagcgacgagactgatctgtcaggctccaggagccgctcagagggaccaggtgacgagcaggaggacgctttcgactccaccgaccgcaggagccgttccgagcattaggctcgttttcccattagtttatcgattgtttagtttctgcttgttagtttgtgtgtttaggttgcttgtttggggtcagtcgacggtcgatatcatgtgcctatgatatggctgtcttaataaggatttttgcttgcctttttaagtgttttaattcagatcagaacaattgcagttttaattcctatataataaagcttagttcttgagcatctgtttttcttcttttccccgcctgctcttccctccagatggtctacaccaggactggcaaccgcacgacaggcgagggcagcaacggcgaagaacgcgctgatggcgtgcaccccaacagcgattccggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctacagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgctcagttcagggcacatcagggaagtcaccagaggccgcgcttcactcccgggcagcagggtggacctaccaccatgattgttcgtcaacaccgcccattcaaccccagcaacttccaccagggctccagtggcagccagaatcaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctcgaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcatccttctcgaatccaaagacctagatgtcattcttgggatggattggctgaccaagtttaagggggtcatcgattgtgcgaatcgcacagtcaccttgaccaacgagaagggagaaacagtggtgtacaaatctctagtctcacccaagaaaggagcctcgttgaatcagattgagacgaaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacatacttatttattcaaagtccgaggaagaacatgaacaacatctccgtctagtactcgagaagttgaaggagcaccagctatacgccaagttcagcaagtgtgacttctggttgacggaagttaaatttctgggccatgtcattacagctcagacgaaagacttccaagtctattgcgatgcatcccgtcacggacttggatgtgtcctaatgcaagagggcagagtggttgcgtatgcctcgcggcagttgcgtccacacgaaggaaattatccaactcatgacttggaattggcagcagtggtccatgctttgaagatctggaggcactatctggtcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaagagaagttttggtgggtcagcatgaggagagaaatagctgaattcgtcgcactctgcgatgtttgccagcgagtgaaagcagagcaccaaagaccagcaggtttactccaacctctccaaatcccggaatggaaatgggaggagattggaatggactttataacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagcatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcctgggacaaaagcttaccatatgcggaattctcgtacaacaacagctaccaggccagtctacagatggcaccgtttgaagctctatacggccggaagtgccgcacacctcttttctgggatcagacaggcgaacgtcaactgttcggaacagaagtattagcggaagcggaagagaaagtcagaatcatcagggaaaggttgaggattgctcagtctcgacagaagagctacgcggataaccgtcgaagggagctcacttttgaggcaggagattacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaacatgatcggcatccatgacgtgttccacgtgtcccaactaaagaagtgcttaagggtacctgaagaacaggctgattcggagcacattgatatccaggaggacctaacatacgtggagaagccggttcgcatacttgataccagtgaaaggagaaccagaaacaaggtcacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaggccaaaatttgaattttcaaatgaccccaagaaaatgcaggtgaaatcaggataaaaccctaagaaaacaatgcaaataataatcggattggacatgtggaatttttcttgagttctacatgtcgaaattcattaacaggatttttagtggaattttcagagctctagaaataattttaaccaattaaaattgagcaagcaatattttattccagggaaaatccttttcctttttctttttcttttccctccctttttccctccttttttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtctttcccccacctcccgccgatcccggcgcgccgccgcgccgaaaccgccgccgcacccacgcctccgccttctccgggccacgtcgaccacgcccgcgcgtgcgccgcgtctcccgcgccctttcccctctccctcccgttcgcgcccgcgcccgagatggccgggattcgaaaaccgaatcccgcctctctctcctccccactcccccgcgtcggccggcgaatcccgcctcttccggccacgtccggccctctctccccctatttaagcatcgccggcaccccctctcgctttttccccatttcgccgacccctcccgagctccccatcgcctccgcgccgtgcaaccacccgccgccgccgcttttgctactccggccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcgccatggccgccgccttcggccggcgctctcgccctcccacgctctgtcctctctctctaatccctctccttttgttcgttaggaggttccggagctcgtcccgccgtcgtcgtcgtcctccgtcggccgccgtcgtcgaccgttgtcggtgaggcttccccctcctctttctcctttttcccgtaccgtgtagccgcgtgcgcgccgcttagccgcgtagccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtcccgccgccgtccgatctacccttgggtagatcggggccgtcggttcggccgccacgtggcgccgccgcccctcctttcccccgtgccgctgacccgtgggcccgcgcgccgccaccccctttctctcttccccggtcgctgaccggtgggccccgcctgtcggcgccgcgccccctcgctgacgtcagccctggttaatattgcgcaataaattatttaaggattttggttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttataggataatgttggtttaataccaccgctccggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggtgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggtcgggtatgtgtcagatgaaggtttccccgaggagtaggcttcgtccgtgccgtcgaggatgcctgtggagtggtgttcccgctgcagtttagtcaaggcttagctccagttatctttcgttttccgctgcatttatgtaagattttacaatgtttgtaagacgtggatctgtatgtcaacattgtcgtttgtgtaccccggctggtcctggacggggattttaatgcacattctgcttggaattctattcgggaatttctgagcgtgacagaacgcgtccaacgcatttccaaacgctacgtgctgatagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtatcattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtctaaacgcgtgctggattgagcaagctctcaccaatgtgggagggtccgtatcgagtgatcggtgtcccccggccgggctccatacggctggccacgggcgacggcactgagctgcctaacccgtggaatatcgaacatcttcgtcgcttctacccctgaggggggggtcgagtgtcaggttttggctcgggccaaccccgcacccccctcgggtgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacaaattttttcatcatttttgattccagattaagttaatctatacaaaaaagaggcatgaagaccttagaagaaagaaaaagaaaaaactggagtctggcgggggcctgggggctcagtccgatgcgcccgggtcgccggcctcgtcgtcacggtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcggccggttaagtcgctttcgcccgcagccgccccgctgatacgcgccctcgcgtccagctccttttcccgcgcctcgaggtcggcagcccgctgctccagtgcggctctctcggcgcggatggattccaaattgcggcgtgcctgctctgccagcgctgcctcacggagggaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgcctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcgacctcccgctcctcctccacctctcgggcgatctctgccagcgccgctttgcgggcttcaagctccgaaacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcgaggcgacagaagacgaggagaagagccgccttggagagaatgcgacgcggctcggcccgccggaggacgcactgggctcggggatgtcccccggacccgtttggtcctgggcgtcgcctggggaagtgcgcccaggcgatccgcccgcggcctcgtcgcgagccgccccggaggctgtcgcctgagcgtcgcccgagggagtgggcccaagcgacgcgccagcagctttgtcgtgagctgcctcggaagacgccatcgcctcagcctgacgagcccgggcggcttcctccttagcagcttcttcggcttggcgagcccgggcggcctcttcagcttcccgaaggcgatctgcggcctctcgccggtcagattctcgcctccgttcctctgcggcccccggatcttcggcctcggactggccggacttgggatggcgggaggaacgtgacgggacatcgctgaagcaaaagaaaaaaccagaagacaaacaagatgggtaagagaaaacttgcttttgggataaaagaaaggcggtcgcaatgagagtgggacgaacctgcgagggggtcggttaaatgaccaccttggaggggaaatcaggtttccccgggatggttccgtctcccccatcttgcggagccgtttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcagagggggaggattccttgaggaatgagagacgtctccacggagctgaaattcagcaccctttggaccacgatcttgaagtcctcgggagcccaatcccatctgactccctggtgggtccgcatgtagtcttcggacccggtgtactcccaggcgcctcgggcgcgccgttggagcggcgcaatccggcgacggaggtagtcaccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggtcggtggcagattccggcataaagcggcgcggcagcccggcatgcctctcgctcacgatgcgagaaggcggaagtacgcttccgtcgagcagagcggaaccccgagccatggcgccggagaaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcaagtcttaaagagaccgcccattatggacagccaagttaccattaccgatgtgcatggtttgagaccgttaggtttctgcgcaaccatgaaaaccggtcccacctgtcaccaggctttaggagtggcgttacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgaggggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatctttccagattcggaacttagaacaagtaagaggttggctcacactttgtagctccctcatacacagatccaccaaaacacaggagtagggtattacgcttctcagcggcccgaacctgtatacatcgcccgtgtctcgcgtttcttcctagctggcgatcttttcacataccgagagagcttgagatttcaccctaagcccccggccgaaccggcaaaggggggcctgcgcggtctcccggtgaggagccacgagctccgtcagttgccaaacattttggcaagttgccaaaattttggcaagatttcttatatagttaccaaaatttggcagcaaactaaatttagccacttttttggcagccttaccaaaatttggtaaggttgaaaatgacatcaaagtgaacatgccctataatttatcattattactgggatatttattctgttatctaaaaaactggaagctaatagatagttaactgatagtttgacaacccatctgatctgatggtgcatctttagataattttgatacttttgcattatccaaccatttcttccttgagggataatgagaagagacggagataatacggtgacaagtattaatgtatctagtggtctcctcccacaatcatgttaacattctttgttcgtctcgtcattattccactaccttcttaaaatatctgggcaatttgcaaatagatattttgataaaataaatataattttatgaaatttacttaactctatactaaaataaggaatcaagaaaacgaatgaccaaaatgttgccttccttccaaatactgtccaatgttgcgtatctttacatcgtgctatgtcaaggttccacccatgctttgacatagtgttgatcactgcactcgcttctcattctctatggtgctatgtgagatagattaaaaatgaagtcagagcatgcaaaacgagaaaaccaaccgtgtgtaattaattgagttataattattataaatttaaaagatagatttatttgatagttaaaaaagttttattttaaaaacataatatttcacagtttaaaaaatttacatcttaatcgagaaaacctaaaccaatctgtcgtaaccctcatcgggtgctcttccgtaacactgaatatgataagggccctttgaatcacaggattgaaaaaacgtagaaataggaaaaacgtaggattttgatacgagtgcaagtgtaaaatagaggattgcaaaaacacagttaagacacaggaatggccgtttgattggaccgcagaaaaacacaggaattagaggagaaatgaagattcataagaaagtttccatgagatagaacctcatgctaaatttcctccaaaacttgcatgtctttaggcattccataggaatttcatagaatttcgtaggattcattcctttgattcaaagtgccatataggaaaaattcctataggaatgaaatcctttaaaatttctatgtatttcctttgaatcaaagggggcctaaatcctcacatacccctcccagcccacaaaaaacgaagttagtactagatgtggcatattctagtataatgaatttgaatagaggtatgttcaaatttgtagtaatagattatgtcatatccaatact

SEQ ID NO: 60935 - DNA, 10204 bp, Oryza sativa
cccccccccccctcccccatccccttcttcctctctgtctccagcgcacgcacgcacgaccacctcgcctcctctcctctcccctcccctcccccacctcgcctcgcctccacgcgcgcgacgcggccggcgacggcgagccgcacggcgcgtgggcgtgcctctcctcagccggcggctagccctctcctcgcgcgggggcggcggcggcggcggttgttgctggcctcattccaccgccatccctcctccgtgtctcgggctcgactcggtggtgaaggtatccatgccattccttttctctctcgcagccctctcctccctggtggtggagactggccggctggggcgtgggagtgtctgcgcttgggcttcgttgtgtcggtggagcgagattccggtgggatttgggggggcatctgtcgctgtaactcgtaaggggttgggggtttgacacggtttcgttttttttttaagaaatgttgtttccagtgatgttgtcgtgtctcaaaattattcagaaattttttatgtagatttcttggcgtagtcagttgtttcaggggaggcgcgtctccatgaaatctctgcatgttttacggggctttgcctgtagcctgaaatttggggggagtgggaaaaaaatgtttcaacaaaggcatttcatatcaagttgttttatgctactgaagtgatgatggaagatgtgataggcctaccaaggccggaaaattttccgcgtcatgcatttttcgttgcgagcaaggggcattgtgaggttttggtaactcaaacctgcatcgtgtctctgtttaggagttctcccttccccacgccacccgtctttgtttttggtaatgtttaacctgttacagaaatggaaatagtgaaggatcagtcagctgctaattactaccagtagctgttaggatgccgctgtgccataatgcaaagcataaaaagagatacatgatgtactaagaatgaaaataaagatctgtaattttttttaaaaaaaatccaaaccaaagaagccccttagtttaccttttcttttttttttactgtaattagccctctgtgatgtgtggaagggctgttcatctaaaatctccttgatatttcataatcagtatgtgtgattcttacaattgtttttctttgtttctattagcatactatttgttccaagaggcacacataatataccgatatgcatataatgttcattcgcttttctatttgatgtctttgtcaggtcaggtgctgatgcaagatataggttgttctatgagaaggatagctgtgcacatcaagacccaaatataatctcacttggttgtactatagtggtggttgaacactaagatatagcttattctgttgtttcaaaaacatgggttcgaggtttccatcgcatcagcttagcaatggcctgtatgtgtctggccgacctgagcaaccgaaggagaaggccccaaccatttgttccactgccatgccatacactggtggtgatataaaaaaatctggagagcttgggaagatgtttgagctccacgctgtcaagtcaagaaaatctggtccactgagcaatgcaccttcgaggaatgcgtcatttggaggtgctgcatcaaactctggacctgtccctaatgccggggatcggtccaactactctggttctctatcatcttcagttcctggtgctagtggatcagcaagagcaaaatctagctccggacctctcaataagcatggagaaccagtaaagagatcatcaggtcctcagtctggaggagtgaccccaatggcgcggcagaattctggccctctccctcctatgcttcctacaactggacttatcacatctgggcctatcacatcggggccactgaattcgtctggtgctcaaaggaaagtatctggacctcttgattctgctgcatccaagaagacgcgggccacatccttttctcataaccaggctgttactaaaatcaccacagaagacagttactcaatcacaggaagcctttcgaagctaatactcggggcagtgggtgtgctctttgtgttggggctcatagcaggcatcttgattcttagtgctgttcacaatgcaattcttctgatagttgttctggtgctgtttggttttgttgctgcacttttcatttggaatgcttgctgggcaaggagaggtgtgattgggtttgtggatcgctattctgatgctgatctaagaactgctaaagatggacagtatatcaaggttacaggggtatgtaaaatgctgttgatttatcatatcatcctatcagtcaatactcctgctttattttcagatgagcttcttccagtttagaagattacatatgtatttttttttgagaggggagattacagatgtacagatgttggtacatagattcagtgcatgatctttttttctgagataatatgccaaacaattacttaagttatcatgtctaacttcacaggttgttacttgtggaaatttccctctcgagtcctcgtatcaaagggttccaagatgtgtgtacacttcaactaccttacatgaatataggggttgggactcaaaagctgccaacacccagcatcaccggtttacctggggattacggtcaatggaggtgagttctttttcatgaatgatagatacccattactaagtgggcattgagaataaattgatgcagtcaattacatcatggtatacaggctttattgaagaatattgaactttgagaatttgtttctctgatctctatgtaccttaacctctgacaatcccaatgcaatcatgacagcaacacgcagtggatttctacatctcagattttcaatctgggctccgggcattggtgaaagcaggatatggtgctcgagtgaccccattcgtggatgaatctgtcattattgacattgatcctgacaacaaagacatgtcccctgaatttcgaagatggctgcgggaaaggaatctctcaagtgatgatcggataatgcgcctaaaagaagggtattattttcttatttagttggtttgcacctagaatgcacaagctaaaattgtgatcttcaatgacctggtaaaatatcttagtgaatcactacatttacttcatcacctgcagatacattaaggaaggcagcaccgtgagtgtgatgggggttgttcaaaagaatgacaacgtgtcgatgcttgttcctccaccagagcccatctctactggttgccagtgggccaagtgtgtcctcccaagggacctttatggattagtcctgagatgtgaagatacctcaaatatcgatgtcatagcggtttagcaagctgggtgttggaacttagaagagctgctgctaaaaaagtgctttttaaatgttttgacttggagtttgtttcgtggaatgttagaattgagaaaaatgtacaaatgttggggatgattaaggttagtaaaaatagatgttaagctggggtttggatgtatagtcttttcttgtattttgtcctttcttttcacctattcctcggttatgagcactgaatgcttgtcttgtgaaatatgatggcttggttattactaccatccagctgtttgaagacttagtgaaattgggtaaacaactatatatgtttttttcaactagatgtatcactgctgttaaagcccttccatgttccatttaggtgtctatgttatgcatgtattcagcagcattcacttagcatacctatgtaccatgtctacacttataccatgcctgcatttaatctcaaatgtcactgactattgttgaagaaacattatttaaataatcctttgaagcaaatagaagtacccatgcattatagctgcagcctgcaggcaacactctggcccagtgaacagctacattacaattttgatgtaatgaatatatatgcatttcaatgtgagctgggatgctgggcaagggagttagctcaaaatggtggcgcatgccaccgaagcaatgcctgaagaagtcactgctcagggtacaggtctctctgtccagaattccagatgcagccatgcaagccattccaggctgccatctgtgggggttctttgagatgctcaacctttggccagtttcatttgtcaccacattgaatcaaggagcaaagcttgggctccaattgaccgagttctttgggatgtgacaccgttttaccatggctgtacctgcaaaggctgacttgtcaaggatatctaggattggtggtgaaactgtactgtcctctgaacttactggaacaaatggagccagatagcatgagacaaaactagaaggcatagctaattggttattcctctccctggtaaggtaagaaacttagaataggcctgtggaaaaacatttgaaaattcaccacatgccttaacttgtgtgagaatgcagcacaacacatgatgttagatatatctattaaaattcctccttttcacattcatgcagtatttcagaagaagaaaatcttttaatgatgtggttattgccatcgaagagaagcaaacctatggtatgttcagtttttctttttcttcgaaatttcttcattgcaccagttgcatgtaaggtgatcttaattaagaggcctaactctttagtagtagaatctacaattacgattttacaattgcgatcctacttagagacctccggttccgattcaagatctcgattgtaacaaccttgttgcatgagtcttcaacaaacaccgaaaattagctaataagaatctaccattaaggaacaagaaggacatggatgcaatccatcgcaatcaacaaaaagtacagatctccacaagcaagaattatgggacaaaaccttcaaagcatcccttcattggtgaatgactgaaaggtgatcttggtgccgaggggatatcttacagggccctagctgccgcacaacagatccagaatttcagaacaggtattcccttttcctcatgtttttcctccattttttcctatctgaattcgttcatgatctgtcaatcattggtgaaacagtccaaatggcaaatgatccgaacgaacagttggtcccggcagcgcaataacaacatagtaacatactaacatgcttgtgtatcaatcatcaactgtattttttttaaaaaaatatattactcagctaaagagtcctcgcacacaaggtgagagatgaagttacaactttcatccgtccaaaagtctgttaaagatttttttttttgctgggccagctaagataggccaaccaaatttacttaagattgaggaatatgtataaaagtctattaaaagattgaggaatatgtacaaaagtctattaaagactcacaccgggctctataagctaaagcataactactacgattctggattctattagccttcttgatcatgaactgtattataggttgtaagggaaacctctctactgggtaaccatggtcaattgatcgattcagcagttgacactatcatcatccagacatcatcatgaccatgattcagtgaaacatgggctctcatgtggcaatgcaagatccgtatgcatgaactgtcctgttgtgccgaaccagattatgaacttggaattgcagaggccatgaacaattgcagacggtccccaaggaggccaggaccaaagataccgatttactgatcatcgtcacttcgtcagtcttccgcgacgatatccccttattttcatgaccgtctgaagatccattgtgtggtaaaacacatcaaaagaatccttctcttgattatttgtgtaagggaacagacattctctggagaacatgcgtactatctgatcgaggaacggcaacctgaattggtgaacaaataaatactacacattgattgcgcaagaaaaatcaatgttgtgatctcttcccgacatcgcggatcggtgacagatgcgctcatgtgcacagtacggtcgtggaagaagacaagcaacgccgatgcctgattacatatggaggccaaattcgtgtaggtgaaattgtgcagcatttcatcaggaattcaggttactgaaaatcagaggatgcgaacacttttcatcacttcctttgagagcttcacgtttatactttataaccaaagagatgactcatcagtaatagcatgtacaattgtgcatgatgcaaatatccctaccatcttaataaaaacaaagtcgttctccttccattccctcctctcacagcgcgctcgcacgtgtagcttacgtaaccattggatctaggtccagttcttttcttcaataaaagttggttgaagattaagattttcgtgacacgtatttcaaactgctaaacagtgtatttcgtgcgaaaactttctatatgaaaattgctctaaaatatcatatcaatctatttttcaagtttgtaataattaaaactcaatcaatcatacattaataccacctcgttttacgtaaaaaacttaattttcatctttaagagaaaagaacaccaccctaatattttatcccaatcatagatacagtctatccctagtctgatccattataatcgttggtgcatgctactagaactaatagaacagaagaattttggattttttttttcggtaggagttgcagcagaagctccactgaagctttcgcttctgtacgtcggtcgaaatgccgttccagcccaacatatttcggcccaatatatccgcacaggtctgggattatattccggcccacgaatctccgcacgggtttccagcacaatattccgcacgtacgtgggattcccgctccggcccaatataaggcccgacactttcgaagggttaatctggaccgttgcataagattcgtacggacaagatcgaggaagcgggaaggtcaagcggaattttgtagaaatagccctcagaattactttatttcacccgtttggcctttccccctcttctggccacctcggcggttcgtcgccggcggcgatggcggcgacggtgcggttcgggctgctggtggcgatgttccaggccatgtcgcgggaccgcacggcggcgaagaagcgggcgcggctccgcgcgctcctcgaccgcgcctacgggcccggcggcagggacgactacttcagcgcgctccgcctcgtgctcccggggctcgaccgcgagcgcggctcgtacgggctcaaggaggccgcgctcgcctccgtcctcgtcgacgccctcgggatagccaaggactcgcccgacgccgtgcggctcaccaactggcggcgcgggggcggcttccgcaacgccggcaacttcgcactcgtcgccgctgaggtatgccgccacatttaccagttactatccctaaccaaaacatggggcatggcggcgtagtcgttgatgagtttatgaatttcccgcgtttgtggttcgatgagctgcgctcgattgagtgttttcttagttttgtttcattaattcattgggttgaatggatacagtctgtggtagcaaaaatctcattgagttaaagtatattcatagatagattgattgtttgaccgatacacgctttggatactgtgattattttcttagttttgtttcactaattcattcggttgaatggatacagtgtggtagcaaaaatctcattaagttaaagtatattcatagatagcttgattgtttgatcgatacatgctttggatattgtgattcggggccttatggtagcttcctgatgtttctcatactcttgtgtgctgctcaggtgctacagcggagacaaggaatgacttctgggggattgacaataaaagaggtgaatgacgcacttgatcgcctggctgcaactgagaataggtagcttatacataatacatctatttgcatttttactgtgccgtgcatcagtgtatgccttgaaagtgagaagttactcctcattcttgacaggtctgagaaggcttcgattctttctagtctgatcaagaaaaccaatgcccttgaaatgaagtggctcttgatgattattctgaaaggttgggttgctctacaagttgcatttctgcagtggttttggattgctgttgatgctttccgtacttcatcatagatttgaaattggggatcagtgagaagagcgtatttcatgagttccatcctgatgctgaagacttgttcaatgtcacttgtgacctgagattggtctgtgaaaagcttaatgatcgaagtcagaggcataagcgccaggtgatgatactacattctatgtctgcctgtctttgcctgcatgctgccattctgatgcataaaatttttacacggaagcaagtttatctccatgatatctctatgctgtatgaccaggatatagaagtggggaaggctgtcaggcctcagctatctatgagagtcaataatgcctcatctgcttggaagaaggtctttttatttattttttagcttatagtgtatcaatggaatatttagtcatttctaaggacactcacttttttcatatagtcatcttacaatttgtttggttatatgctccctccctcttcagcttcacggaaaacaagtggttgctgagtgcaaatttgacggtgaccgtattcaaattcacaagaatggggaagagattcatttcttctcaaggtaatggttccccatctatctcttgcttattattctgaaacggattggtttcttttgccataatattttctgtttctgcctgtaatatctttgctgtagataggctaatcctggtccactaatgtgctgtgtttatcaggagctttcttgatcactcagaatatgcacctggaatgtccaaagttattatagaaaatatcttggttgacaggtaaggtttactattactacctcgtcacatattatagctacttctagcattcaaaatttgtcccaagtataaatacttcctcctacttccctatgtcaaccaatcacaaccatctctcatttaatttcttcaccttctttctcatctcatccagtcacaaccatttgtcacctcaatcttaatccctccaaaaaaaaaggcagaagtagctataatatgggacggaggtagtactagtgaagattttttttttttgggggaagacaatgaggttttaattgtattctaacaattttttttctgggtgaaagtgagaaattgtacatttttttcctgaaaggtatcatcacatggcttagtctggtcatagacaaaaaaaaaagaagcaaatgaatgaattaccccctccgtataaaaatgtaaggcataatttgtttagttaggacaaggctttggccatcagtttgctttattagaatatagtttttatgacgcaagactgatgttattagattcatattgaaaattactttcttatgattatacttttgtgtcatataaatgatatattagtaaagcaaatcgttgatcaaagccttgccctagcaaaacaaaatatgccttatatttttatatggaaggaatattgtcaaagatcataataccaaggaattatttttgttacacctttttctgcagtcaacaaattataggaaaacttaaacatgttttgaatttcttttcgagttacaaactaattatgagaactttctccttagggcatgcttcaataggggatttttgatttgaatcctttgtgtaggctgtttcttactccctgcatccctaaataagtgtgtagttttagcctaagaatttgtccctaaaagagtgtagttttagagtagtccacttgacctctttaatactactacgtctttttcttcttatttttttgtcattggaccaatagtactccctcctcgttttctgtccatatcaataaagggcatggtagtcttttaatctcttccttaatatgtagttgactatctaaaactacacttatttagggaaggaaggagtagtagttagtataatacttgataacccattcttgattttgatgtgaatttgtactgaccctgcaggtgtattttggatggagaaatgcttgtttgggatactgtgcttaatcggtttgcagaatttggatcaaaccaggaaataggtttctggaatctcattggaaattgtagaattttgttttttatgctgtatgtctttatagtggact

SEQ ID NO: 60936 - DNA, 665 bp, Oryza sativa
tggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaatgcagtctcattttctttttcttgttccttcttcgaaatttcagcaattttctcgtatcaagaaaggaaaatttcagcgtgtttctgctgatgaagcgttgcatgtgactaagcaaattaaagcatctgtagtttctgaagccggaacctcagagcgggtggatcggcgatccaaatggggtccgaaccccatttgacctctatattttctcacacacgctctgcatatgtggctatatattttcttcttctcctggttcagtggttgagtacgtactttaagggaattgattttctt

SEQ ID NO: 60937 - DNA, 1178 bp, Oryza sativa
ttttattaaaacataaaacatagtgcgaacaataatgtttatatatacatgtgcacgctttaatgctttatctctataatcatgtctgagagattaagtcgacgacacatagattatcacatgtgtttcattattgacgggtagttgcctactatttaaaaaataattagccgtaaatatgagcatatgtttaagtctggtacttgaacttgggttccactagaatctaactagagctacgccagtttgcaaactaaatcatgttatcacttgatcattagagtatcagactataatgatttcctgtgtggttgatcttagcctctagtaaacaggaccgatttgtttacagaagtcacaatatacagtttgaatgctttgtatcgtcgtcatcatcagtgaaggctacacgcctccaaacacaaaaacatggccacacacagagagacagagtgagacctcgcactcacactcacactcacactcacgacgaggcaggcagaaacagacgatgacctgagctagtgagagtgatgggtggggcccacacgggggagaaaaagaataggaatctagtcagccgtggggcccacgagaacgatggccacccattagagcacccacaatggtaaagtaaagtgctctctataaaacatgtacatctcagcaatatactagattaatagtaaaccatctcaatagtatgtctacatgggtatgtatagctctctaatggattgcctcgtttttctctagactatttccaggttagtgttagatcttatcatatcttatcattctctgtatggatatgcacggatgcatgttggttcggatagatagaggataggactctaatcccttgtaattaggatcaccgaaccaacacatctgcacgcatatatatctgtaaactcagcgcgtttttgcatatagtgaatcaacacgaaaccctgcgtccaccgtgacgctttcctgcatacacctgagttttatatggtatcagagcctcaaagtccggcgtgatggcaggttcctcgtcaagcactgcctccaccaatcctctctttggcgttcaagtttcagagaaactgaccaaaggaaactatgcgctctggtcggcgcaagtcctggccgcgatacgcggcgcccgtcttgatggccacatcaccggcgcc

SEQ ID NO: 60938 - DNA, 1004 bp, Oryza sativa
ctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagttggaagtactcattatagtcatagtttcggcatcataaaaaacgacaccatcgtagccacagtgccatcatggccgtgtcacttttgttggaagtaccctttatggtcatatagtctcgatatcatagcaaatgacaacgccgtagccatagtgttgtcacgagttgtgtcaataagattgatataacctacaacgtggctatcttgttaactacacgcggcactactcatgttatcgtggcaagcatatgtaccacgtgttgccatcacgagtttctaaaatccgccgagagtccaccgcaaaattataaaatccacgctatctctagcagcacttactattatgataatgcagtgacagggttaattaattaatcattttatcatttgtgtggatgtgatgtagcattagtttcattcattcatctaaggggaaaaagttcacctccatgggtcagatcaacgtggttatttgtcaatgtgctagctagtgtatcaccacctaccaagcccataaacctatagcaagtgaaaatttcagtttaattgatttagttccctctttctgatgacaattaatcgtggccttatcatgttagcaatcatcatcagggatccaccatatatatagttgatgcttccattatggctagaaagtatgtttaattaaggccatgacttggagaatgacatcatgtttgaggcacccgcgctcgcttattgtcgtagctattaacatattagattatcacttcgtcatccagcgatttgccctaaatcaagtc

SEQ ID NO: 60939 - DNA, 698 bp, Oryza sativa
gatgggccggcagctaggcccgatacacaaaaaaataggggagtaaaaatagacattatatgccatgaacgaaagcatagggatctaaaatagacttttattatctatacatatgtcagccaaagaggagggacagaaaatagacttattttagctatacacatgacagcccaaagaggagggacggaaaatagacttattttagctatacaaatgaaatagcctagagaggagggaaaaaaaatagacttattttaaaaaggcccgatgggccacccatgccttcgggccagcacggcacggcccgacagctggtaggtcgtgcctgggcaggaggtgcagcccatgggcgggccgtgccggcccgatggctgctgggccgtgcccagccgtgcctgggcggggccgtgccgggcgggccctttggccatctatactgatagagaacaaagagatacagctgacttgtagggttcacgaggggtaagataaacatttcacacgtcttgtccaccgtgggagtgcaggctggcatgccatgcatgtcagcaaagagtgaaaaattacttatcataaaagtaaaaagtttggattttggttgaaattggagatgatgtgactgaaaagttgtgtgtatgacaagttgatatgatgaaaaaggactgaaatttggatccaaactttagatctaaacacag

SEQ ID NO: 60940 - DNA, 1264 bp, Oryza sativa
aggtggacgttcactcgggtgattaaaatccttctccttgtatttgggccactccaacagaaattaggagtgtggtctcaaagaagccacactttttcgaattagggcggggggtggaggggggcggcgccagccaccctggcgccgcggcgccaggggcgggcccaggtttttcaacttgggtattcgaaattgtaagagaaaaaattttctaacccaaggtctaatagttgtataatatgtaacggtataagcatgattttataaagtcataaatagatagaattgaccataaattgaatgcgttaagcatattagagtacattactaaactattattgacaaaacaaatcaaatttatagagcacataaaatggcaaaatgataaaaaaaatcttacaatttagagagaacttttcgtttcttgatattttgaaaatgattgatcatgtcttcattcttaacttgcaagaagaaatctctttcaatgaatgtaaccaagcaatcattcaaatattctggccccatcttgcttcttgcaatcattcaaataatcaatacacttcagttcagtctgaagaagcattcaaacaataatatcctcattagtcattcaagcattgaagcaatatcctcattcaagcattcaagcaatatcctcaatcctcataattcattaatcgatatcctagtatttcctcaccggctcaccgactcaccgttgctcggttgctgtcttgctgactgctgtcgaggatgggaggagacaagttgggcagctccgcagctgggcaagagccaggaggcgtcgaggcggcgtcggcgggcgggcggtgggccgcgccgccgcgggcgacggccgaagccgggctggcgccgtggcgcggcgacggtgcgtgcgtcggcctagcgagctggcggcggctggcgtggcggctgggaatgggaaggggatgggaagggaggtgaggagaagagatagggttagaaaggaagtgggcttttctttgctattgggccaatgggcctgaaatgctgggtggtgggagggttcagtttgggcttcttttgatttttgaatgggtataagtattttttttcttttttcctatatatacatatggaatatatacttcatatatgtattttttgtgcaaaaattttgggtattcatttgaatacccatgaattgaagtgggcccgccactgtgcggcgccagccgtcggccggaggaagaaggtgggggggagaagggtgtggagg

SEQ ID NO: 60941 - DNA, 739 bp, Oryza sativa
ccagtgtacttttggaagacgattactcgaaggagtagggtcataactgctgtcaaggatgtccgcggagtggagtccccacgctgcgagcatcaagttatatagtttagctcactttaattttccgctacatatataagacttttaataatacttgtaagacgtgaatctgtgtatcaactttgtcatttgtgtaccttggccggtcatggacagggtttttatgcacattccgctttgggaattctggttcgtgaatttctaggcgtgacagtaggaaggctgctatttctgaaattttgatgaacaatgtgattcgacttgaattctatattgtttcatcaaattctgtggctccaagttgacgctttgttttgatgcatgttcatactcatctgttggatcagcaatgaaccttacttattcttctcccaaacagttcgactgtaggggaatatatatttcactggtacttttggataactcaaatttactggtgcattacagtcaagtttgtcaagcagactgaaataagggaggaaaaggttatactccatctgtttcaaaatatagtaacgggatacttgattagacaccagctagtactaggctactatattttgatgcctaatcgtatgaatgtgtatatacaaatgcgaactaaaattcgaaatgattttttattttgtttgcacctaaaaatcaaaaactggagattcatttttattggcaactctaa

SEQ ID NO: 60942 - DNA, 2284 bp, Oryza sativa
tcgtcgggttcgcaagcccgcgggccacgcggtccaccccttccccatccaattccgccgtaggagtccgctttccaccgcgcgccggtgagctcgccatggccgcggccttcggccggcgattttgcccgcctcgctctccctcactaatctctctcggttgtttccctaggttgccccggagcccgtccaactgtcgctgtcgttttccatcactcgccgtcgtcgatcgtcatcagtgagacccctccccttttcccctctctcctgcgccgcctagccacgtcgccaccgtcggccgctcgccgccggtcgcggcctcgcgccgccgccgctagcgccgcgccgccgctcgccaggaccgctgggctggcttaagccgctcgcgcatgctctcggccatgcgccgccttcgccgtcagatctactcgtgttctttttatagtaaaaacatagtgaatcttctaaatatcatagaaaattcatccgtgctccgtttaagcccattcaagtctcagtaaatcaagaaaatgcaaagaatccattaaaaatggttttgttctctgtttcagtagtgttatagcctatttgcattgtttgctttgtatgtcgcatagattccggctctcccgacgctctggtgtacttcgaaatagtgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccctctagctgacgcatccaggcaagggtgggcgtgatggagttcggatgggccctgcgacggcctatgccgctttcggattcacttaggcacgagaagggactgcccgctgccttgcgaggactgggggtgaaacctgaggtgtggtgtgcttgattagatggggttatgcgaagggtcctatcacggcctccttccggtatgtcgtggtggcatgtcgacgcacgggaacgtgtcgtggggctgtgtcttgtgggtacagttgcacacctctgatcagagtaaaactattcgaatagccgtgcccgcggttatgggcggtcaaccagattcaccgtgattagtctcaccctagattagtttaatggaactgattagttcaggtggtggtttgggcatgtctcaacgtggtgtagcgttgagcagtggttggtttaatattggctaattattacaactgttttactgctttcaattactgtttataaatgctagctttatacaaatgaactcttttagctgtcctttggttataccttgcatcataccctccattccggtaggacttgctgagtacagtgggtagttcttgctctatctcccaaccctcagagttcaagtatgcgtccgatggtggtttctccgaggagtagacttcgtccgtgccgtcgaggatgcctgtggagtggtgttcccgctgcaaaccaagtcaaggcttagctccagttatcttttattttccgctgcatttatgtaagacttttataatgtttgtaaaacgtggatctgtatatcaactttgtcgtttgtgtaccctggccggtcctgaacagggttttaatgtacattctgcttgaaattctattcgggaatttctgggcgtgacacgccgcctccatgcatcttcatgtgtgatttcctttgccttccacggagggagggcggcccgaggggtgcagactcggcggcggtgtgttaaccttcggctgcttgcctttgatgagatggcgacaggaagaggctgacggcaaaggccgccgtggagcaccggtggttggttcacggggaggcgcctcgccgacttcagattcacaattttttcacattcttttgaaaaaaatcaaaaccaactttaaatgtcaaacgagacgatgtaaatgtttg

SEQ ID NO: 60943 - DNA, 6926 bp, Oryza sativa
tatttaaaaaagtcaatgtcgttaaatatttaaaagcggatggagtatatatcttcccgaattaattgctagctagcacaagtagtactatgtattaattaagtcaacttgaattatttgctaattatgtttattgctgtacatgagttgtctacagtataattcttagtgataatgacgtggaaatatagagacaatatctaactttacaacatgatatagtagtaaactgtttaaaactgtacatctctacttctgtcaatgtttaagcatagtcctcctcctatcctctcccctatcatgcgtgtgggcatggtctcgctccttcgcgtttacctaaccatcttaggatccatttttctcaattcattaaaataacaaatttctaatgatattatatggtccgatcagttggaaagcacgaacgtgttagtatttggaagagagcgcccgacagatgtatccatgcaaccaataatccacttctgcatgaaccaaccaagaattgctgcgtattggcagcttgcaatgaatggcattgaagcaggagaaggagttgctatcaaaatttgcattgtgttgccttaatcagattgtcgcctttcaccatgaatttaatagccatatatatatatatatatatatatatatatatatatatatatatataggtccagattatatatgcagaaaagcaaaagcacatgcagcctcgtgttaggtgaatatatatataaggccccgaacagattgatgaaacagcaaaaccaagtcaggatcaactaattataaatgtttttagggggctgtttatctttaattgagcaatgaaccgatatgtataattatatagagaatggtcccatggattggctgtgacaagcgaattgatggagcagatgcatcatatcgttgccattaattaaaggagccatctggattctgaacaaacacaatattgttaaaaaaaaaattggttgatttgtttatggtttgtagtttgatttcatttgttttagggtgtctttagatcagattttatgccctttttttacagaactaaatctgatttttcctaaaagtccttatatacttcttaattgctccacatgcccttgttgttcaatggacccaaatgactttgtcatgtcagagtgcatgcaagtctaatttgatcagtttagatccattaaagaaaacacagaacgaatacgatttagtaaaaatcatatctgaatcatgctgaatcttaccaaaagctccctgcaacaatgacgtcgatctcctgtttgtgtacgaggtgatctacaaaaccaaactgggatcagtagcctctcataaattaggccaaaacaggttctgcctcccaaatccatggtaacaaaatgtattaaacagaacagaagatcaggaaataccaagataagacagaagccattatgtcactatccaccagtgtgtcatcacatttgaggtaaatagataaaaagaaataaagaaacaaacagacaaggggaaagaacaaagtccaggtatactagacacaaaataactgatgaataaactcagatgacatagactgggttcgacttaataccataaaacaaattgaggcaacgtagtacttaaaatcctggaagtacttaaaatcctggaaccaggacaattggaaaatattagcaggttaataccataaaaaaactgaagcaaataacaaccatgtagtacatctggaaccaaatcaattggaaaatactctctgtttcacattatactccctccgtcccagaatataacaacctagtaccgaataggatgtatcctactactacgaatctagattcatagtactaggataccgtcccatccggttctaggttgctatattctaggactgggggagtaaaacattttggcatctccattccttttttcagtggcggacctacggtaggacatgggggtacagttgtacccccaatttttttttaacaatctactgttatttaacaagtataatattgtctgatagttcaaaacacctattcttacgcacaaaatcatgctttccaatagtattataatttttttcttagttatttttttattttctataataatcatttttatttgcactagtaatccatgttagcacttcatttttttctcactggacgatgcttttgtaggtctgtacccccacaatcgaaatcatgcgtccgccactatcttttttagatttactaacatactatataaatttgaacaaatatatgaaacacatacatggattcatgtacgaatctattaaaaaccaaaacatcttatagcgtgaaacagatgaggtattaactagttaatctcaaatttattagtatctcgatgatgatatttcacatggaccgatggactacatcaccggaatacaagagcaaagaacctgcatttgatgtttatgcaactttgttgaaagatactccctccgtttcacaatataagtcattttaacatttcccacattcatagtgatattaatgaatctagacatatatatctatctagattcattaataccaatatgaatgtgaaaaatgctaaaatgacttacattgtgaaacgaaggaagtaataaactgccaattcctgcacaggaactgtcagtaccaaacaaaaatggcatactaattaatttgccagggcagaagttttgaaacataaactggaaaaaaaaaacttaatcatttcatcatcgttcgataaggcacctaagaaggataagttatagaccatcaccaggaaagactaacaacacaagcgtataatgaggcacaaaaaaatggtagacaaccaaaaagaacataaggaataggtgctctgcaaattacagaccactaccatgaaatgatagacactagcaagtaaaatatcgaagaactgaaaagggcaatttgtttcttcgactacttaaggctaacagtacttccatctatggtcatgtattagcatatgccaaaaaaaaaaaaagcaccagagaatcctaagacaaagttacaaaagaattattcaaaattggggaggttggacaagttaaggatgctgacagtgagccacaagcaagcccacaagggagcacaaataagagtgacagtggtggccaaatgggccgcactgcacggacacggcccactcagacgtcaacccgagtaaaaatacttccctctcaaagaaacaaaagagtaaaatactcgttcatcttggcgcgcgaccaagaaagcagaattcgccgtcttcgtgcctctgtttggttaggttagaattggaggactgaacaaggtagtcagtctgtgtgtaactttgcactgatgattagtcagagtcttgttgttggctttagtcccacatcggtatttgatgacgggggagcacgacttaaaaggtgggggtggtcttcacccatcaaactagtcttttgggttgtgtaggctaaaaacctaaagttgtggagcaggtccaatgtaacctgggtggcccacggttggtgggtcaggcctacgcactctaacacttgtgttaggactgatgtactctgtgatcttatattcttctgattattcattacaatcgtatttatatttatgtaatgctattcaatttgtacataacaattcaaggcctacaaattatcagctttatcagcttgttgaatcttgtttcatgactgcttgttttttcatcttcagaaaagggactagttttgtagtttgtggattctgtccttgatctttcagtacataggagtgttaaaatgaaaaacatagtgacctccaaaagaagggaaaatgacgagtagaagacatgtatttgggtagttccataatgcacacagtagaaatcatttgtcagaatcagtgttttggcagaaaaggtagaagaacgcagagtactctgcattttgtaatataggcattggactagcatagaatattagaatcgatagtctcaggattggtgattgcattagtacattggaattgcaatcaggggaatcttattcttctgtttattcattgcaagcataggcagctgcgcagtgggcacagagcgaactattctttcgccttttactaaagaataccgtgtgctcgctgcaaatagcagcattgcaagcatacttgtgtagtattaagcatgctcaaataaatttgaaacaaattcaaggccatgtttgtttcattaattattagcatgttgagtccggcctcatcctcatgtgcttgcttgttaatcttcaatcgaagtactggttcagtagttatggattgtgtcctttcatcctcccttcagtttgtgagcatatagcaggaaaaaacttatgttcaaaataaaaaggaagaaaggaaaaacagaggggaattaaaggataggattattggtttgtcatgcaaacattcagagggaaacgttgacaaagaaataaaaagaacagtgtgacctatgtatatgaactagtatatgggttgtttcagccaataggttccatttgtcagaatagagtttttttgctgatcggcgagttgcttgaggtcctgccggagcaaacaagtcgacagttcaataaataatggtttcgtcagtgttggtttgtgagtcttcagcaaaacaagtattcagttagagaaaagaaagtctatgtcaataaggctggaattgatagttctgaagtcctgatcatagccgaattcatttgttggaacaggaattttgatataaataatactataatacaaaaaagaaaagtttgataaacctcgtttgttatatctagtctttttgtctgtcaaggtatagaaaatgtttgatttttgttctgaaggggaggatctctaatatattcagtcagtggtcagtgccaactctgataaataattgatgccattacttggagaaaaccttgtgaggattgtaagaaaccgagggaaaagaacattaaaactaaccagtcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatctaccacccagaaaatcagtcaaagaattgatattatgtttcttttcatacttagtgctgcatcaattgggtttgacctactaagtcatgcttataactataatctctagcttgctttttgatgccaataagggtttcatcagggtttcaactgatgagttatctaggcgttgcttcggctcataaggattatatacaagttggatttagccgatgacaacaaaattttcattgattatcaaatcgtttggatttaatgacatcggagctccagtcgatgtatgttttaacctttggatcagagcttattccattatatcattattagccgattggtttctaccggtttacatcgttgtcttattatattatcattagccggctgtttttatataattatttactcaagtatcagaatatgcattggatatgtagccgacagttcaaaaccctatcaacatcggctggtatcgccccatcggcttgtcagccaagcgactctttagtgatcaacatatttatctatcttgtcagttgcaggatcaaactggctggcatgcccgcatatcatcaatatttaggacctgcactagagctaagcagatctcctaggccattgtgttcgtcgacttagttcgcgctaacacagatcagataccatcggccaagcgcggatttttttgtcaacaagacggaggagaaggtattgaccaagattgtaatggagatggatgtggcggtggagaccgtagttgcggaggagacagtggagatggtggagtccgaggattctcaagctacagcggtgggaatggatgccgctgctcacctgggaaacacgatgtagcgcttgcaccataatatgatggcgtgggatatctctcctagatttgtctacccatctcctatagggatgtccagctcaagatcgtcaaatccttagcagacccactccacctcgatctttgagtatcgaggtggatcgcgtcttgctggacttgtatggctatgccctccgccatcttcacgagaaacgaggttagttagtaacatatgcaccaattttcgcaagctacaaagcaggatgtgcaaactatgagcataccttgattgataggtccttgaagggaatatgcagctaacatggtgtctgttgcgtgatttcatccacggggcatggatttttcaatgatccctcagtttagggatttttcaaaatttggtgttagatccttcaggatatatctgttgtacaaatctttcttgaagcagttgagttgttgggccatcttttttagagtccaatcctttactttgttctgttctacttgagggatcgtgaagatctcgag

SEQ ID NO: 60944 - DNA, 5295 bp, Oryza sativa
  unsure (1)..(5295): unsure at all n locations
gattgagagctctctctataggtgccggttgtttcaaacggcacctgctaagcggcactgatgaaaccccaagtcattgatgtaagtttcacaaccgacatctttgatgtgcacgcgaggcaaaagaaaaatagcttgatgcattagattgattcgactcgatgctttgagctcataactgaatccgaaatcatcacaaatttaattcaaaaactaaatcctaatccaatcgaaaatcacatgatcattccaaaataaatcacaagacaagagacaatccaatcagaaatcacaaaataaatcacacatgagatgagaggagaggcgaaaattacaaaataaatctcacaggagatgagaggagagggacgggcgagcgggaggccactgccgctcctagccgaaccccctcctttcctcctcgctgctgtggaggtcctgagctcgggggccaaatcccgcaccgcggggttgccggtaaccagccacagcgccacgaagatgctgagagggagatggagaacgaagacgacgacggcaaggccgaggaggcatggcggagacaggtgggaggatgtagcgggtaggggtggtaatgaggaggtaggcgtgcggcgacagtaggggcgggtgtgagtgaggcggcgggagcaagtgtggaggaagagggaggaggaggaggangagacngaaaaggaggtgtggtgataaggatgactagacaagggagcagataaagtggttggggggcccgtttttctataggtgtaaatttaaaaaaataacaacacgtatattagtgcgtgtactgtaaattgagacctataatatattatagtgtcgggttctttaaaaaatcggcactaacaatatagtggcatgtttttatttaaaatcgacatctatctctccacaaaggtatttgttctagccgatggcgctatgccgaccagccttgggtgagaaaaacattattgatgtcgggtttagtattttctgtatatatagtctgtatatatagtgctgttatttttttttgcatttcggtagtagtgggccttttggccacctatgataccaggaatactagtttttttgaagagagattaggctgcattcgggagtgctagttcccaacccttctcacccgtttttcatgcgcacgcttttcaaactgctaaatggtgtattttttgcgaaaaatttctatacgaaagttgcttaaaaaatcatattaatccacttttaaaaaaattagcaaatacttaattaatcatgtaataataggtggttcgttttgcgtgccgggtcctccgaacacagtcccttgagcgactacaatcgagtactgtttgaacacatcagtaagatcgaaagtcagatccttacccgcttttctctcctggtcaacactttatttctaaaattaattctcaagtggatttttgttcagatttttttttcataccggtattcacgttaaactcctgtcctacaatttaacaacggacctacttttattgccttttttctattaatttttgacccctttgccttgaacaaggcaccaccttcaagcaaatgaaggatgttagaaggtagtggaagcaagaggaaggtagtggaggtcaggttgcacgctaagactgtgttcgggaggcacgtaaaacgacctatacattatgattagtaaagtattagctaaataaaaattgaaaaatagattaatatgtttttcaaaaacaacttttctatattttttcaaacaacacatcgtttagcaatttggaatatgtgcacgtagaaaacaagggaggtgaagttgggaaagtaaacttataccttgtttagttccatttttttttctaaaaacgtcacatcaaatctttggacatatgtatggagtattaaatatagataaaaaatcaattgcacagtttgcatggaaagtgagatgaatcttttgaggctaattagtctatgattagccataagtgctacagtaactcacatgtgctaatgacggataaattaggcataataattcgtctcgtggttaccaggcgagttataaaattagttttttcattcgtgtcaaaaaaaaccccttccgacatccggtcaaacgtccgatgtgacacccaaaaattttctttttgcgaactaaagacacccttaagaacgcaacatatgttggaggttgagaagtataaaaaagtgcctaaggtagtaaggggtctaattgaaagtataggatagaataaagaggtccaatgggaagccttggtaaataaatgtgtcctatatcttaaaactgcaattcgttcttattttttaaaattataatttcaaaattaattccttttcccatcaataagtacttactatgcaaattgcagtctgcacccgttcactagactggaggtaggaatgacgtacatatatacattgagaaatattaggaatttaactttgaagggaagaagcatatgtatatggatataaataaacgagagatttgcaaaatatatcaagtcacttgtttttgtatatcaggcaaatatattacccggctttgtaaaaagcccagaagaaaacaggttcttacagagtcttacaaaagtaaacagctaaaacagggtaacaaaaggctttgcgacacactggggacatccagctttctatgaaaggtgcagaccatcaaaaagtactaaaagccccctcactaaccacatcatgtatatacacaactgggacagaaaacgacacaaagggcctgtttatttggaaaaatattttacccttgcacgtcacattggatatacggtatttgaagtattaaatgcagtctaataataaaataaattatagattccgtcaggaaactgcgagccgaatttattaagcctaattaatccgtctttagtaaatgtttactttagcaccacattatcaaataatgacgcaattaggcttaaaagattcatatcgcaatttcctggtgaactgggtgattgtatttttttttacatttaatactttatgtatgtgttcaaatattcgatgtgactatgtgaaaaatttggtttgggaactaaaccatcccaaactctcgtaaggtacccagagtcttcgggcagattgtcaaccgcgcgccggcaaaccatccagaatgagcatgctttctcatggaaatcagcgcagttttttcttttagtagcagcctccatctttgcatcagggacaaagacatgacagacaacatgcaaaggagttttgattagtttgttttcaaacacccactcattccttgttatccatagaccccacaacatcccagcaaacactaccatccccacttgagatttcattttggttttgatagctctcataccatcccagaaagatagatagggacagttacattccaaaaataaattcaacaccatggcaattacattccaagcaaaatgagccaaaggacaagtaaaaagaacattccctgtgctttcctcattcaaaagataatattgtcaagtgacttgttaatcgccacacgtaaggtaatccattatcagatcatactcaacgaggggtctgcaaaatatattactctcttagttttatatcataagccgttttatatttttaagttaattttttttaatttgactaagcttatagaaaaacttagcgaaatctacaacaacaaattaatttcattaaataatatataacattgaatatatttttatattttgtttttataaatgttttaaaatattgccatatttttttacaagcttaatcaaatttaaaaatgtttgatatgaaaaaataaaaataacttataatatgcaacttataatatgcaacagaggagcgagtatagtcaattatttactgcagctagctaccacacatgcaagaagtgaaagtagagtacataggccatgttcttttcctattaagatacaaattttgtcacagttttcattaacacacttttcaaactaataatcagtactatccgtgaaattattttcattgaaatagagttaaaatatcaaatagattcatttcatgagtttaaaataattaatcaaacatcaatggtttcctcgtttcacgtgtctaagcttaagattgttgtaatttagattattgaaccagattactataagctgaattataataggccgacatataataagctgtgagctgtttgttttcctggattataagctgtttgttagttgttagccacccaataataaaaaaagcatcttttgagtggattagattatagtaatttgctttatagattataataatctatcataatatgttatcggtttgttttagcttatttctaataattcagattataataaccctaagctgaattaaacagtactgtgaatcaaacagtactctagaagtactaccgaacggggccatatgttgcgatcagagtttggaaacggaaagctacatacgtggcgtcgggccgtcggcacgtacggctgcaatgtggaagacctcggcaaattacggctgcaatgtggaagtcgtcgtcggagctcgttaggacaaatttcgccgacggaaatcgtcgttggtggtgcccgcatggctgcattattaattgtactatatgcaaactgcgactgttacggttttgaattgccatatcaatgtctttgggaaaaactatactataaaaaaacggcacaacccaggtcgtcgcagtatactactccctccgtcctatcttaagtattttatatgttttcgtgaccaacatttgaccgttcattttatttgaaatttttttattaatattattattattatttgatcgtaaaacatgaataatattttatgtataacttattctttttttataaatttttcaaataagacggatgatcaaatgttggatagaaacccataattttttttaataaaattttcaaatacatccctgttcttttctccaacaaaagttggattaacttttggatactcgtggcacacttttcaaaccgttaaacggtgtatttcgtgcgaaaactttctatatgaaagttgttttaaaatatcagattaatctatttttcaagtttataataattaaaactcaattaatcacacgttattaccacctcattttgcgtgaaacacttaatcttcatcttcatcttcatcttcaggagattcaaacaccacctcaaaaagttgttaaatttggacgttaaatttgttttactcaaaaagtcgctaattcttatt

SEQ ID NO: 60945 - DNA, 1517 bp, Oryza sativa
caaaaagttgccaaattgtggaagaagttaatgtcaactggccataccagagttattaaaaaaatgtgaaaggtcttactgtggaatttgttctactatttcatatgcatatgtctactgctggtagccatgcatgtcactgttaaacagttgaactagaaatgttcatgaaatcaggatgcatgtataactgactggagatcaatgtgtaagacataaaactcttgacaaattccaaattataggacaataactagcatgggggatttttttgctgttcaattttttggttacattttctggattagatgattttgtttttcattcattttaactaaaactaaaaaattattaaaaagaacttatataagagatactagtctaggaaaatccataggtgcgcgtactgtacatatatttcatgaattattcatcttaggttggttcgctcttaaaactgaactgagggggaaaccaatggggggtacgacagacaggcaagacttgttagtcaaatagttataagggtaataatatgattgaagtatgtacttggcaactcatcagtttaactctcaatttaaaaaaattcaatttatattagtatacatgtttttttatcattctctatgtttcagccatagcttataaataaaagttaattaagcaccaaattattttggttgcttttgggcacgtagcacgttttgtaagccgcaaccaagcacattctaagaattaaaagatactaccagcaactagattacttatgatggccaaaaatcactaggataaagcaaaaaaacgtctcgaaaattattcgtgacgtatcaacatcaggaaaattccgtcattgggactagtttgtcagataaaaataactttttctttaaccaatgctaacctcttacgatccaatggctttggctgatacagtgaatagtccgccacaacagtactgattaaatataaataaattatcttaccatatataactgcatttgatagagaagaaatagatacaagtacaaattaaaactcctgtcgatgaaagctaatgcatgacttcgatctcaaactgttattatgcagacaatctgacagggggcaggacggcatgatcaaacgtccagtgcggatcatattcatcagttctttgccggagggctcgggttgtggtactccggcgcaggctgcggcttgggctctggcttgggctctggcttcggctctggcttaggtggcactggcttcttgtggaagtggtcgaagaagtgcttctccttcttgtggatatggtcgaggaaggggtgttccggctcaggcttcggcttgggtggctccggcttcggctccggcttgggtggcaccggcttcttgtggaagtggtctatgatcttcttcttgatgggaccgcacatggtccctgacgcgcacaacgctgatgggtagtgtgtcttgcccccaatggcgacaaacgtgccctccgacattggcacgatcttggatggctcctg

SEQ ID NO: 60946 - DNA, 1037 bp, Oryza sativa
cgctttgaaattattttttttaagtttgactaaatttatagataaaatagcaatatctaagacattaaattagcttcattaaatccaatattaaatatattttgataaagtttttaataatatgtttgttttaggttgaaaatgctactatttttctatgaacttaaagaaatttaacttttaaaaaaatcaaaacgacttataatacgaaactacatagggaatacgtactcttgaaagcatcctcagctttcatgttcttccgggtgcagtcggcgcacttggccgtgccgacgacaaccgacgccgcctcaccgccgacggcgaccgccatcaagacggcacaaacgccgaggagaactagtcctcgaggagcacctgccattgctgagctaatcctagctagctctgtgtagctaaatattgctgatgtgtagagatggatgaagtgaaaggtgaggcaaacgcgcggtttatataggcatcgatgaatacaaacacagcttgcttgcattattgatccatcaatcgatggatcgaccagctagctatgagcaaaaagggccaatttggcgccgaatttgcagatgggcgaattaaggccgtccaaactgaatgatttgatcacgtacgtccaatcctctctgcagcccagctacgagaaaataatgatctatccatcggttggtatacgtaggatccacgcaccgctttatttatgcatgcatgtgaaatcttaacagcaataagtacaataatcgcactgcgtcttaattaacttcttgtaaactgagtctgagagatgattaattgatcaggagtactacaatgagccgtacatcgtatctgcagtatatactttgcaaatgcattggattgttattggattggatctttgaatatatgatcgcttaacacatgcaaatttaaaggtaatttattgtctgcatgtatatatgcacttagtacacatgtccagcacaaagtactgacagataaagattttgaacatttgagattaattgacaaagcaggaa

SEQ ID NO: 60947 - DNA, 10826 bp, Oryza sativa
gggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaataagttcccagttaatgttgtacaacttacatgcgttcatggcattctggctacttgcagacctgctgattcttctggcttctgccgcggagagcatctccggccggcctgccgccggttgccagacacggtgcggtgacgtcagcatcccctacccgttcggcatcggccccaactgctcccatgggaagggcttcgagatcgcctgcgatacccgaacccgaaacggcagcggcgagttggtgccgaccctcgccgccgccaatggcaccatccatgtgcagagcctgtttgtagcgccgatcccggaggtcaaggtgatgctgccggtggcgtaccagtgctacaactccagcgacagcgtcaccgagagtttcttcggcgcggtagacctcaacaacacaggcgtgtaccgcatctccgacaaccgcaacatgttcgtcgtcattgggtgcaacaccctgtcctacacccagaacgggaacagtcgcggcaaaggcccttacgccggcctctactacaccggctgcgtctcctactgtaacgactcgtcgagcgcgcgggacagcatgtgcgccggcgtcggctgctgccacatcgacatctcgccgggcctcagtgacaacgttgtctccttcgggccctggaagcgtggcttccaggtagacttcagcccctgcgactactccttcctcgtcgacaagaacgagtacgagttccgtagcgccgacctcaagatggacctcaaccgaaccatgccggtgtggctggactgggccatccgcgactccgttacctgccctccactggaggtgcaggagaagaaaccggctgggtacgcgtgtatgagcgacaacagcgagtgcgtcaactccaccaacggtcccggatactactgcaagtgcaagcaaggctacgatggtaacccctacgtcgacaaggaccaaggttgcaagggtaagattaatgtttttattttattactcctagttaacagttttgctaaatatatagtgccaccattttatttttacctttcgttgtgtgcaccaaccctgttggtgtttaaattcattaactaatttttttttaccaggtttcatttgatcttttcactatttgatgtaggcgcaaaaaaagtgaaaaaacgtattgtgtattttagtaagcatctatatatacacggccgtgtgttgcaagtttcacaagttgcgtaattttgcgtgtgtgtgatatataggatttgaacgggaacctgttcttcaagtagcgtccttaccatctcacctataaagaactttgtgcatgcgggagagatgcttattcttttgacttcgcccctctaaaacttgtaatatataaattgcactataaatgatatcaaaaggaaaatttatcaaccacaaacttgtagatcacattgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaagttaatttttgcgtgcctttccatataagaattgccaaaaaatgacatttatgtaggaagcccatctgaaaaaacttgtaattctatgaaaatgtctaaactttaaagatttatggaaagttcattttaagttcaaatgaggtgaaccaaagttatatatgacccttacaatatttttttatttatatttctgttagtataattgtttacttatcatttacctctatatgagttggtatgttatctaacgtgacattagtgaatgaccatactaaaagaaatgttctaagaaaaatattaactaagttttactataagaagtactagaacgatctcggagaactttagtttacctcaataggacttaaaatgaattatctataaatttctaaaattttgatttcttaaagaactgcttatacaaaaatagatactagagcttataaagatatttactacaaagttgtagatctagttaagctctacaattttaatatagaatgtctttatccaagatcgtttgaaatactcaaaagttcgttttcaaaaatagatctgagagtttgtaaaagaaatagatctaaacgtattatccaaaatgttgaaaaaaagtttcaatgtagatttcgtgaagagcgacaatttttataggggggttcctaagaatttgccagttaaaaaatattttatacgtggtttataatcctggaaaggcgaagccatcttcacacacgtgattttcattttgagttgcctgtcaagagaaaataaaaagaagcctaagcctacgattttttttactagtgacagtggatctaacgactaatagatatgatcctttttatatgcacagacatcaagagtggtgatgtgtccaacaagaagaaatatccctggtagggcgtgggcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagctttggtaaggtgtacaaagggactcttgaagacaatactccggttgcagtgaagacgtcaatcgaagtaaatgaagctcgaaaggatgatttcacaaatgaagtgatcatccaatcgcaaatgatgcataataacattatcaagcttttgggttgttgcttggaagtggatgttccaatgttggtgtatgagtttgccgctaaggggaatctgcaagacattctccatggtgatgccaacatccctctcccgttgggcttacgcctagacatcgcaattgaatcagctgaaggtctaaggtacatgcactcatcaacaagtcgtaccatacgacatggtgatgtcaagccggccaacatacttttaacagataagtttatccccaagatctcagattttggaacatctaagcttcttaatgtagacaaagatttcaccatgtttgttgtaggaagtatgggctacatagatccagtattccataagaccggccatttaacacaaaagagtgatgtatacagttttggagttgtactgctagagctcatatgtagaaagccaacaatatatggtgaaaattgtagcctcatcattgagttccaaaatgcctatgatcaagagaacagtgggaggataatgttcgacaaggagattgcaaatgaagaagatatcctaatcctagaagaaattggcaggttggcaatggagtgtttgaaagaaaaggttgaagagcgacttgatatgaaggaggtagcagaacgatttgttatgctgagaagatcaaggaagtgtggatagggaaattatagtgtaagtcctcaacactgtgagtagattactatcgagggaactcctaagcactttggtgccagcatcagtgcaagaagcagtgcgatgctttctgcaccagccactccacttaactagaaggtggacaataggaagataggagctacaaacaaaaatatgtattttgtggtaggcatgatataatcaatgttatcaatcggtgtcatttcatttaaagtaaattgtgtttttcaagtatgtatctcctatttatgttttctgtaatttgaatcgatttttgtgtattgtagtacaaaactgtgtaatctattgttgttgtgtggaactcaggtcatgttatatattgtctatggttgttttgattgtagcacgtggcttggaaatatttcattgatgtgcatgtactgtaacattgcttagctatatctaaagtaaaaaaagtcattatccttgcaaagattttagtgtaatcttgcatagtttacagagatagattggcttgccacctatgcattattgggttccaatatgtgccaagaaggaaatgtctaacatttgttctcaaaatattttatatttctatacataggcccatttggttgggcttaaactcctaaatttaacttcaggagttggatatagagtggagttgtggagtagcctaaacctagctcaacttttctagtttattttataagagcactctagttagctccgatccttttttttgtcaagcagaaaccttttggttgggctccagctccaagacaagttggagcaagagctagagcaagaggtggtgccatgccaaacaggcccatacaccagcaaaaatgcccatgcattacaatgtatcaagtcaacctttcgcttattcatcttctcatacattgcaacaagaaaaactaatataataattaaaaaaatcacatgattaggttaggtttcaatgtcaatatagttttgaagatgatgcggtgaattttttggataatggaataaattcaagcctttacttcaaataagctataaccacttattacaaattctctcaaagagagcaaacattcagaccatgtcatagcgacgggcgcatccggcaataacagatccaatatacatcgtcaccactcagaccaacaccatgtagacttctcgcagcatgactgctagcaggcaccacatgtaggcgtcagcgttaatgaaggaacgttaacatagagatcgaacgaagaaggcaggtagatcgccacaacccaccttgcagcacgggatgacttaatgttgacatccccaaccatgagtggcgttggacggttggagtctgatgatcattattggtggcactagcattatactccctctaacgttttcaatttttttctaagttaaacttatgtatatttgatcaaatctatagaaaaatatagtaacattttcaacataaaataaaccaatttaataaaaccaattatattcaatgctagatttaataaaagcaatttggtgttgtaggtgttgctatatttcgttataaatttaattaaaattaaataagcttaacatagggaaaaaaatcaaagtgtataatatggtacaacagcagcagccacagccatcagagggttcagggtatcaccgcctccgtgcatcttcatatgtgatttcctttgccttccgcggagggcggttcaaggggtgcagactcggcggcagctgttaacctttgactgcttgcctttgacaagatgatgacgggaagaggctgacggcgaaggacgtcgtggagcaccggtggttgacggggaggcgcctccctgattttagattcacaattttttcacattgttttgattagcattgtaatctgtcaaacgagactatttaaatgttgttggtcgacttaagtttatttaatcagattgattgccttcaaaattttataccaaatttgtttgtaacagaagaaattcgtccatcctattgccttacatcttggcaagcacgctacaatactcttcctggacagaggagcaatgatggggtaaaaaggagcgtcatcattcgtccaattaatggcttatcaaaacttgaattttaaaatttgattttaaagttggttttttgatttttttttcaatgtagttttatttttcagctttggcttttaaatcactaaggacacatgtagtaatttttacttgcaaatcattttttatccctaaaaataagctgttacggcttatataagcagcaaccaatgacccaaaatcacaagaagaaaaactggcaggtaggtccaactgtatgtctgcagataattctttcatcccatcggtttaccactacagacgctgccgcgaccgcgagatacaaaacttgaacacgactgttttcaattcacaagcaccacatgcatggcacataagtataactgaaagaaaacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattatcttacagaacatatcccagacgaccgtcagggagcaccattggtaccatcctcattccagctggtgctggtcctctaccatatatcataggctgtaacaaaaatgtccatagaaacaactacaatgtcaacatgcagtagcagatgcagacgaagcaattgcaaacgaagaattatttgtgaatataatttttacatgtgtgttcttagcaaatctaaaaacaaaggctgaaaaataaacttcaatgagaaaatttcaaaatcaactccaaatttaaggttgaaaattcaaattttagctgataagcatcagcgaaaagatgaggcttcaggattcctagcatgggtattcggagttaattaaatcatgtttcatagaatttatataaagatgctagaaattaattaaataaaacaataatttagccccgcggatgaaaacagctcacatgcatatatatctcacaaatttactagatatctgataactaaatgcaaagttcatgcaaaaaatcatgatccatgtttgaaaaaacattaacagagtatcaatttgactaatcttcaagagactcactcaaggcatttttctcttcagaatatgatgctttattatcattagacaaacactaagaacttcctcatctacatacaaatcaagggagtatgtgaagagaacggtgtatgggattgcttttgatacaccatcaaaggtcaatgttggtgttcttacaacacgccaatttcatatattttttttcgcttccttaaactgccttcaatgcacttgaccacaatctctcttattccctgccttagcaggcggtaaaacgacttttgtgacctctccatgaatttcaaagatctccttaatcttctctttagaagcattgtctggtaagttcttcacatatatagttttcacctgtaaaagaaaaggccattcagacaaatgttcctagggaacaacaaaacaaattaaaatgatatgaaatttcaaagctaattatctctatgaatataaaaaaaaatcaacaagcgaagggtgccttgtacgaataggacaatccatccataacagaaacaaccttgcacaggttgagccagtggacagtggtattgaatcagtagaataacttccaagtcaaacactcaatctaaatagtatttcagatggctttaatctacatacaaaaaagtgtcagattgctttaatctacatacaccaaagtgttgtcagttatacaatccttaaagtgccatgtagaaactaaaatcatgaagcagcggcatcctggaaataaatcaataaaatgatggttattttggttcaacaatggtaatcagtagttccagataacaaaaactaatgtgaatgagaaatgattaacataagaattacaaaatatttcatgtttcttagatcattggccagttcctttagcaaattatggcccaaaagaaacaaatccaactcctcttttacaagtgagttaccccaataaaatacgcaatataaccagttttttttcccaagggaccctagttcaatttgcagagctgcagtgcatccgttgagcatagaaagcgctgacttttcatttacagtgtatactggggcagctgcagaagaagaatctgatgatgatgaacccttaggttcagcccagctgacggtcaactggctaccatcaaccttaaagtttggtgctgacaatttctgcttggcatagtctgcacaagcatggttataatactcaacaaagaggaacccacggttacggcttggatcatgtaaatcctgcaggaccaaaacaaggtctcaattagcaaattcggggccttcctagtgcaaagtacaaccatgaaatcacagacacaccttgaacatctcaatgttcacaacacctgggcccttcccctggattatgtttctcagctcgtcctcactcaaccccttgggtacattgccaacaaatagcctgtgctttgcctgtgacaatgagcaccgcagtgtcctcccctgcaccacggaccataccatccaacataagtgcaccatacgtgatgcaattagaacctctgtggcaacccagagagccacaataccttgtgttctttgtcatgcagatcctcaatagcacgctgagccccatccttgccggtgaaggtgacaaatgcgaatcctttgttctccttcgtctctttatccttcatcaacctcacctgttgtcatccagagcttcaggttattgcactatgtgttacagggatgcaaaa

SEQ ID NO: 60948 - DNA, 16894 bp, Oryza sativa
  unsure (1)..(16894): unsure at all n locations
acgcaatagtggatagatgcacgttctggttgttagcttgcatgtaggtgtacatgcagccttgcatagagggttagtttgttagtgcatggcgtgagtcccggtcaagagaattggctggttgttatcctttgcatgtaatttgagtctatatataatgagaaaaatgatgaggccgtgggtggttgaatcaacagaaacttgcatcttgtgctgcttgtgtgtgtctacctgagaagcctttgtggcaaaaatacggtagagagagagagagagaggaagtgatttcccaccagagagacaaaagtgtttgtgattaacacttgtagctgtgagtgagcaatcccaacacaagggagggggagagaagcgatggaggccatcacagaggtactcctcatcgagctccactggatccgaagcccgcttcccacgctaccacgctgtactggagatggagggtaagaggggacgggggagaggataattaagcgagagttttgccactcccatcacccggcccattattttatattttgttgcgattttcgtaggcggttatgttaaaagcaccacatcttaaaaatagacctgcatgtgaaaaatcatactccctccgttttatattagaagtcgtttgactttttttagtcaaacttttaaaattttgaccaaatttatagcaaaatatggtaacatttcaatataaaacaaatattgcatcaaaatatattcaatgttaaatttaatgaaacttatctaatatagatgttgctaattccttttttctttaaacaagcacaatgcctgtgtgttgcactgggtaatgtaaggtggataaagtttaacttcaatgatttaggatatggtatgaccactatccgtccgaatccgctccattttcacccctacgggagggactcgcacacaaccagaaatgccacccttaaaaacgcctctctatgtttcattgttaaatattattaccactcccacacatcatgcttgtgtatagtatctctttagcatcattgacttaacatatgtaaaacatttattttattaaaaatgctataatatcatttattttattatttgttttattgtgattaattttatcatttaagacttctatttttgcataattgtataagatttttaaatacgataaatggttaaaacgcatataaaaattgacggcgtcaaaagaaccaatagagtagtactaactaaagcgaagtttttcttttcgaaaatgacaagaaaggagtaaaaaaattatatgcaaggattgaccctgtttgagagagcttctagctgctgcagtttcttccagaatcagaagctcccccaaacagttcagcttttggtctagattttgagaagctgtaattgtataaaccagaaaataaactagggccatgtttagttccaaagtttttcttcaaactttcaacttttccatcacatcaaaactttcttacacacacaaacttccaacttttccatcacattgttacaatttcatccaaactttcaattttagtgtgaactaaacacagcctagaagctataagctgggaaacccagcttttccagattctcataagctggctaccgaccagctacttcgcagaatcttaagctccccaaacagaccctatatttccttgcacttagctaatacttcctctgtttaatattataagatattctactattatccatatatatatatatatatatatatatatatatatatatatatatatatatatatatatatatatatatgtgtgtgtgtgtgtgttaatgaatctacacatacatatatatgtgtctagattcattaacatctatataaatatgggcaatgctagaaagttttataacctgaaatgaaacggaggtagtactggatcgaaagcaactggaacaaagcgaaacaaaagaaaggtggtctagtcagtatcttaataaataaacccacgtttaaaacaaggagaaaaaaatatcaatttggttaagtttaaaactagattctaacaaatcataaaccagtacgtacatagtgtgtgtatatatgagggctgcctgccagtagcaaccacacacaaagcaagctcgataacgtcgatcatggcggcgtcatcctccctgtctccttccctcctcctcggctgctccttcctcatcgcggccgccgtcctccttcgccgccatgacagcgccgncgccaccaccaccaccaccacccacctccacttctacatgcacgacgcctacaccggcccggctcccaccgccatgcgcgtcgtctccggccgctccttgctgcagtccaccaccgacatcgtcgacggctcgtcgccgccgcggcagttcggggacatcgtggtgctgaacaacgcgctgacggaggggccggacgccggcagcgcgcgcgtgggcacggcgcaggggttcggggtgcgggtgtcggagggcgggttggtgacggacctgagcatgcacctggtgatggaggccggcgagcaccgcggcagctcggtggcgatcaagggccggatcgacgtcggcgtcggcgtgcgcgagtcggtggtcgtcggcggcaccggccggttccggctcgcgcgcgggtacatggccagcagcagctacgactacagcctcgccgccggcggcgtcgtcgagatccacgtctacctgcagcactagctagcagcctgacacactacgtacagctagaacgcgcgcgcctctcctgcatgcctatgccttttcatttcatgtgttcttgcttaaagttgtaaccagcgtcctgtgatgtattgtactgtactgtagctcgtctattttcgattttttgcatgagcacgtctgcatgtttgcagcgtgagcgtcgtgtgttccggtcacgttcgtgcctggaacgcgtcttctcatggacaattaaaggcagcagcgcacaaactacattttacattaagatatttctaaattaattaccgctactatagaaacgattttttcggatgagaccccttgaggttgctggcaaattaaactgctcccgcctgcaaaaatcgctgccccgagagcgtggttcaaagaccacatgcgaaaaaacaattttcgtaggcaggcttcttaataggcccgcctggcaccaagccgtttacccgtcccctccctctctttattctctcctcttaaaatatctcatttcctaacttctccacactccactccactcccttatcttctcctcatatcttctcgccccctcctcaagcggccatcccctcccccctcccccttcctccaccgcggccacgatgatagtggcgatggctacgacgacaacgatggtggcaagtgggcggacgagcgggagtggccagcaccagagggatccggcggcatacaggagcagggagcggcggatccggtggtggggaggacggtggagagcttggcggcaatggatccggtggttgggtgggcagcgatggtgcatccggcggttggcggtagggatggcaatgctgatgggaggtagggagggcatcagcaacagcgaggacgaaccccgggggtgggagcgggggcggcggcaacggctgcggggcataggagttgctatgtgtcacaccccaatccggcatcgccgtacaacggcacctgataggagcgtgtcgtaggaaaaacggcgcgaaccgcttcctacgaaaccgcgatctcagtactagtcccaggacatagcgctggtacccacggtgacaaatatgaatcattgcaatccttagaataaatagaggacttatttaccttaacttaggttgcaactcaggacagcccgagattacaaccgacgacacggacgaggcaacaccaacagcggcagcagcaacggaaacaacggactaacccccaacaccacaggcgacggctggggtctaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtacaaaatttatttatcaagattttcacaactcccagagttggcctcaaagcttgttttcccaaaccaaaccatttttccaaacttcccaataatagtggtccccaaacgaccaatcacttccagggacttccggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacagtttaataacctctgtagagggggtacactatacccacacgacgttactagccttggtcacccagcccgtgcagaacagccacgtctggtgactttggggctttcacgacaaggtatttcgaaagccgacacagggttaccatatgccaatgagaggagtcccagaccaacaacaggttaggtcccagaccatactgtgccaggaagcccgggggttctccccgacaccaccccgttgaatccacatgtctcttggcatcaaggctcccttgattagctatttactcagccaggggcgtcccattccacccgtgtggtcgcactattgtatgctcggatgtaattccaaaggaatcggtccttagatgcgaccgcacaagtattccgcccaggaatggccttgtgtcgcaaattttatttttaaaactcattttctttcacaaggcaccgacccaggcgtcgggttttccaaagcttttgtaaaccaagttttacccaagaagttacacagattttaagtttgaaggagaccgtcgatactcgcacagagtgcacgaatatcgaggcgcaactagatagttacaagggaacatgatataacaattaacaatggaaggatcagatgcaacaagttgggtaggcccaccggtctgccttgcagacggggcaaatagattaagtgcaatcctatcaatgcataatatttttcaagcaaattaattaagttcaaatataggctcaatatgttcaaaggtggcttgccttgctcagggtcttgatcttcacgaatcttcaagaaatccgcttgacgaaaatccggtaaccgcaactatacgcaaacaatcaaaaacctaaccaaaagactgaaagaaagatcctatttagactaattaatagtgccattaaattgatatcaattttacggaactactggaagtagaacggagtcaatcggtcgagcggttgaggagatatggattttggaagcttaattggatttctggacaaggaaatgatctattggattttttggagtacgagaaatggcttatagaatttatagaaataatattctcaagaatattattgacagtcactgacatgcaggaccaatgggttgaattattggaatccccagattaagaggaaggattttatggaatttggaatataggaaatgttttatggagcaggagatatgatttattgcatttatggaaatgaatattctcaagaatatccttttatcactcattgacatgtggggccaacatatggtgagagagaggtgaattgggagggagcagatatagacttttggtcattgtgtttggcggagggagtaaaaatggacttcctttgtttcaatgggccgaggagggggagctggtcgatgggccaggcccacgagcggggagagagaagggggggggggtggctgactaggcaggggttgacttggtctggtggggtcagcggctgaggtggcgtccaggtggacgccacgtcggacagggaagggagaggaggccgggcggctcatcggatggccaacggcgctcggtgcgctccagcgaacggcggcgaatcggagtgggcggcaggcactggaagcgagaggaggaagcggggaatcggttccacggatcggaccggagagaaggggcgcgacggcggccggcgacggtggcgaagctcgccggattgccgacgtggatacgcgatgggagggaaaagggggcgcgggctatggttcgatcgaatcggtgtggtgttgcgacgcacacgcgttgggcgcggaggctgatggtcgccggtgttgctcgtgcggcggcgcggcgcggcaacgaaaaggcggctcggcgcgagagctgaaggggaggccggtggccacggggcagcaagggggaggtcaagaggggcccgaggaaggtggtggcgagcgggttcgaagagaaggggggaaccgacggcagagcgcggccgtgtgccgcggtggtgaatcgggcggcacgacgtgggaacaagaaagaaggccggcggctagggcggcggttcggggagagtcgagggggctccaggagggtggagacgagaggatacggcgaggggatggccgacggcggcgcgcggtcatgcgtggcggcagcgaatcgggcagagcgactgtttggggtggttcaagggagctcaaggcgggtggtggcgcggggagtccccgagagggtggccaacggtggcgctcagccgagcgcggcgtcggcgggaacagagcacggcggggtggtcatagcatcgagagtggcatggccggggaaacagagagggggcgcgaggagttccgggagggcgacagcgagctggttcggcgtacggtaaggggaaggggacggggagctcaccaatcggtgaggaatggtgtcggcggcgatttgaggatgggaatgggaggaaggccgttggcgttgggcggcgaggccgacggcggcgcgcggtcatgcgcggcggcggcgaatcgggcagagcgactgtttggggtggttcaagggagctcaaggcgggtggtggcgcggggagtcgccgagagggaggccaacggcggcgctcagccgagcgcggcggcggcgggaacagagcacggcggggcggtcattgcaccgagaggggcacggccggggaaacagagagggggcgcgaggagttccgggagggcgacagcgagctggttcggcgtcctttaaggggaaggggacgaggagctcaccaatcggcgaggaatggcgtcgcgggttnccggcccgnngncgaatttttgaaaggatgggaaggggaggaaggccgttggcggcgcacggggacgaacgtgacgccgaagcgggcgcaccagggaaggaagggacgcggggtgggacggtttggtgacggcgcggcgttcttggccgtggcgacgaaggaggcggcggtgctccggggttggccgcgcgacggggtaccgaggttgaggaaggatttggggctcggtgggtaggatttataggcaagggggagatcacagacgagctggcgctcggctggcggtggggcgatggtttcgtgggggacccgaaaacggcaacggcgagaatgcgttggacggcgaggtcggtggatcaagcggtcgaatttgaacgcggagcgcgggccggcacggtcaaagtgggggcggcgggattcggcgccgggaaggaaacgagatttggaaattgaatttggatttcgaacttgaaacttggtctcaggaaaacagggaggagtcaagggaatgcatccaagcgggaattcggtatttctttgggatagatttcaaagatagataggtagacggacggaccgatggatatcgtagagatagatagatcaacagagagatcggtagacggatagttagatgggttgacaggtagagagatcgatgattagatcgagagacagataggtcgatggataggtagataggtagatcgatcgaaagagagagggacgaaatgaaccaatcaatgagtttgaattttgaggattgacgacaaatgcggatagggttttacaagaggaatccgaatacggaaattcgaactctcggattggtgtaggtagattgataggtccaaactttagggagagggagagagatgggctggaatagaaggaagaagtggaccaggaaaaaggaagaaggaatccaacctatgagggaggttaaatagactttcacagagagatttaattggaaggttttagggctggagtctggattcgaatttcgaagtcgatacttggtctcgggataataggaaggagtcaaggaagggaacaatattcggagacgagtcaaataatttagagaaggagagtgtaacttgggagtttgagttggactactcgacgagatatgtgggtaagggatttagaagagaaatctgaatagaagggttcagacgagattatttggaacggatattatcctgggatagatctatactcggggattgttctagaattacttggatggggtttcaaagagaggggaaatctcgggaattgggtttcataaaaaggaattcaatatggatctgcaccaggggattcggagcaaatactcggaaatggtttcaacgaatgacagagcgataggtggagggagattacaaatatgggagttgagatcaattattcgaaagagagtcaagggaaggtagagagagagggagagatgaaattgagaggttaagttcgaattcgagagtcggtttgaaggaaacaagggagtatttaggtctcggaggtgaatcattggactgggttagggttcgggcattcgacaaagatcacgggtggggtttcaggatggaactccgaatagaagggatcgaacttcgggattatattgggatggaaattttgaggagacgatctttgataacagggtatgcagacaagggagggatttttaattgagatctatggcacaacttagactcaaacactcaaagaacgaaattttcacaattaggatttttaataaattagcttttaacgtctcgcgaaaagtggggcgttacactatggttttggattgttcattttcattcgatttaactttttgcattatgacagcttaagcgcccgcatgcgaaaatactgtattttcacatgcagttgctcttccccatgtaaaaatactgactttttggacatctgggtgtaggcgggtcatcccctatctgggaaaatcgattttagtcgcatggaaaaatcgtttgtgaagtagtgtactacttttcaattcatccaacaaatttgtacttattgatagttgcatcattaggtaattattgatagttgcatcattgggcgtgatttttccagtcaagtagagtacataattatataaacttccaagtacatcaaagagatttacctcaatatttatttctgctatttaacacacttagaagtgcccatataatcttagatggatgtatagctatcttcgtatatatactctctgtcccataaaagaaattcaacttttagctataaatataaatgtaggctatgtacggtttgtagcagaagttagtttttatggtttagatggagtagttcaagctaccacatgaactaatattccatcttcacctcaatcacacatccctccagaaccgcgtagccagcccatccgacggacgggcccacttacacataccatcccacttatacttttgtccatacttcgtctaaaaggttaacccggagtgatatagtttgagggaagaggccttataagggcgcacccttgctaaactagaaagtggtactaaacatgcgcacacagttatcatgggttacacaggcctaatccttattgggtcgggatgtctgacacacacccccctcaaaggacccgacgtccccgtcggtccaaatcacccacatagctacacaggcatataagcaaaggtatagaaacacaccccctgttagcacatgcccgaacgtccagtgttggcatcatatgccatgccatgtgcctcacgcaaagtccacatgcgccatgtgccatgtgccctcacactgacccatacgcgcaaccgcgagggtcggctctgataccatttgtaatggtcctcccttcggtggtactaaacatgcgcatacaactctcatgggctacacatgtctaattcttattgggctaagatatcacaagacatgtgctcgggtgtctatgtacaaggaagaaaaaacatgcatatcaatccattattatacggtaagtagtacatactagtacttgtggagcaattattatacggtaagtacataccagtgcttgccgagggatgccaatcacatcttaatatggtacctggatatatgggatatataatccaagtcaaaagtgaagttatgtgaacagctttatgatggaaaacgatggaaaacaactttcatgttcggtttagtgagcacttttttggttcagaataagtccttccctttcatgtgaattccccagcggccaattaacaactcgtggggccctatctattcattctctctggccccaagacgaccccctgtcccttggactcaagcacatcgctatgagtggaacgtagaccataacataatttacagatctaagatatgatcgggcaagtaaagaggttttaatatagtgctcgaaagatggttatgaatcgattgactaacccaattttatgtttagattcataactaggacttttttttactgagggagcatatacagtctgttctaagtcaaaatgtatattttatccatcaattagatttaatagatctcatatctcaaacattctctatcgcaaacttttaactagtgtaattatggatagtttaattaactcaagatttcactcaaatggccatcgtcacatctatacctgctatatagttacagcccactaaagctaaagcttaacgtgtaaacatgtcatctcatcgtccattactaataattgcgtactaagctccaacaaacattgcagcatcatctacaattcattaaattatgcaaataaaagtgcaagtatatccaaccatcaccattcacattattttcataatattttcaacatacatatccaacatttttataatacttaacatatatattcatccatgtaatagaagcgtgggatatcatatttcatccagaatctgctacagagtctataaagtttatttctctccttacatagtttagcaaacctgttttatctgttgttaatatctaatatttttttttacacttagctcgattattgaaaaaacatattaaaaattacccccttagtaatttccgaagcaaagcgcggggaatttcctagtatctatatcatccagtaccttattatctctgtctctctcgtctcatacttattcgcttgtttctataggctgtctctctcgtctcatacttattcgcttgtttctataggcccgttagaacgttgaaaattcatatggtcccctcatctcctaattataggaggttgttgggcatactcttatcccttctttatatgcggctcccaagagtattgaaaattcgtcgaacacggtacaatcatacgtaccatatttgtcctgacagtcacttgaattcattttatatgagagctgatatatatatatatatatatatatatatatatatatatatatatatatatatatatattatatttatttattttagggtgtgtttagttccacgctaaaattggaagtttgactaaaattgaaagtttgaagaaaaaagttaaaagcttatgtgtgtacaaagttttgatgtgatggaaaagttgaaagtttgaagaaaaagttagtaacttgttatatacgatgttcgtgtgacgtaacggctctctcctagaatcacgacgcaaaagcgaagaaagaacatgacatttaccgtccgtttcccagctaaccatgcatggtggcgttcaccatacgttcccaatcgcactaggaccgtcgtataagtctataagaagaaatcgttcacatagcattttttatctctatagcgcatgtacagcaacggccggaatatttgattatttcgttgtctctcaaattgtcaattgtcttctgcttacctcgctatatacccggaccgcgaaaaaaggtcttgtatgtacactgatctaattaatgcttctttgacaaactgcaatcatttcatcacaactattcacttatttaattaccaatacccacggagcgcaaggcggctatatcatgatcatttcacttcctatggagaattttcaaatacaggaaagtttccaaaccatcagtagattggcatagcagaaaaatacacatcaacaacagaaaaatagacgggaggtggggcctcatgcttattctccctccgaaattcatctacaatagtctatttcgttagaattttaaaggggattggttaaaaattagtcctttcttcaatgggctctatagaattatttttcatatgacacaaatgctctaatatttttatgttttgcttataaagtgcaagctgctagttgctttcacaggattagtgaagcaagagtataagttttgagcaattgagatgactgtgaaatttagtgttatagctcgagtccccaagacaagtatcctgcttggtcattgccttcgagtggtttaacatgcttaggttgaagttaataactggctaactattctatcaaaggtttctcctttgcttattacttggtgttgtggttattatattgaaagatgccaatcgtggacatggacacattcagagtgagtggctatatatatatatgattgtacatatggatcctactcattcaaatatgtgtggtacttgcggttggtatcagaggtcttacaaggtgctttgggctcactgcagaacacatcgggtcatacccaatttggtctgaccgatatagtttacttttggtagttctttctttcgtataagactttggtcttaagtttcaggctttcttccaaaaagctaggtgatcagatttaacaacagcctatgattgatggaggtgaacacatggtgaaaatagatcaaatatagcaacaaatttttcttgaccgggctctcagacaccccctcaatactctagctccacccctgcactaagccataattacttcaaagcaagccataattacttcaaagcaaaatatctcatgtatgcagttggctgttggcctagcaaccaacggaagaaaatattttgttatttcttagcagcctacttgagaaacacgtactccacattatgttatcgaaaaaaacaacaactgatgagtaaaaaaaaagaaacatacaaagattaatcagcaatgtttatcagtaagaattttgaaatcccactaaacacgcggggcatcaacgagatgttcgcgcatagcgaatgcaacgtaacaaaaagaaaatcaacgtggccgctgaagcaagtccagataagcgattcacgggatctcgttcgacgcgaatattcacgcaatatctttgtgcctctgttaactattgagaccgttttttctttctccatggccacacctcagttttggcctagcttccccggtgaagatgcaggagaacgtcgtcaatgctggtgcggcgctggaagcaaacgattgtttactccccggagattgtggtactgtattacactacctctaattcaattagctagagtttttatgtcattctcaaaaacttcacattcaatgagggataccagtgattgcaattttggtccccaccggcaaatcaatatatcgaccgaaatttttgggttttctcaaatttttgttgaagttggtcaaagtttattcaaattcattcaatattttagaaaatttcgatccgaaaattgccgaaaatcctaaaatttcataaatttcagtcgtactgaaatcgaaagtgtaaaccctagggatacctaagttattttccttctctactaaattgccttttcaactctacaattaacattcttttcggatgcatctgatggagggagtatatcccatcttactataaaattgctgctcactaacttttaaatctcaactagaaaggtagtccgcgcgatgcgcgggcatatgtatttgtttgttaaaaatcggtctgacaaattaatttcaaataaaaagtaagatgttttttcatttgactttttctttcagtgagccgagtcaaatgatgtggtgttttttttttcaatttgactcagaatcgtgctctctctctcgtgcggactctctcgtgaacggatcaacatatacgcggagtatgtgcggctgactcatggatgtcatcatcaagcaatagaggacagaatcatcttgaagtttttaagtaggttaagattaagaatagatctaatgattgaggatattgaaaaaaatcaatggttagtttttttaatataatttatatgaatttttataatttattagatggtcacatgtcggtttagggggattggtattattgccacatggcgatttagcggcgttacatgatctaaatttaatatttagtatttaatatgatgcttaaaaatttgatcttaaacatttatattagaagtttgagctatgtatatggattttgacttatgtatttaattataaataacacaataattcaaaaaaaattgagaaaatatgtaacttgagttttatgatcatttagaaatccgattattaatttttgatagattgagtatcagctaaaaaatagcaattagcttaagaaataggagagaaggggagagttaggagggtagagggagaacgtaagtacgtaagtgcgcatatatggaggtggtggtgaggatgcaggtatcagattttctttttagatgaagatctaacggttaaaattaatgggtccatcaattttagaaaaataatggctaaacatttattagaatttttatgatttttataaaaatctgttagctagaaaattaaaagaaggaaggaaggaaagaggggggatgtttgtatcgtgaggagaggaggcccgggaggaagggggcagtggagatgggttttggattttttctaaagatagatctaatgatggagtataatattatgtcaaccgtattaagtgaaaattgtgggctagttgttttgttttctcgcatagtttctttgatttctaatttattagagcatcatgtgacaagctataagtgtttgtaggaaatttaatagactttagctaaataataggaagggggagagaagaggagagccctgagtttttctgagagggaagggtctatcaatttaaataaaatcgatggtcatatgtatttttttctcaaaaatatgatttttaaaaataatttattagatgtgaaatgtgaagacatagaggtgttgtaatggacatctaatagatgatgatatgtgatatattatcaatttttatataatgtttaattgatgtttagttgtcacggaaaggatatggatttatgtctgaaaatatatttatcatatatcaagaaaagcctacatggatcaaactaaaaactgaatatatttaaaaaatatactaatcatttagctatctattgtttatatataatcatttagactatgtgacaatcggccaccgtaacagaggaactcacatcctgtaactatatctctaacggcttatctttttttacctattagatgaccaatcggatgtctatttctatatcgaaaacagataaccaatcggatgtctatttttatatcgaaaacatagtaaaaagagtgaatataggacttcgctcattaattaatttaattaaacatataatcattcaagcgtatcataaaattaatgtatagatcgtccataaaaaaagttagtgcttgcatgttgcacagccagctcgatgctccatgcatggaaagatataaccatttccaatattaagttatcatttccaatattaagttatggtgcatatctcgtaataactaccttaattagaaaaagaagaaaaaagaaagagtaaatgaggggaggataggcgtacttacatacgtaagagggattttattttgatatgatgttttaaattattgggtccactattttaaatgaaaatcgactgctagatattttgttttttctcataatttctacaatttattagagcatcacatagcggctctacatcttttgtaggagtgccacatagcagattacgaacatttgtagaaagtttaatagacatttagtatataatagattaaaggtatcagttttttaattaaccgacactcatagtctattaaaggtgcctggtgttatgggtgnnncnnncannnnnnnncnnntcnnnncnccncnnnnccccncaaaaaccctccccgcaaaacctccccacaataaaccccccacccccatcactaccacaaatacccaaaanaatattcttcaacaactttctcccttctttcaaaaacacattatccttcctatttcctatcgactttttttggacaactccctctcattaataatgtaaagtctgttgcgcctggaaattccctcgggtttatttttggcttgagggaaatctctgtttgcttaaaaattttattaaaaggtctctccactcggctttggaaattgctaacgccctcgggattccaggggttcgactgtctcttttcctgggaaccgggcgggttccttaagaatttttgaccaaacactttttgaaagggcctggttttcccggtttgaaaccaaaaattggccaagcttgtgtcgattgcccc

SEQ ID NO: 60949 - DNA, 23506 bp, Oryza sativa
ccgctctggtactagacccagtggttagcattgtcaagctcggcggactcttaattgaggcgggcatcgcactcaacacctttttgttaagaccctggactaaacacacattccttgggcggaattaatacccaagtaatgcaccctccctcggtgttatccaaggattgtcagctacacaaattggccagatccctgttccagttacattaggcactaggatgaatattcgcgcagcctataacaccaatctctaaatgtttttacataaattttgctttttattaaaagaaggaaaatatgagagataaaaagataatagaattaaaagataataattggagtaggagcatacggagtacgtacgtgtatgtacatccgcgggaatagtgagcccaagtggattaggatgggtggactatttttttttacatctaatctaatggtcaaaaataatgggtccactaatttaaataaaaatcaatagttagatgtttctttgccacgtggtaggttaggagcgtttgtagagtgccacgtgacgatccaggagcgtttgtaggaagtttagtggacttttagtactccctccgtactcataaaggaagtcgtttaggacaatgtttaagtcaaaccctaagaatataaatcatgaataactttcaaattgttgagtttgaaaatgtaaaaattatatgaatatatttgtcttgaaaaatactttcataaaagtatacatatatcacttttcaataaatatttttatagaaacaagaagtcaaagttgtgttttggagaccgtgtcgttgtcttaaacgacttcctttatgagtatggagggagtatataatagatagatagatatgcaagtgtgctacatcatcatctactagtaattattatatagattattttaaatatcatataaatatgacatatcatttataatattgttgtatttttagaacttaatatatatgtaatcaatgtcgaaccattatctccacatcatttatatattatttaaacatatatatctatcatgtataatatgcattcatctatatattccacggcaaagtgtggtgtatcgactaggattctatataagtacagcagctgtaagcattaaaggctgcctggaaccacacacaaagcaggcagccaagcatagcccacagcaagctcgaccatggcgtccctctcctccctcctcctcggctgcttcctcctcgcagccgccatcttcctccaccgcaacggcgcctccaccactaccacccacctccatttctacatgcacgacgcctacaccggcccggctcccaccgccatgcgcgtcgtctccggccgctccttgctcgacgatggcggtgacgcggtgccgcgtcagttcggcgacatcgtggcgctgaacaacgcgctgacggaggggccatccgccggcagcacgcgcgtgggcacggcgcaggggttcgcggtgcgggtgtcggagggcggcatgtgtggagattatggatacccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccgttaggatatggattgtattttgtaaagcggactccttcccctatataaagagggtccgtgtgcctcttgggcgcgattctttttcccaatttatacaatcaataacacactcggcggaatcatccccggacaggagtagggtattacttcttgaataagaaggcccgaacttgtataaaattcttcgtctccaaacccatccactttcctagcttgatagccacccccttttattattgccgaaatcttgtttcgacagttggcgcgctaggtaggggtagcgtcaagttctcaccgactaagtgcgataggtttcgtttctggcatcgacgacttcgccttccctcccgggcaggcgttccggttcggcagcctcaacttcatcacgaacgacttcggcaagatctctcttcttgactcggattcaaaccagtcggggagagaccaggtccccgtcccgtttggtattccgaactcggccgaggcctactccaagatcatctctcccgagtcggcttcaaaccactcggacgagatccaatctactcttccgcgaccagatcaagacgacgggtcctatccttcaatcctgatgaaacttcctgatgatttgccgctgtcttcacagtcaagacatctcctactcgaagatctaggcgagctccggcttcggccccgatccgatctagatccagggaggttggcgttatagtccaacctctcgggatagtctcgacggaagagttggatggctacctcagctcccctagcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacaacgctaagcccgagaagcggaccaagatcgcgcacggcaagaagctgaacgtcgccgactggaggaagagcgacagcgacaagagcgagaacgactacagcgtgagcaacaagatcgcgaacggattgcaaaggaggctgaagatcgatgacaacgtgccttggaatctgggcggcgagcgagagagctcattgggcaacaagacgtcgatgggacagcggtctttcgcacccccccagcagaacgcggttgcagcaatcactctcctcgacaccctcctcaaggaagacgcactcaaccaagccgatcatgtagtcaacatcttgaaccagacgaagaccatgatcgctgcctcggttccagccaactctgcaagcacccgcaccccgactggtagccgagtccctcaccagccgagcctcagcattgccggcgccgaatctagtcgtaggagcaggggacatgatgaacggtctgttcgttcgcctcccgagcgatatagggagcgccgagttgaacgaccacactccccacatcgaaggcgccccatcgatcttcgcgacaccatcaaccagcgcgcgcagcaagaggccatcattcaccggatcgctacgacgacgacgtggatggagttgctgccttcacaagcgatctgcgtcgagtggattggccagccggctttaagccgactggaattgagaaatatgacggcaccaccaaccctgagtcttggctcaccgtctatggtctcgcaatccgcgcagcaggaggagacagcaaagccatggcgaactatctacctgtggccctagcggattctgcccggtcatggcttcacgggctaccctgcggcacgatcgcatcatgggcagagctactcgaccacttcatcgccaacttccaaggcacttttgaacggcccggaacacacttcgatctttacaacattgttcagaagtctggagaatctcttcgagattacattcgacgcttcttcgagcaacgcaacaagatctccgacatcaccgacgacgtcatcatcgctgcctttactaaaggcattcgccacgaggacctagtcggcaagttcggacgcaaacctcccaagacggtcaaacagatgtttgaaaaagccaatgagtatgccaaagccgaagatgctatcacggcgtccaagcaatcgggcaccacttggaagccaaagaaggatatgccgaccgcgggagggagtggaagtaacaaccacaaggatcgcaagcgtaagcccgaagaacttgtggcgaccacctctccgtcttcccgacaacgttcccgcattaacaccttcgacaagataatgaacttccaatgtccgcatcatcccaactccaaccacgtggccaaagattgcttcgtctacaaacagttcgcggagcaatacgtcaagaacgcatgtaaaccctcagacggagatcaaggcacatcaaagaagaaagatgatgaagacgatgccatgactggttttcaagatcatcgcaaagaacttaatcacatcttcggcggacccctggcttatgaatctaagagaaaacagaagctaacagaacgggagatcaatgcggttcagcctaacacgccccaatatcttcggtggtcagagatagcaattaagttcaaccgctcggatcatcccgaccgagtggtccactcggggcggtaccccctggtactagacccagtggttcgcaatgtcaagctccgacggactctcatcgatggtggcagcgcactcaacatccttttcgctaagaccctggacgatatgcagattccttgcacggaattaaaaccgagtaatgcacccttccacggtgttatcccaggattgtcagctacaccactcggccagatcactgttccagttaccttaggcactcgggagaattttcgcacagaaaatgtttgtttcgaaattgctgatttcgagacagcatattatgctatacttggacgaccggctttagctaaatttatggccgtcccacactacacctacatgatgatgaagatgcctggtcctcgaggagtcatatcactacggagcgtcatcaagcaggccgtcacatgtgacaaagaaagttgtgagatggcccaaacccacgagactactctcgcccgcgaagagatccgactggctgcgaccacggcaagcgagggagaagcgcctgcaaccaagctgacgaagaccgaagaaagtgatgccaagacgaaaaagattcccttagatccctccgatcctgataagactgctgtaataggcgctgagttagattgtaaataggaaagtgcgctcatcacctttcttcagaataataaagatatttttgcgtggaaaccatccaatatgcctggtatccccagagaggtgattgagcactctttacatgttaaggaagacgccaaacccatcaagcaacgactccgccgttttgcacaggacaggaaggatggatcaaggaggaattaaccaagctgttagcagcaggcttcattaaggaagtccttcatctcgattggctggctaacccagtcctggttcggaaaaagacggggcaatggcgcatgtgtgtcgattataccaacctcaacaaatcttgtcccaaagaccctttcaggttacctcgcattgaccaggtggttgactcaacggccggctgtgagttactcagcttcttggactgttactcgggatatcatcagatccggctaaaagaatccgactgcttgaagacctcgtttattacgccctttggggcctactgctacatcaccatgccctttagattgaagaatgcaggagcaaccaatcaacgcatgattcaaagatgtttttcaactcagatcggtcgcaatattgaagcttatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccagttcgtctcacgactcggcgagcgggggatgcccttcttcaagctgctgaagaagattgacaatttccagtggggacccgaagcacagaaagcctttgaagatttcaagaaacttctcaccactctaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagctgactccaagacaagatattctcaggttcaaaagttactatatggtgtcttaattaccgtcagaaaattatctcactactttcaaagtcactcggtcacggtagtcacatcgtttccactcggggatatacttcataaccgcgaagtaaacggacggattgcgaagtgggccttagaattgatgtctttggacatatcgttcaagccacgaacttcaatcaagtcacaagctttagctgatttccttaccgagtggaccgagtgccaaaaagacatgccagaggaaaagatggaatattggactatgcattctgatgggtcgaagaggcttacaggcactagagctggggttgttttaatctccccgactagagaaagattgagctacgtattgtggatacatttttctgcgtcccataatgtggcggaatacgaggcgctactccatggactaaggattgcaatatctctaggtattcgccgactaatcgtccgtggagactctcagttggttgttaatcaagtcatgaaagagtggtcatgtctagatgataatatgaccacttatcgacaagaggtacgcaagttggaaaataaattcgatggactcgagctcacccatgtcctccgacataacaatgaggcatccgacaaactggccaattttggttcaaaacgggaagcagctccttcagatgtgttcgtcgaacatctttacgaaccgaccgtgcccagaaaagagacagtcgaagccatggatactcaaggcgtaagcatgatcaaagccgactggagagaacattttataaaatttttgagcaaacaagaactccctcaagacaaaaatgaagccgagcggatttccaggcgcagcagactttacattattcatgagaccgagctgtacaagaaaagtccatcaggaatactgcagcactatgtgtctttggaagaagggagacagttgttgaaggatatacattctggtatttgtggtaatcatgccgctgcacggaccattgtcggcaaagcttaccggcaaggttttttctggcctacagctgtgtctgatgctgacaagattgtgcggacatgtgaaggttgtcaattttcttgccagacaaattcatttgccagcccaagagttgcaaaccatcccgttatcctggccatttgtggtctgggggcttgacatggtcagcccgtttaaaagggcagtcggcggttacacgcatctctttatggctatcgacaaattctccaagtggattgaggctaaacaggtcatcatgatcacagcagataaggctagagattttttcatcaacattgtgcatcggtttggggtacctaatcggatcatcactgataatggcactcaattcactggcggagcatttaaagacttttgtgaagacttcggcattaaaatttgttacgcctccgtggcacaacctatgagtactggacaagtcgagcgtgctaacgacatgatacttcaagggatcaaagcacgagtttttgaccgactatgtccctatgctggcaagtgggtagatcagctgccgtccatactttggtctttacgcactactcctaatcgggctaccggccagtcgccgttctttttggtttatggcgcagaagcaatgttgccgagtgaagtggaatttgaatcactacgatttcggaaattcaacgaggagggctatgaagagggccaagtagacgacatcaatcgactagaagaagcccgagaaacagctttgattcagtcgactcgatatttgcaagggttgcgccgttatcataatcggaatattcgatcgcgagcctttttagtcgacgacctggttctgaggaaaattcaaacaacacaggatcggcataaaatatctcccttatgggaaggaccgttcataattgctgaagtcactcggccaggttcttatcgactcaagcacgaagacggtactctcatcaacaattcttggaatattgaacaccttcgtcgattttatgcttaggcatttcgtttgtatctttcctctttgactgctaacttcaaggttttccttgaagttttcagtcagggggctactatgataataatggagtgtgatttttatcaattcaatttgcttacttgatttatcattgccctgtttggtctttcgtcttagccaatgaggactgaaggtttttaatagcttttgtgggttttaggctcaataaggtttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttatcagacccagttggccgaaggtcgaaatcttggaatctctcaactacatcagcagcaatcttgtcagcggctttctgctcatcattgatgaggtcaagagcagcttcttcgctcgtcccgtctgcaaagccatcaatggcatcaatgtcaactcttggataaagggatttggtcatcgccaatgccagacttgctcccatacttccagcttctttgatgttcttgaagtaagtatctggtgcgactctcagcttgtcgaagatttcggcagcatcaagtgtactcgaaccggcgttattgaagaacatggcctagataagtggagtagcggcattagcgactttatccctggctccttcaaacttgttgatcttgtcaactaagacatcaaattgtgcttgagacttgatcttgcggtttgcgtcaacagattcacattaatgaatcagcatatagaagataatggcttttgaggtattgattattggtaccttcaacctcctttaaagccgaatccctctatcttgccagctctgccttgtcattttccagagtttggatctgtttctctagttgagatatcttggcagcttgcactacattaacttcggttaatcaagattacagagataacagcacaaatcagttgggcagagtttgcgcgaaccttttgatgagccactcagttcgaaattggactcctggagctcagcaatccgatcccacagatcatgttcattcttcttggcaagttctctggcctcgtgcaattgactcctagtggcttcgagggttccaaaatgaggaactagtctctctagggttgcggttttcgcctcgttcctaagatgaatcctctgcggagcagtttaatcagcgctcgagccagacggcaaacaagatggctgaggtcaggcgtcaagggacttacatttacaatgcgagtcgcttggttgagtgcctttttcagtaggcatacctcttcatcttctttttgccggtttattacaattccttgaggttgcaagttgtcatcccaccacttgaccagaatgggagggcacgaatcttcggctgcttgtatacggggaatttcttcttcatcaccgatcattggtcctaatgtatccattgacaaaggttagacaatcgatcagagttatttgggtcaacatggtttcagacaaagtgtttacccgtaatgatttctggacgaggacgagtggattcggatgcctttaaaggggatccagatctctggtcattgctggcgtcttgtccgtgagggttgtctgcttgggtttcgacttctggaacctcttggcttggccctgcgtccgactggtttccagtcgggggctcctgattaactccggcttcggcttcggccgactggtttccagtcgggggttgatcaccggattctacattatcggttgccggctgattgtcactcggatgatcctcagcagttggcccggtttctttggaagaacttgtgtccatgttagtcgggtcagagtcttttccagacggatctatatcagatggtttcctgcaaatttgattatcagtattattgccacaatgggtgcgcatcaatgcaagagagatcgttatgtaagttgcacctagaagacttcctgatctttggcacagggcgactggatgttttcttccttggtgtagcctgttttgatagtttcttggttgtctctcggtctccaggcctcctggcggtatcatcggcttcgtcgtcacttaaaaccagcttcctctttcgagaatctggctggctgattggatcagaagcacttggttgagttcagaccgaattcgtggtcctccgctcccttgcccagtttggtggcggggagatcggcgttgagcgattgggggatccgacttcatcaaagcaaattcctgggtgtaatatccttcattgttaactaattcaacaagaaaataagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaactgacacttgataaagtgccgggtgatctgttctccttgaaggccctgttctttcagctttatcattctctccatcagttctactgcttgtgcagcttcatctcccattggcagtgagttccaagtatcccgataaactggaggaaggcaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttgctcttatttagctggggcttgaggaagaagatgcggcggaacaaggcgaaatgaggcctaatgcccagaaaagcttcgcaggcatgaataaaattggcaatatgcactatagagtttggattcagatgatgcaagctaatcccgtagaagttcagaattccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtctgatttagttcgagatacggctggaaagggatggggaatcggagcggtggatgcgaggagaaatttcgtgaagtttttgagggtggattggagcggattgatgaaccctagtttgcccggcgcagttttgcactgtagcaggaaatggggaaagtggcgagagtctcggcggggaagacgaagagacgtttttcacttcggtattattggggtatcgggagtactaatgggcctgggcctgtacagtacttcagcccaatactataatcagcgtggcctgttgtgatccctagggacttagtcaatttttgctttggcaatttgtgttcacaatggtgtggcccaatgctgttaaaatcctttttaacgcgattcaataattctttggaattattatgatgcatataaaaaggtgcccgacagaaaggtgttataccattttttgtaagctttattaggctgcaaaagctgtttgggttgatttgagatgactggtttattaataatcattcttttagcatgttatatgcttattttggttatggtaagggtcacagcctaggctattagacttattaattaccatgattttctatcatgtttggtgggtcattttatgagatttttactcggattcctatcaaacatgtctatttttggacctttgagtgtttatcactcggcccttcttgtattttttgtccttggtatgttcaagttgagaagcagtcggctgggtatcttactaagtaccatgcgtgcttcgctataaaaccactcggttcttgactatatgtttagtttttcaactaatcacatagtcgggggctacacctaattaggtacatctactcgatgcaccatgttttattttcgcccttcacagtttttgatctttagcactcggcaagctggagcaagttgaattgaagcactcggactactgttttttgtttcgagaaggctattttgtcaactgcgaacgtctcgggggctactgtggagattatagataccccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccgttaggatatggattgtattttgtaaagcggactccttcccctatataaggagggtccgtgtgcctcttgggacgcgattctttttcccaatttatacaatcaataacacactcggcggaatcatccccggacaggagtagggtattacttcttgaataagaaggcccgaacctttataaaattcttcgtctccaaacccatccacttttctagcttgatagccacccattttattattgccgaaatcttttttcgacagcgtggtgtcggacctgagcctgcacatggtgctggaggccggcgagcaccgcggcagctcggtgacggcgaagggccgcatcgacatggacgccggggagcgcgagtcggtggtgatcggcggcacggggcggtttcggctcgcgcgcgggtacatggtcaccaagaactacgactacagcctcgccaccggcggcgtcgtccagatcgacgtctgcctgcagcactagctagccatggacagaaaacgcacgcgactgctgcatatatgcatggctgcatcatctgtgcgaggagttgtgcagcggtggattcaggaagtaatatctgaacaaactgaaaaaattagtacttctttctatctgtatatgttaaaaaaatttgatggggtttcgtgcgggctcctattgtcctcatgttcaagatcccgatgcctgcatgatagatctgccataaagttgtgtgtatattatccgtgtggaatgaaaatccatctcctatatacgtagaaactcctcaaagtatcgagaagttgtaactacactactatatattgtccagttgatgtattgtatcgagaagattgagtaacattaatcatatatttatttatggtttatgtagcccttgatagttgtttgttttgataaaaaataattagcacgagctagcccttgatagtttctttgctctaagtataataatttttgaatctgaaattaataattaagaagatgtatatgtattggcattgtctttatcgtacaggtgatgtggtgatatgagctgatgctatcagctgaatatttgaacatgtgcttaataatatttagacaagtgtttggatctgtacgacaccactatggtttgggcgtcaggtatttagcttaaaaatcggacgcccacctcagcgtccatcacatgcaggcgcaccacacaaagcttgtaaaatcttgcgtagccatgtagctaagtctatattcatgcatgcatctaataaaaaaccatggttagttgggtggtattagtttttctttagcaatctataaactaccttttctcttaatttacttcttcaatctacgatccatggcactattaaattcgctgcaattaaatctttataataagaccacatatggttatattttaatgaaaaaatatttagcatttttacatttcttttaaatgatgcacaaattttatttaaatgtttcaactagaatacatatgatgttgcactagttaacttgcaaatgttgcacctggtttttctggaatgtttcaggaagtattttataatgtttcaatatttacaatttaatattaatatgtgatataaatatgactttttttcgttctttgggacttaatgtttcatataggtggttactattgttgcaatcggtatttttaatttttgcatttctctgaaactctttatgcagtgaacaattttctttaaagggtgaaacaatatttgattttttatcaaaatataattgtgtgatatattgttataaagatttaattgtaatacaacagtgtaatcaaatgatagaatggataattattttgaaagaaaaacatttgaaaatgggagaaaacgtgcaaatgagcaagcaaaaacttatgtggacatgcgcgaatgacatgacatgatatgcatgtgtagacatacactatggatgagaaaaggagagtagtagtgagagagagagcgcgtaaaatatacaacagtactctgtctgtgccatcaaaaaccaacctagacaggatgtgtgacatttttttagtataatgaacccggacatacccttatcaagattaattgtataaagaaatgtcatatctcatcctaggttggttttttataggacggatgttgtctttcctagaacatgaattaatcagttaccctcatctcaatcacatcaggcaatgtcttcattataccaatggtatggctgatgcctggcttaatatatattctgacatgtgcagttgtgcaccgatttttatgtacgagaggaagaaattaaaatatactccatccgtcccaaaatataagggattttagaggaataggatactttctaggactatggacaagcttttttttttgtctaaattcgtagtactataaagtgtcacatccctctaaaatcccttatattatagaacagagggagtatatatcgttagaaattaaaaggtaagaaaaacagaactaacatgtgggctccatcgcttttaaggtagtagaagtaactcttttcagaagtagaagtaactacattctctgggaaagaaactcttcgtggtatttgaaataactatactattacaggagctatgaaaaaaaataaaaaattaaaataattggaaatttttaatattggacttgttttgttatatattttgagtgaagtacgatcgttcaaatatgtagatgtttaaaataatattgtcgatgttttaggtcacaactacatggtaaggggattgtcggtaccaaggtttatgcaagattgaggtaaaagagatagagacaaggatttttatacaaggatttttatacaggttcgggccccttatttggcaagtaatatccctactcctgttggccgaagccggtgttgctatttattcatcataatcacaccagtacaaaatttgggataatctatcaaccgttgtcgacttggcggcctagaataccatgatgtagtcgacaacgggatagtcttcctccttgaatccgcactcggcgagattagagatagcgctagatcccttgttagcctctacaggcactatattgggtttgtctaggcttatttttgatgttgatatctggcagcttgtcttggcgtgtgtttgcttgtattggtctgtgtctatcttgattgtccccctctcctcctagggggtctatttatacccataggtgtccccttgaccaaatagaactatagggaccaatatggatacaatccgagtagtccctatagtttccatatagaactctacttgtccttccttattcaaaatacctttcataagtgaggcctaattccatataagacttgatatgtggtgggtcccgccgtgcttaattaactactattaggtacgtataagacttgatatgtgttgggtcccgccgtgcttaattaactactattaggtatgtggtatttataaccatgacaaatatatataccgttgaaaagatataagtgattaaaaaaatactactccctccgtcctaaaatataagcatttttagcatagtgtcaagtcaaacttttaacattgactattaatagaaaaaataaaaaatatccatcatgtaaaattgatgttactagatttatcattaagcaaactatcataatatgtattttttttatttacaacatcctatttttatatatcatcttgaagactgtgtcgaagtctaaaaaatgattatattttacgacggagagagtacatcaatggtactgtttctcatagcatgtgaatagcatgctacattctttttgaaaatatgagtatgaccagataagatactttactatttttgataaggccaagtttatatgggactaaaacttttgataaggcccagtttacatgggactaaaactttttagttcctctccatcgaatgtttgacgctaatttggtctattaaacattaactaataataaaactaattgtataaatgagagctaattcgcgagatgaattttttaagcctaattaatccataattagcaaaagttgactgtagcaaaagttttgctaattatggattcgactcgccaattagctctcattcatacaattagttttattattagtctatgtttaatactctaaattagggtttaaacatccgatgtgacagcaccttaaagtatgcatagtgtgtagatatgtttttttaaaactttcacacgaggaggagcccagttcgtttttttttaaaaaagaaacgtttcgcttgcgctagcactcgctatcttgtcacgtccataagtacatgccattgccagctgcaacaacacactgcaagcagctgcatgccatagccccacatcaagctcgacaatggcgtccctctcctccgtcctcgtcggctgcttcctcctcgcagccgccgtcttcctccaccggaacggcgccttcaccaccaccaccaccacccaccttcacttttacatgcacgacgcctacaccggcccggctcccaccgccatgcgcgtcgtctccggccgctccctgctcgacggcgacaacggcaacggcaacggcaacggcgacgacggctcgccgccgcggcagttcggcgacatcgtggcgctgaacaacgcgctgacggaggggccatccgccggcagcgcgcgcgtgggcacggcgcaggggttcgcggtgcgggtgtcggagggcggcgtgttgtcggacctgagcctgcacatggtgctggaggccggcgagcaccgcggcagctcggtgacggcgaagggccgcatcgacatggacgccggcgagcgcgagtcggtggtgatcggcggcacggggcggttccggctcgcgcgcgggtacatggtcaccaagaactacgactacagcctcgccaccggtggcatcgtcgagatcgacctctacctgaagcactagctagaagtagcacggagctagccatggacagaaaacgcacgcgaccactgcatatatgcatgtctggccgctgcatcgtctgtgcgacgagttgtgcagcggtggatttaagaagaaataaaaatttgatgggtttcatagggctcctattgtcctcgtattagtacgtaccccctccgtttcgtaagtcattttagtattacccacatttatattaatgttaatgaatttagatactatctagattcattaacatcaatataaatatgaaaagtgctagaatgacttacattgtgaaacggagaaagtagtaaaggctcaagatccggatgcccctatgatagattcaccctaaagttgtgtgtatagtttccttgtggaatgaaaatccatctcctatatatgcatatagttcaaagtgtcgagaagtagtaactacactactatatattgtccagttgatgtattgtatcgagaagattaagtaacattaattatatatttatttatggtttatgtagcccttgatagttgtttgctttaaatataataatttttgaatctgaaattaataaataagaagatgcatatgtattggcattgtctttatggtataggtgatatgagctcacgctatcagctgaatatttgaacatgcactcagtaatatttagacaagtgcttggatcggtacgatatttagcttaaaaatccgacacccacctcagcatccatcacacatgcaggtgcaccacacaaagcctcaaaaaccttgcatagccatgtagcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtagcaccaaccgggactaaagatcttaactttagtcccggttggtaataccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccagttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatgaggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccatgtgggacgaggacaaacaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccatctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacgcatctgctttgtcaccttttgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcaaggagcacttggctctagttcgcgctaggaacattggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcttaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacatgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatt

SEQ ID NO: 60950 - DNA, 695 bp, Oryza sativa
gcgtggcgcggatccggccatcgggcgcctgtggatcgagccattgcggggccggctcccgcgaatccggctgtcgtggggctggcagaggtggatccgtccaccgtcgtccaccgagccgcttgcccccgcgccctaagtgtcattcgccactgtcgtgtgccgcgctagctgccgcctgagcgctcaagaagccggagccatccgccgtccaccgcaagccgtcgcggggccgatgcccgcggatccgtctgttgagggcccggtggcagcggatccggtagtcgcggggcccgcggaggcggatccgtccacgccgtccgccaaggtgccatccgtcaccactgtgcgctgcgcccgctagcgcccgccgccaccaccatgcgccgctaacaccgccgccgcttgccagtgagttagagaggagaggaggtgagagtgagaagagaggagagtataaggttgaaataatgaggagaggaagtgagaaaggatagggatgaaaaattttgaagtgttgaggagagaaatgaggaggtaactcagactttgggcggatccttaagaggctgtatgtgaaaatcgattttcgtatgttgttgcataaaaggccccttaagttgtattgactgctatgtgtctacgggagttattttaaagatggcaatctatttcatggattgatagtcttactc

SEQ ID NO: 60951 - DNA, 3917 bp, Oryza sativa
gcacatctacttcctcattttctcccccaaatgcctagtacatgagcagaaaattcaatgacaatatgttcaagcttaatgagaagataaaaattccaactaatagaattttcctatgattgatcttgtacacattttattcttgactagacttgttacttgtgaacaactatctatgttagggaaccttatgcatctaagtagatgataattgagatatagttgagatgaaggaaattcttgtgttctatctcatgacaattggggatttgtttttaaaatcaaaaatttatttggaaccttactcctcatatgactttattcctacccaacaaggccatacaccaagccattaatgatgaaccttatgcatgtgtatgactacctgtaattatattgagctttaccaaatttttgtgactcgtgttagatgtctctcatgctctctcgatcaaggttgcacaaccactatgttatccatataagatgctaagcttctacactggaagttggcaccattccatccatttcgactaccactgaaaaagaaaaaccaactttgatgaataaattctccattcaatttatcccttcttctcctaagaaaaatccttggaaaagaaaaagaaaaggagggaaaggcatggctattaaaaaaatatttctcttcaaaaatatagagcaacatggaaaaaaaagaaagaaagaaaatggccatgccccctctacaattatgaaggagaaaattggagaagcaggtataaataaaggagaagcattttctttattttccatttttccacacatatcatacactttccacccaaaaattagcgatctttgtttcgagagtatgatcgattatcttcttgagtccatgtatttgattttgtaatatatatgatgaaggtatgttccgaattatgcctaccaaactccacacatacagcctttagaataaggaataatttcagcaaaatatgccttggtaaggatccacagacattacaaaatatccgagtgatcgagggtaagtcattatgatgagaaaagctggtttgggaaaatttataaacccccaaaagtctgaagtagaatacgaggaggaccagattcaagactgttccatttatcaatcacccaggatagtaagatagccaccgctgaagttcacaggtacaagaatagttttgaataatttatgtgcttctattatatattggataattttattctgaaatttatctctaacctttactcaaggacgagcaaagagctaagtgtggggagtttgttggcggctattaaatgccaaatttatgccgtcaatacctgcataaacagaaagaataaagtatccaacatagtgattaggtttatttctaacatattccacgagtgttggtgcatatgtgcctgcaggtaataaaccgccgaagttgggatgaaaatcagacttaagtggaggtgaaatcctatccatacaacgagtgggccaataactacacaaaacatcaacaaatggtccttccactcgaagaaatagatatgggaggctgaggaggagcaacaggccgaaaagtgggcctattgggccatacatgggttcggccgaaccactcccacagctgtctgatatgcggcttggcagggacagtccagatgactccctaatggcggttggagggtagaatggacatttcacatcttcacttcactcacacactccaagcttgagctgaattataagaggctctattgtactttattgtatactagattagagagagagtagagtacaagaagtcagaggagttccggaattgtcggtaatcctcttcttatttcttttgctttgtttaactactctgattataatagaaatatctttcgagtaatttagttttgcttggtgagaattatctcttggttagttcctaatcagcgtacgagatcatcgttcactataatccagcaaaatatagtgattgctttagtgtgtacctaacattaaagtaagttattaattgcttagacgctgtgtctaggtagttattaatcgctccgtatcccacagtaggtgtggggtgggtgtagaggtggtgacagccctcaagatcactgaagtcctccctaactaggtacgtagtagagcgatatctgggagtagtaagctggccagtgcccgaagtatcgtattaggattaaagttaagctttccatagacactgtttctcaccggtgaatccactctatcctttgcttatccttagctttatgtacttggacgtacctggtgaagagccgacacagacgttccctgtggaaatcgatacctgagaatactcctgggtgaagtgttacatcggtatatctctataaggttaagaaataccaacatggacccagtcatgttccctgaagcagattactaggttggacagatacgatctacaatagccaatctaaacaattccttcttggagacaattggaccaacaacctagcgtccttcttgttccccatctcaaggagaagagcaacatggagttgggaatgtcaatgttgaagatgtccctagcgaacacctgagtttagacccaggccgtaatccccataatgcattgccaagaagaccaagttggaaaaccccacttgccgaggtaatcgtgatctttgcgaccacttgaacaggcggagacgggaatgacgagaacaagacggacgtcggccatcaccaacgttgttctccacaacgataacagaacagcgatggcaatcatgaagctatctaaatgaggaccgagaccgactggattggcaaagctgcaaggacgagaacaatcaaggctggagaagtcagggtgacaatggccgaggtcgaaaacaccacgataacaacagacgacgacgagattcacgttcccccggttctcggagaaatcaaggacattggcatagatccagaggtcgtactcccgattatagttatccttcgttgtcttcatcatcatcgataggtggctctcgaaggccacgaggacaccaaccacctctcgtacctggaggaggatgtagattagctaaggtatctaccaccttgaaaatcagtcaaaggcttgattgtctagatgtttattttcatacttagtgctgcatcaattgggtttgacctactaagtcatgcttagaaccatgatttctagcctgctttttggttgccaataagggtttcatcggggtttcagccgataagttatctacacattgcatcagcttataaggattacatacaagttagatttagccgatcgcaacaaatgtttcactatttatctaatcgtttcgatttaatgacatcggacctccagccgatgtatgctttaatctttggatcagtgcttatcctatcatgtcattattagccgattaatttctactagattatattattgctttattacattatcatcagccgattgtctttatatcattattttttcaagtatcaaaatatgcattacatatatacccgattgttcaaaaccgtatcgacatcagctcacattgctatatcggcttgtcagccgatcggctctttcttgatcaatatatttatctatcttgtcagttgtaggatcaaactgacctgcactggagtaaagcagatctcctaggtcgttgtgttcgtcgatttaagttcgcggccaacacagatcgggcaccgttggccaagcacggatttttcgtcaacagtttcatcgagaagttctccatccagagtggctcacaaatccagtaatgtttcccaaggccaatgacaagtagagaaggtgtgtggatttcattgacctcaataaggggtgccacaaggatcacttccctctacccggcatgatcaactagtggactcaata

SEQ ID NO: 60952 - DNA, 1582 bp, Oryza sativa
acacgtcaacgtacgttcccgcgacaacgtgaacgagaacgagaacgatcgaacgaacgtgaacgagctaggaaacgtgaacgagcgaacgaacgaggacgaacgttaacgtgaaatgcaatatatatatatatatatatatatatatatatatatatatatatatatacatgtatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcatgacttagcagatgtttcttgtatcaacagatggctgaccgcgatgaggaacagatattgtacgatacaatcgcggagggaagcagccagtactgaaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactg

SEQ ID NO: 60953 - DNA, 1000 bp, Oryza sativa
attatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaacctcattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaactggaaatgaatagtcctggatgcagaatactccttctgattcttacacttattgcatggacaacaaataaaacccctttgcctgttagcttcggccactctcaaaaaatagtgcacgccctaatccgtcattagcaaatgtttactgtagcaccacattgtcaaatcatggagcaattaggcttaaaagattcgtctcgcaaattaatcgcaatctgtgtaattagttattttttaagcctatatttaatacttcatccaagtgttcaaacgttcgatatgacagggtaaaaaattttgaggtaggatctaaacaaggggtaagtctacattca

SEQ ID NO: 60954 - DNA, 3957 bp, Oryza sativa
aagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgtactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcatcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcatagtcaagggcccccctagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatgcagattcaaagggcccgacggcggagggttttcgttactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgctactgccttgcagaccaaatcatcaccacaagagagctcgatgtacgtacaaataaattcaaaatttcattacgtagtgatttcttgtttaattactaatcaatttcatacattcatatagtttattcgcatgagggataacctgaccacacacaaggaatttatcgcggcggttcaaaaacaactcatgggattcatcaacgaagaaatccttgatcccaagggtgaattctactacgacggaaacacaattcaccggtccttagcttctgagctagcagcgagtactactacgtcgaaaccgtagctagctaggacatataatggattgtaattaatacatgactacatatgtttctatatgcatgtgtacacattttctataatgtaaatatattttgttcatatatatatctatatacatatgcatttgcataacatatatatgtatgcatatatatgtattgaaacatatatatgcatggtctatatatatatatatatatatataaaccatgcagcaacaggggcatgcaaaaaaaaaaaggtcagctctatctttagtcccggttggtgttaccaaccgggactaaagatcgatctttactcccggttatttcacccgggactaaagataacgatctttcgtcccggattggtactcccggtttggaaaccgggactaaaggggggttacgaaccgggactacaaagggtttctccaccagtgtagctaagggggttgtttagatccatgcgtgtaaaattttggtgtgtcacaacgaatattatatagggtgtcgtatgtagcgttcaagcactaataaaaaaactaattacagaatccgtcaataaactgcaagatgaatttattaagcctaactaatccgtcattagcaaatgtttactgtagcaccacattgtcaaatcatggagcaattaggcttaaaagattcgtctcgcaaattaatcgcaatctgtgtaattagttattttttaagcctatatttaatactt

SEQ ID NO: 60955 - DNA, 4283 bp, Oryza sativa
ggaaattaaatatttaccatttttaaaatgtgccatttaataatttatcactcatatctacttattataaaaattgaatatgtttttgccaatactttgatacgccatccgtgtattagttagtttttaagttcatttgattttggaaatgcatattcatgtttgagtcgggttctaagtttgtcctttttggaaatatgcaacgaggcgcgcaagatatctctttaaaaactcacatactaacttgagatgatcggattcctagttgcaactcatgattttctatatatatatatccaagcaaattcctatagtgaatttcaccttaactaaatcgtataacaataataaaattaaaataatcttcaccaattgcaacgtacgtgcattttttctaagtattatgtgacatatgtgtcttcatgtatatatgatatttgggttaagtgatgccacatgtaaaagtgacagatagttaaatatctcatacttgtagccaggtgtcgaaaacaagatttatttgtgctttttttttccctatacctctgttcaatactccatctttccatcttaagatcacattttccgaacttgtaaaccgtgcatattacctattatttttaaaaaagtttataggaatttgcttttaaaaattatattaatctacctttcaatatttttagctattaattaattaattatgtgttaatgagtcgctttatttgacatacatctagggggagaaatcccatattctctagactaacacagctttaattggaaaaaaaaacacatatactccatctttgaaagaatgtacttttgaacttaatttttgtctcgcaaataccatatttttaaaagctactagtgtacatatcggagcaagaagcttctctagcggaaagacaatataccctttcttgagagttcaatcatgttgcaagttccaagctcatggtcgggcgcgtgagaaagaaagtgaagacatgtggcttatacaggttagggccactgagaaacataataccctactccaatgttcttgcgctatacataatgattaaatttacattggaagaggatgtacccttcttcacacagtcaatggttacgaatggtcaaatgttacgcgaaaaagttaatggtgtgttatctagagcggttgttagcgcagtggtagtgtgttatcttttttttcaagggaaatagtgtgttatctcttaggaagcaaaaggtttgaatcctcctacctacgcatgcttcggaatcctgatcaaatctaatggtctaaaatttaacaaattttcttcagaatttctgtcgagatgtatctagcaaaatgataaattaaaaatttataatggacaccaaaataaaaatgttgaatagcatattactggaggtagcaaatgtcaaccctcaaaatgaggaaagagcaaaaagaggaaaaggagcgccatatccacatccattacggattgcagtagcagcaaggcaaatttgcgtttctttctgttttaagcaaaaagagatgggaggtgcgtgtgctccccatgtgcgcaaccgcaaaaccctaggcccccaaacccctcggcgagatcccatccgtccatcgcctcatccgacggcccagacctcgccggccgttgtacttaacgcagccgcaatccacttctctcgtctcttctcttgtcacaacacaatactgcagtgcactgtaaaagaaaggaaagggaaggaagaaaaagcttttgttcatctgctcctttccccccctcaaatccctcccaaatcccaactaatcgcccgatttatcagcccattcctcgcgcaaatccgctccgttagcttctcgccggctattcaaccttggggccatcttttttggggttaaatttggtccagagttgaggctttttctttcgggaggagggatttgggtagcaatggcttgtccaatcgtggagatgtctcggttctagtcgccaaaaccatctagaatccactagtgttttgggaggtcgctgttgcgggagcagccgccgccttttgtgtgtgtggagtggagatggtgaccgagatggcgatgcgaggtgagccgtggcggcgccaggagggggagcaggcgcaggcggaggccgatcgggaacgcgagctggacctcttccgcagcggctccgcgccgcccacggtcgagggctccatgggcgcgctccacgccgccgccgccgccgacgtgttcctggaggacgagctccgggccgacccggcctaccactcctactactactccaacggcaacatcaaccctcgcctcccgccgccgctgctgtccaaggaggactggcgtccgcgcagcgccttcgccccggcttgggtgggatcgacgacgggaggaagcccagaggtggaggtggaggccgcggcggcggcggcgctggagggatgggtccaggggatggcctcattgggatgcccggtctcgagattggccgccagaatagcttctccggtatctttcaggtggtgcttcttctacactagaacaacttatcctatcttatttaactgccattgcattgcttgcacctaagctttcatgacttgattatgtcagtggttcacgcagtagatgtcgagtacaagcattggcataggagttttattacttttggttccttttttcgttcattcaagtagatgagttcgtttgagtcaatgttcatgtctaaattttttaccagggtatacgcttctctgctgcttttactgttacggagttagattggtttattgtgattgataactccaatagttgagttagattggtttattgtgactgataactccaatagttctccaccttcatagctactttgtatgataaaacctcaagttctggctgacgtttgctaggttttggcactataaaacgcctttctgtcgcaaaagtattggtcctgaaacttcgtaagttgtcgaccaatatgctatttgcagccaaaattgttgtgttactgccttgttgtttgttaccacattcttggatctgtacccattccctatgctatgtttgtctcggtcatctgagtaatgtgatctgtacatggttagggagatgctgaatttagcatgcatacacaaaattggtctagattccacggaagctgcataatattcaggaaatattttctgcagtatatttcgttacaagtagatggaaatggttctgagaaagcttcccttgccacacatgctagaatagtgcagtatgataattggccagcaaatgtcatatttatatcttcttctgtttttttttgcaataaagtttatatcattattgtattgatattcggtgcaacatgtattggttggcttctaaaactgctatctagggatgtggcatcgcatttcttgccaaatgcactgcatcatgattacaattattatcttacattgacatgtaggtcatttcccgtatacgtgtgcggattgtataaaatagggtagatcttaactctcaagggaatttaattactcttttcttcagttataattctattcaaggctaaagaaataacttctgacctatatatgatgcaggatgactcgtatcaacacgatacggatagacagggtgccaactgcaatggtacagacttgttgagttcttctaaagtgcagtatggtctacatcgtgagactggagctattagtggccttcactcagacagcaaagcaccatgcttgccagaaaaccagaatgaatcatcacactcatatgcatcaataataggatcatcactttcaagaagtgcatctccagatcctgaactagtgaggagagttcctagtccttgcctccccccaattggtgtgaaacttggtgctacagataagaagaataatgttggttcatcttctttcaattgtagttctcccaatattattgaatctgatgatttggtgtctgctctatctggtatgaacctgtcgtcatcaagagcaatgaacggaaacacaatggaccaatctaagctccatcaggatgtggatgatgttcgtaagttcctttttgatcagtacatggatcaaacaaatggcaatcagcgccattcctacatgaaacgttctgaacaaggacacgtgaaggttcctcaagaatattctggggcttctatgaatccttctgttatgagaagccagatcaatgctggtggtttcacatcatttaacaactcatcggtgggatctggctttgcttctcctaggcttgg

SEQ ID NO: 60956 - DNA, 3857 bp, Oryza sativa
ccaggccgtcctggactggccgtgcccaaaaatgcgtgcgcagttcggggcttcctcggcttggcgggctactaccgccgtttcatccgcgactcggcaccatcgccgcgcccctcacgacgctactgcggaaggaaggcttccactggtccgagacagtggcatcggcgtttcgacaactacaacacgcactcacggcagctccagtcctccagctcccggatttcaacaaggagttcattgtggagtgcgacgcatcgagctcaggtccgggcgctgtgcttcatcaaggcgccgggccggtcgcattcttcagcaagacgatcgcgccgcgccacgccaagctcgccgcctacgaacgcgaattgatcggcctcgtccaggcggtgcgtcattggcggccatacttattgggggcgccgcttcctcttagaccagcgcctctccaccgtccctcagcaccagtgggctagtaagctcctcggttttgactttgtcgtggaatacaagccgggctccacaaatgtggtggcggacgtgctttcacgacgggacgaacactgtaacaccctgaaaattcgaccgacaaaaatctaaactctagaaatatgggccttcaaaaactttttaataaattgcatcatgctgattttgttcgatcattttatttgattttgatttcgaagtttattaatcgtgagtaaaggatagttaattagaaatcaaccctaaaaataaattggtaaaatgaatataaattaaaaaaaaggattaggtggggatagaagtaaataaaatattgtcgcgaccatatttggatcaattgaatttaagacgataattaaccctaattaagacttcaaataaattatataaataatatatgagtaatattaatctagggtgaatccattggttggaataacacacatgttgagtaaatgcatatatgcaaaaattaggaattttggaatcaaatttatatgggaaatacactaaaatcagtttaatagaaaaagagcactattcatcggccgccaggtgttcgacgtggccctagcccagcccctcctctacccctagccgcgcgccgtctcgtcgcctcgcgccgcgcgcccgccgcgtcgcgccccgcgccgccgtcgtttcattctcttcccccttcccctctctttcttcctctccacgccctataaaaaccccttccctccatccccaagcctccccacacccattccccatctttcccctccctctccccttctccacgcaccgccgccgtcgtgccgccgcgccgccgtcctcgtgctgtcgtgccgccgctttagtgcctccgcgccgccgcccaagtgcgccgcgccgtgcgccgtcgtcaccgccgccgtcggtgagccgctgccccccctgtttgttgccgtgccgccgggtagagagagagagccgagagagagagatgtagggagaagccgagggagagaagaaagaaagaaggagagaaaccgagaggaaagaaagagagagagaaaagagaaagagggaaaaagaggagagagagaaaaagaaaagaaaaaaagaaagggaagaaaagaaaaataaaaaggaaataaataggaaattagagggagattagggaagtgtagaaaatttaaaataactagaatttgattataggattaatgaaaatatcgttaggtgaactcctactatttaaatacctaaagtactagaatttgattatagaactaattatttacgaattaaacaattagatgaatccttatagattgctatagatcatttttagtaatatctataggagatcaattcgcggtaataatttagatgtaattaaataaatataggaattatcataaattattatagattatttttgggtaatccctataagtaatcgattaacggtagaaactagggattttagccgtgtatcatatttagtcatttagtcatagactaaattaggtcttataatatttctaggatttcgtccgttttttagctcgcgatagaaatttctaacctattatatggatgtaatgctcgggtagattaaattaaaaacttatgacaacaaatatttatacccgcaaaatagtttaattcgaaattgggtttgctttagttcgcgaatagtaaaattaatataaaggaattgactttcgctttcgactttcatttggatttatttgggtttttatttgaattctaaccgaattcaaatcaattttcgcacgtaactatagagcccgagggagccgcggatccaggcgaaggtcaagacctacaagatctcgagcaaggcaagtcatcactattccttgatcacgttgatcccaattgtgaaattaattttgtttacaaataagattgcatgcaatgatgaacatcccacttgtgattatgccatgccttgttattgtttatcttcaattccttgtaaccataattacgtatgagtccctagtcaattatgacacttgcttagagaatgctattctagaatcttgcatattcatatttatcaaatgctatatgcttgggcaattacctttgggaaggtaattgagatgcggcatgtggaggcatgagcaccacattgccatgataatggtgacaagaaaggaattaaaaacctatgttttagaccggggcggatggtggatttgggtggtatccgggaaaggctagtaccgtccccggtcaattaaggaccgagccatgaagttaagcatgaaacgacctcgtacaaccacatttctcgaatggggttagacctagcggagtaaatagccgagcggaggcagtatccatgcatagtggtttctcatgtgtatggcaggggctctacaatggtgtcgccattgctaggactgtcgtgtgttgagttgagcctagttataacttaattacatgggtgtaaaacttcccttcccgggtgcgccagaactcctctcattgctagaaaccgtgtacgcctagagtgcatgaggatgaaaagttcatggagcgggtactgccaatgcgaggttatcgaaaggctttgccgtgacgcgtctcatgtgttgagacaaggctcatgtgttgggcagtcatggagtgtgggtaaagtgtacatccactgcagtgtgagtaaaccaaaactattcgaatagccgtgctcgcggttattgagcaccgggacatgtattacacttggctagtctctgaattcttaacttgtgtgggatatgttattgcatgatgaaatttctatgctgcggagtcacttcttgagataggggaaagtggacgtcctcagaaaaccataacgactcaatggcgggaagctatccttgggatcacaatggatggtggacagaaccgtcgttgtttaaatacaaacactggtactaaaatttgatcagtcaatgctaggtcttaagtttgtgaaaagaattataaaacttgctttgcacaaaagaaccaaagccatcctttgaaatacccctatcatatgtattgttgatgtggcggcttgttgagtacggttggtactcacccttgcaaatataaaattaatcagaagcgggagatgaagcttcggagaacccctatgcctactaccaggagggagaagaagacgatggtgcccaataggtcttagtacggtcgttgcctgtgcaatggcatgccgctgcctaaattccgctgccttatctaaactctgcttttggttgtattccggaccgctcggtccgatgatttaagataatgcctgcgggcttatgttgcactaatttctagtagactctcgtgtatgagcatttggtatcccagctataaattactgtgtacca

SEQ ID NO: 60957 - DNA, 7585 bp, Oryza sativa
ctgtactctacacattcagttccataaaaaacaaaactaatactacgaatatagatgcgatatatactattactacaaatctatctagatggtacacatacttttctctttgtgtgatggcaaatgaactgaatagcgaataaatacatatccattcatcatagataatactaataaaaccctatcacatcggatgtttggacactaattataaatattaaacatagactattaataaaacccatccataatcttgtactaattcgtgagacgaatctattgagcctaattaatccatgattagcctatgtgatgctacaataaacattatctaattatagattaattaggcttaaaaattttgtctcgcaaattaactttcatttatgtaattagttttgtaagtagtctatatttaatactctaaattagtgtctaaatatagagactaaagttaaatctatggattcaaacaccacctaatatggtactaggttgtggaatagcaaggacagagagatttgttctagatagatattgggtacacatgacaagattgattgctgcaaggaagagcaagtggctagactacttatttgatgaagaaatgtaatgtgtggagcagcggagaacagcactgatggtgacgagtcccatgaggcatgaggagcggaggagacaagtgcacgtcgcctgcctctctgtctgtatctctactatgtatgtaggagtaaatgtatcagtatcacggtcgtttttatcctttccatgccatgcctgagagaaatgaattggcttcggcttcggattggatatgcttcttcctccaccacacaaccagagcacaagccaaggcaaacctcactgttgcttcccttcccttcgccctgtaccaatagaagttcggattgggtttcgttcttttcttcttcttttttttttcccttgtaccattagaacatggccatgccacatattgccatcgctccatcgctaacatttccacgacggccggcagcctctctcctattaccaaatttcaaaagcttctatacaaactagtgtcaaactagtgtagtactctattcgttttttaatatatatggtactgttgattttttaagatatatttaattattcatcttattaaaaaaataatgtatttatttattttattatgacttgatttatcgtcaaatgctcttaaaattttttatatttgcacaaaaaattttaaataaaataaatgattaaatatttataaaaaaatcaactgcatcatcatgtatttaaaaatcaactgcctcccaacaacatctatcaccggtgaaagcaagaaaaatagttagttcagggatatcatatgctgcctgtaatgtattggatccatctgtactccattatcacgcacgcctctccaagaaatcataagctcattagcggtcaacacgatgcgataccgccataatcgactacagtctacaaatttaggccaatttcaaaatttgtgtggagtataaattacaacgaattttctgcatttgctcttgtttgttcgtacggatagatactactagtccgtcaattgccaataggcagggagaaaggaaaaaaaaaacaaaaaaggaaaaaagagctttgagttgactgacatggccgtgctctcctcttcctcccatggcctcctccacccaccgctccgtctcctcgccgccgcctccgccagtagcggcagcagctactcgattccccatgcgcgcctccgcctcgccgtcactactccgtcgaggctaccttcccccatctcatcctcgcccgacccaccgcccgacgtcgcccacgacgaagacgaacaggaaggtcagcaccacaaggaggagcgggacgagcggtacgggttcgagatccaggtgcgcaagctgcccaagcgcaaccgccgcctcgtccgcgcccgggtccgcgtcgacgccccgctcgacgccgtctgggccacgctcaccgactacgagggcctcgccggcttcatccccggcctctccgagtgccgcctcctcgaccagtccgactgcttcgcccgcctctaccaggtacccccaattcctcctccaccaccaatcaatttaggttgaccttatctgtgctttcatccgcaggtgggtgagcaggatctcgcgctgggtttcaagttcaacgccaggggcaccatcgactgctacgagggcgaattgcagctgctgcccgccggagcgcggaggagggagatcgccttcaacatgatcgacggcgacttcaaggtcttcgagggcaactggtccgtccaggaggaggtgtgagatgctattccaaatccatgttgccgaatcatactaccacatttcattccatgccatgatcccaacagcatgattttttctttctttctttttgaagaagaagaagagagatagtagtgcatagtaagcatgaattgagaaaaggaatcaacccccattcatcccaaacatacgacatactgcattgatttttttagataatggatagaaatccagcctctatacatgtcgcattgatggtggttcagatttaagatttttcactttttcatacaatcagctgctcattgcattaaccatcggtacttattctcgattaaatctgattccagctggtctggattctagaagcaagatgctatgaatttcattttctgaatcttaatctcgagactagggttagataatatgatgatttgggtgtgctgttcaggttgatggtggggaaatatcagcggatcaggaatttcagactatactttcttatgtggtggaactggagccgaagctctgggttccagtgaggctactggaagggaggatttgtaatgagatcaagaccaaccttttttcaatcagagaagaagctcagaggatccagagattgcaagataaggtaaactgtaaacaagggtgttgctcaattgctgttccaacatgctcgagtcaattagtagtaatttctgaacattcttcagtagtactggaaatacaacattagcctgtggaaattatggcaatggtacatttgggagtcatatcttttcttgttatataactccattttgttcattccactgttatcatactgtaccttcttaattctacagagaaatccatgctgaagtttggcagtatgttttcagtgattggtcatctcttaaggcttcatcccaatattacacgtccttgattctcaagaatacacttcagaaaggtaggtatttagcactccttagttttttttttcttttttgaaactttagcacttgttagttagttggacaactgccatgaacctaatgagtctcagtcttgcagggggaaaatgggcgaagaaagatgatgacgcgcttcatgatgttagtggaacacccaaaattatgacttaggtcactgggcatgtcttgtgacaattggattggttgatctttctcaatagaagagaggaaaaggcaaatggattatttggaattcggacagctttggacgtgcctgacaggcaaatggatagagggtcccaaaacctaatcttgcttgtatatctaggattacctttttgccactcaatggagaaatgattaacgtttcgtgattaactacacgatgttgacatatattgcaattttatttgtaaccaatcctaggcagaaagctgctgaattggtactcacttagtcacttgcctcttgtgttgaagcggaggggaggggatattttgggcttgattgggggtgcttttaacttctgtagcttctccgagaatcagaaacttctctaaacagttcagcttttgtctggattctaaaaaactgtagttataaaatctagaaaatgaattaaaagctagaaggtaggaaacctacttttccagatcatcataagctagctaccaaccagttgcttcttagaatctcataaacatgccttttgtcatcttctgttagcttacttgtactgtggaatcatcatctaaatcaaacttgtttgttcataattaatcaaacttgtttgttcaaaatgatgagaaaattgcaatattaggactgtaaacattggggtttcgcacttttgacacaagtgggtgacaaataggcccatttgtgtctataaaatgtgggtcctgtgtcattatagcaaatgttaatatttgcaacgtcataattgcaaatcccccgaaaatgagtcgttcaccatctttgccactttctcgcgaggtagcatagcagtgctcactgctcagtgggagggagcatctcgccgtttcaatcggatcgggctccacaaatccaatcccgaattgaatgatgaaatgcgcggcttcctccgccacgccgagtcgcgaaccccgcgggccttcgtccaactcctcgccgcccagccgccgcgcccctccgccgccgaccagtgccatgccgccgccaccaaactcggtttctccgcctccaaccccttcgccaacaccgcgctcctcgccttctactgccgatcccgccgcctccgtgaggcacagcacctgttcgaccaaatgcccctaaggaccgccgtcacctggaacacgctcatctacggccacgcgcagtcgaccgcgcccgacctcgccgtcgcggccttcgcgcgcatggtgcgcgccggcgtctcccccaccgcgtcgtccgtgtccagcgtcctggtcgcctgcgtcaggctggagaatgccggtgctggagcaatgctgcactccgttggcctcaggtgtggcttctttgcttctgtcgtcgtcggcactgccttggtggacatgtacgccaaatgccgtcgtttgggcgcggcgcagcaggtgtttggggagatggaagagaagaacgtggccactttcacggcgctcgtgacagggttcgttctaagcagaaggcctcatgacgccgtgctgttggtcagggagatggaacgctctggtgtggcaccaaacttgatgacgtacagcagccttctcagctcattcgcgagcccggaggacatagatcatgggaagcaagttcattgcgcagtgcttaagaagggcttggagcacgatccgtttgttctgtctgctcttgtgacaatgtactccaagtgcggcatttgggaagattttgtcaaggtgcagatgtctgtttcatgtcaagatcaggtatcattcaattccgtcatttttgggctctcctgtctgggaagaggtaaagaggcgtttcaacacttcttggaaatgagaaggcacggcactgatatggatgtgttcacctttgccagcatattgaaggctataggtagctcatcctcgttgctagagggtaggcaggttcatactcttattctgaagattggatatgattctgttgtggatgtccagaacagcctgatttccatgtatgccagacatggtgcaataggggaatccaatggcgttttcatttcaatggaagcacccaatttgggtttttggaattcactaatgtcgggatgtgctcaacatggccatggaaaggaggtagttgagatgtttgaacaaatgaggaggctacatgttcagccagaccacataaccttcttgtcagtcctcacagcttgcagccatgttggcttggtagataaagggctcgagtatttcaacttgatgaaagataaagggtatcttgtgggagcaaggacaaaacactatgcttgtatggttgatcttcttggtcgagcaggctatctcaatgaagctgaatacttgattaatggcatgcctataaaacctggtgcatcagtatacagagctctgctcagtgcctgccagattcatgggaaccttgagattgcaatccgagtgtccaagcgtctaatggagctaaatcctcatgactcatctgttcatgttcagttatcaaatgcctttgctggtgatggccgttggggtaatgctgctgagatcagggagaccatgtcaggtaaaggaatagtgaaggagccatcttggagtcgtattgaggaccagatgcaacatagataataagcagcctgtgcttacaagatgcatgccactgtcttggttgctacctagaactgaattatagaccgaagctctgagggtgatgcttaccgaacgaagcaagctagaaatatgtgtaagaaaaggtatgccaaagttagtgatagatttgactacctgctcgtaaatttttggaggtttaaacagttaaacttccttctgctttagtatgaacctcattgcgtttatcattagtgagtaaagcagcaccagattggataattctggtgttataacgatgagttctactggaagcaagataactgatcgccgtataactggagcctaaattaacctgatgtaatgaaccctttagcctatttcttgttttgcataagcataagtgcataacagaaagtgtatttcagttaaacaagaaacatccacttccttctgtacataaaattaactcttttttttcaatctttttttacagggcctttgcaggcctctatggctgtatgtgaggctgtgagctaattgtaggccctttacaatagaaccagcaaaatgtttcatcctaacttgctgtgctattgttgcatgatatagcataaggttctatccatgcaatccttttgttcactgcacattgaactcatcccttgtagttttcagcttgcaatgttctgtgagaagacaaagataagagttatttttcttaaaactgcacattgaactcaccccttgtagttttcggtttgcaatgttctgtgagaagacaaagataagagtttttcttaaaactgcacattgaacccaccccttgtagtttttggtttgcaatgttctgtgagaagacaaagataagagttttttttaaaagagtttaagaaagagtggaaggcgccagtacttatttgacccatatatagcttagtacccacggtgcattttcttgtttgatatgtgcttttgttattgtttcctgcacatcataatttggacccagttttgcaggggaacttccatagaccgagggaagagctggtaggactttgtaccaagcaaatcgaggagcgtcaagaccgagtggcttaggttggtccatcgaagtgggcaagggggagaaacgaatcagaaaacgactggcctggcctgatggtagaatccatgttgtgtctgcctctcttgtgggcgctccagaaaccaaaggggatcactttgagtaatcattcatacacaagtaatcttgcttgatggccagtcatgttacagactgtatcatgcagtttgatgcctgtttaagctaagagaacgggggttttccttcagtttgctgcttgagagaaagcttgtgacaacaagacgaaaaaatgtcatgcttgaggcggtttgggccttgatggtttgggccgaggaagcaaagaagcccaccgagaggatgaaggagggcaatcctccgataccaccgacacgggagagcctccacacctgacctcagcaaaagcagcagatcgacaaattctccccgacacag

SEQ ID NO: 60958 - DNA, 3170 bp, Oryza sativa
tcatcatcattactcacatagttcacaacattattacatgggtcatccaacattattacatgtgtcatccacagaaaagcggtacaaacctcggttgtcataacctttagcaacaaatgtttcatatttagacaggacacatttattggactcaaacacaagtttaaaattttaaacattgatcgtgccaacacatgcgaaccgttctgcatcagcaaggaggaatctctcctgacctgataaaaataaaacagggaatatcaacacacaaccaccagtatcaacccaccacttaggtgaatgaaatacataacgaactgtaggtaaaaaattaccataccaagatgttactcctccatcgctaataaccatgtttgcagattttttgaccttgcgatcagggcaatacttggcccaatgacgacttaacacacacacacaaagcagttatcctttgcctttctcttgccttttttttttaaaattggttatagccttgggtttgatatcatatatgactttttttcataaaattagttgtagccttgttgtgggatgcttgagcattccttttctgcaccaaatgctaaaacctccctcaaactttttgtcgcggttgttctttgctatcaccttctcctcaacacccaaagaggcaatgagatcaataacactgaacacttgcctcatgtgttttagacaagtagcaaagtccaaccaatatgtcatctatcacaaacttgtctagcaactcgtagatgttgttctcaagttcctttggtagtgcctgaaactcatgagcttgttttactatagaacggtcatcgacgatcttatactcatagcaatgtttcatgacatacaactcactgccagtatcgaagactccgaacatggcctcaagtgcatcccacatatcctttcgtgaaggcatgtgcatgtacacttctactcttttgttggctaatacacttatctatgctccacggaacaagcaattcgcgaactcgaacttagcctcctccacaggggagagaccgtacgatcgtcttgccctatgaaacaaagaaatattgcatagccgtcaaccacaatagtgcacgtgccttctatctcttataatttgaaccatcaattgcatgaggtttaagtgatgcagcaaaggcaactaccaaaaagacctgtcaagtttttggattgttgaaaatataatcataatctctactatcataaaattgaagatatttttctggtattttggtaagtcatccgtgcttgagtcggttttaatttcttgtttcggttttaatctctactcctcaaaatccgtaatttaaaaaagggcgaaaaaaatcacacggaaaaagaaaacgcccataaaataacatgaaagataaacagggaaaaaaacgtccgattcgtaccggaacgaaaaaaaggcaaaaaatgctgggtaaaacaaaaaaaaccgaccataaaaaaatgcaggacattggcaaagtacttcagatataacatgtactactcactgtagttatgtggtacttctattcaattaatcatctctcagtacacattgcacaaagttataagttctcacccgtagtttacattaggaccagttcgattattgtacttgtaacgatgattcatgctgtcatgcatgcataaagcggtgcgtggatcctacgtatgccagccattaatggataggttattatcatttatattctcttcgtctcaggacaaaccaacttaagatataagatgctactcaactaaggtcctgtttgtttcagcttaaaattattgtaatctagactattaaatcagattactctaagcaggattataataagctgacataaaataagctacgagttgtttgtttctctagattattagagtcatctaagggtagtgggtcattagccacttaataatctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttggtgaataaattgtaaatatcaaaaccaataatctccgatgccaattgttcatcacagaataacaatcaaaaacacctttaattttacagttacatagtctagtataacgaatctgaatatcatcatgtccagat

SEQ ID NO: 60959 - DNA, 9012 bp, Oryza sativa
ggtcaaacatttttaaaaaagtcaacggcgtcaaacattttgggatggagggagtagtatttattgggtacttgggggaactctaatgctagctatggttcttttttgcatgagttcttttgacaaccctacatcctgcacctatttgtgctgattttgttgtaatttattcgtagatgaagtaaggatgtgggtgtttgaagaaatattaccaacaggcaagaagctctctgagtccattaaccaagcaaatgtaagagttcaaactaattccccgtgctttattttacttctggaatcagtaaatgattctagcatgatcctcgcatattacaggagaattgcaaatacttacctggtataaagctcggagctaatgtaattgctgatcctgatttggagaatgcaggtaaacaccgtaaattgtattcctaattataattattcttaattggatacattgctcttggatgctacaataatgcttagagatctagttaatgaaggaagttctcttcaccaaaaaaaagaaaaagaaaaagaaaaaagccagcagctgcttcagtaaaatgaaaatcaacttatagatacactcaaaattattagctttgatgtgctatttgatactactttggggggtgggtgggatgttgtaatataggtttcataagcaaaatgctatcatcattgcagcctccctgtctacatcatgctttttttcatcttgacaaacaaacacccataaaagtctcctttttttttcagtgaaagatgcaaatatgcttgtttttgtgactccccatcaatttgtggagggtatatgtaagaagcttgtgggtaaactaaggccaggaactgagggtatctccctcatcaagggcatggaggtcaagatggaaggaccatgcatgatatctaaattaattacaaacatacttggaatcaattgctgtgtccttatgggtgctaacattgcaaatgaggcaagcatcttctgaacttcccatgcaaagtttctttgtactccctaaaggtgaaaagtaaccaggtgcacctttcaaatgcagattgctgttgagaaattcagtgaagcgacaattggatataagaaagacaaggaagtggcaacccgatgggctaaactttttacaacaccttacttcctggtttctgttgtaagttcaaccataaaatctcattgaaacaaaccctctcaccagagtgattcctagcagtggttcagcagaaaatgaaaaacctgtgtccttcatgtacaggtagaggatattgaaggagttgaattatgtggaacactgaaaaatgtcgtggccattgcagcaggttttacatgtttgttaatttgtagtagtcattgtttcctttcaaattttaatatttaagtgatggaatcaacttgcaggtcttgttgatggtttggatatggggaacaataccaaggtatgctatttttattgaaaacataacagagaagaattttcattgtatcatagagtttaatgatctgttttatctatttgtcaggctgcaataatgaggattggtttgcgggaaatgcgtgctttctctaagcttctatcccctacagtcagggacaacactttctttgagagctgtggtgtggctgacctaataactacatgccgtatgtatctcattgttctccttttaccattgagctgacaaacactgacaagatgagtgtttcatggcagttggtgggagaaacagaagagtcgctgaggcctttgcacgaaatggtggcaaaaggtttcttgtctaaaacatacataatgtcttttgataattttactctatactttaactttgttagagaatcaaaatacaaagtatgtcgatgttgatggcctatactaaagagttttcacatagatttttttttctgttttgtgatgattacataataactatggtatttcatcattcttacaggtcttttgatgagttggaggccgagatgctacatggccaaaaacttcaggtaagcaaatatctggaaccaagcaaacatggtgaattcgttgccttcttagtgcatctaatctttattagtttcacttgcagggagtgtccacagcaaaagaagtttatgaagtcttgacttatcgagggtggcaagaattgtttcctcttctgtccacagtgcatgagatttgtattggtcagctacctcctacatcaatagttgaatacagtgagcacacgcccaacctctccatcatcaatggttctaatgcgtattactgagctagattctgcaaattgtattattgccactattctcagtatcacttgttacaacagaacaagttgaaacatacctaatgtctgaatccgttatatatataatattattattcagccatgtcacctcataaagtgcatgactgattatgtgtttctgtcccttgttgtttggaaattgagtgaccttgccagaaatccatggattggaataaacaaattcagtttatatggaaaatagagtgaaagaatttcatggtataatttataagggtgcttcttgaatgaaacaccacaaacaacaggccatgcttaagtttaataacctggaagtttaaaaagttaatgaccctcgcccaaaaaaaagaaacaatttacatccagtatgcagttcactgttcacccatttcataattttgtaatatagtgtgtttttacaaacacgctgtgtacattgtttccaacttccaagtatcacaaaagaaaactaatatttgagcctttatatttagagctttccacatttcaataattcattgtatgtagtaaagaccaaggaaatgttgagtgataatttgggaagacttaaatagtgttgttttggattcatggagtgctgatttgatattgaaatgttaaatttggaaggattcccaattacaaactgttgatcaggccttgtaattttggagctgcttttgctgacagacagagcaacaatggattgtagaactataataccatattcctacttcctagatggaatgtttcatccgaaagcctcactggcctggaatcatgatgggtagaggggtaggtggaggtgtgcaaggaacttgagagcgatcactgtattgccttatatgataagtaagcaatgaactaactgaatattccaggaccaccaggtggacttgatgcctgtgctgatccagttctgggtcattgggtgtactgacgatatcattggacacaaacatggagaacatttctaatggaagaaattgcattctaatacagtgaaacacaggaataaaatattagagactgaatttgaacaaataatcattctactataattttctgaatcaattggaattcaagttcctagagttcacactatgacatggagaagaagtttgcgagttatgtaatgaaagaagttaaaagtgtactttctatattttaagtttcgtccaatgacttcatttaagagtagcagattttgcacctagcttttgtcatgcagattttgttaagcttctcttagctgaacccattttcactattatcgaagtttgctagttgaaaatttggtctttgatacaaaatgctgcttcctttcagtaaattttagtggccttagaattttacaatccaagtaccttaagaaccttcagataatgcaactttctgctataggctacttgatacagtgaatagattgttgatttcctttttgaatggcatgtgtttctgatgatctattttaatataagatgtatttcttttactcttaacacatgcaggtattacttagaaatgatatttattttaggagtgttttgtattccctggacagttttcacttgtagttctccaatttcatctcaataatcaaatcttaaacatattgcaatagcatttgccaagataaaattattcatggtacagtatccactatatgaagatgaagcggaaacacgctaatgattgttcatgtcctgtcttagatgcaaccaaaataaactatttcacctttcacggattagttgatttatcatattttagtggattaaattgtccacaacattttaaattccaatcttcctggggaacaaggaccaaaagaatctgccaaacacatcactttcatctttttatgtctacaaagtaacttttggtgttgagcctagacaagacacaaacaagataacatgaaatacctccaaaacttgaacagcggaatttatttggagtcatggcaatatgctcatcgaaattcaggacctagtttctttctttaaaagaaaactgtgactcatgtttcaattccaactggcataagtttttatttctattgtgacctgacatgaacccgtttcaggaatccactgaatgctgttctctgaagatgtcatcaataacagtttcagcttgctaaaggtcttgaaggacctctgctttctagtggagcaaggctcaggaaattcttcatgtcagtgttcttcgttgcggggtcatcaactcatctgtcagatcttggacatttccaggccttcagcaacagtccatgcaagaagtcgtcagaatgcacttacatttcacatctgtttatgactgattacacattatgctcatatgtgctttatttttttaatgatacaacgcatcagtatgtgagcaatatagtttgctcatatttgttatcgtctaacagtggcttgttaactatgttgaggttttatattcacaactaaaaactttgtacgctgggaatacttaaaccccttaacagttcaagactccaggctgtgtttaatattagtccaacatttgcctgagaattgttacttgcttgatgcacttggtactgaaatctgcaaatcgttgttatcattctacatatgcctgagaattgttgcttgcttgatgcacttggcactgagatctgcagatcgttgttgttatcattcattctacatttctctgataaggagtccctcccgttcaaatatgattatgattcgataaaaacaattgaaagtagatgaattcaaaagtcatcaggctgaaattatctgacagtacagaatctgtaatgctgcagatacatccataagcatatctggttgagcaaggtacagaaaatgacatcaaattagagcagccattctggaacattcatcagtaccatggaaaatatgatcaaatatccatttgatttagtcacattttaccagtattagtcttagaaccataacaaacatgacagaccatgctggtacaaaatacgcaatcctcggatcctcactaacttattaagttcttgaccttttgaaagactgacaacaatactaagcagactctgacttggtgtagatccttacagcaacagccaatcccaatatcgccaagggaaccaaaaactggaggatcttgatgatgaactctggtgtcttatcctggttgtagtgtggttgcttcgggggcgtgtacttcaccttggtgggtatcgtggttgcgtcaatgtcgccgacataatactcatccatcatcgcccgagcagtggtgctgtgccccacatcttcgaagtcgtcggtagcatccttggctgcaatattcaagtaccattgtaagctgaaatcagatttcctgaaaccttatcgatcaacaagtatgcaatgcagcaatggggctttaccagtcgaagacaacaagacatcatcacctccagggtgatcctccaaaaacttggtcacattgtacacctgcaagtagcaaaacaaatacttctatgagtttgatttgtgtaaaggggatttttttttcaccatataaggcctcgtcaatataaaagcaacaataaccaagcacatttcagtgtataaaaatgagcaaatgaccctagcaacctcccttatagaacagtttgttgaaaaaatacatatcttttgatcagccaacatcatgttcacagagtcaaaatagcttcttgacatatactacacgagaacatataagctccctaaagttctgagcatattttaaacaggcttgttcatctgattgaactggaaatagagaagtaagcaaaactgatttttccttggctctatgaagtaaaagatcttgcattattctttagcgtttgacatatcaacagaattgtgaatcctatggaataaaagatgaaacaagagctgcacatttagattacaaagaacagtttctcgcattaaaccacaaaatatttataccaggactagtgaggtacattcttatataggctccatgaaaatgactggttaagaaaagatgttcaggaacattacaggaaaaaaaatgtgcagtaggagattctcaacaaaaattaaggtcaggataggctaatttatgagggatgtttgctatcctatcctatctggaaagccatatccgcacagtgatgaaaagtttgtccctaaaagttcccagcaagaccgtgtgtcatactaatcaaaagaaaagagaagagaagagaaaagggagaagaccttgccgccgatgatgagccagcaatcgtccttggtgttgtgcttggagacctcctccagggtcagcaccttgttgttggacatgttgatcttgatcgatcttgccctcctcttgctcctgcctcctgctcctctctctcccaagtcccaactggcaactaccaagagatgagatgagagatgggacgagagaagggacgaggagcgcgaggcgaggaggaggaggagctttggatccaacgacgaaagaaagagagagagagagatcgcgaatgaggaggaggaggaggaggagaggattgaggagcagtagagttgtatagtgggagtaggtcgaagggcccaccagtcatagtcagtttggttggtgggtaagggcgcttgtctcaccgaccccaaccacatggttccttttttttttcttttctgtgtactccacaccaacaaccgtagcagctagccagctagtctgtggatccgatccgtatgcgactagactagtctggtgtgtgggccctccctccctgtatctgtatgttgtacaaatacggtactactgtacttcatgcttttctgtccaacagaagtagtggtggccaattggtttacagttatactacacggtttatacagtcttttggaaattcaaattctctttctgaacgaccaccaaaacttattcacgtaaaagagaaaaatgtgcaaaaataattgcttcttttttcctactggtttatgtttttacccaaagtataaactactccctccgtcccataatatatctagtcctaggatggatctcatcccatcctaggttgctatattacgagtcatgtctagatacattgtcctataatagattccatcccatcctagattgctatattatgggacggaagccaacctgccaagtctgcccaaatcctatgcaactctcacttgcttcccatcatgtgccactaactctataattatgaactactccccacgtccctaaatataagagattttggtgggatgtgatatatcttattacaatgaatctggacagaagcatgtccaaattcgttggactaggatgtgtcacttccaaccaaaatctcttatattttagggacggatggagtatctctcattcagctatatttatatcttttttttttgtcttcttggataacatacataacttagagtgtgtttggttcacggtcatgcatggataggatatggccatccatattttgttggatatggcgatctaattgctttattatgctctactcagttgttatctctctagctaatatcgacatggttcaataatcgtatccgggtgttttcctttttatcgtaaccagacattttcacattctatattttttttaaaagcaacagtgaagacgatataacatggggatcgatgtgggaagaaggttgatttttcggctttctaaagatgggaaactaacagaaactgaaaagcaaactataataagaccagaactgagatgatcgaaagattttaagagagagagagagaggctagtttggtcgagttcgttcttcgttttttatttttacgaatttgtgacagccccaaagtagccaccgattattaataaatattacaaagaaacaaagagggaatcccagtaattattacatctatccatcaccatctttaattttcaccgatgaaaaataatgagagacaaacaatcttgaaatgtggatgggaattgaaaatgaataacaatgaatacgagtactgagaaacacttggaagtgccgagataacaacaacgaactttacaagcaggatgaattaagagagtcctcttcttgtgttattattttgtatccttgaaattaagaaactgatttaatttaagcgttcttggttgggtaggaggccatcttgttgatgccgcagaggccgtcgtgcttgccggtgcccctcctcatccggatgtaccccttctcaccccaatgcgatccccacgagttcttcacgatgatgtaatcgtgtcccttgctggccgtcccgtatccaacggccgtcacgccatgatccagccgcgtgccgcacggaccatcaaacacaccctgaccgattaatcaccattaatttcaagtcaggacaagaagaaaatggcaaattaagaagtaattacaaacaatttactactacaattaaattccattaacctatactcctataaagtctctagtgatggtggcagtgaatcaaacacccactgctgtttttaaaaattgactggtgatatcttttgttattatggaatagcccaaatattcagttcaaacaaataaacaagtggtactaatatgttcgataatttttataatatttattacatactataatatattttcttttatctatagcaaagcatttgtgtttttttagctattgaagagagaacattgttgattaattgtttcatacccg

SEQ ID NO: 60960 - DNA, 873 bp, Oryza sativa
ttttcccagaaaatttgagtgcattgcatcaacccttcgctcattcatcttctcatacattgcaacaagaaaaactaatattataaaaaatcacatgattaggttacgatttcgatgtcaatatagttttgaaaatgataaggtgatttttttggataatggattaaattcctgcctttacttcaaataagctacaatcacttattacaaaattctctcaaagagagcaaacattcagaccacttcatagcgacgggcacgtccagcaagaacagatccaatatacatcatcaccatggagaccaataccatgtagacttctcacagcatgactgccagcaagcaccacatgtaggcgtgagcgttaacgaaggaacgttaacatagagatcgaactaagaaggcaggtagatcgccattactcaccttgcagcacgggatgacttaatgttgacttccccaaccatgagtggcgttcgacggttggagtccgatgatcattattggtggcactagcattatactacctctaatgttttgacttttttctaagttaaacttctatatatttgatcaaatctatagaaaaatatagtaacattttcaacacaaaataaaccaatttaataaaaccaattatattcaattctagatttaataaaagcaatttggtattgtaggtgttgctatatttcattataaatttgattaaaattaaagaagtttaacataggaaaaaaatcaaagtgtatatatggtaccaacagcagcagcagccgcaatagccatcagagggttcagggtatcgccgtgtcacaccctgaagttcttctcccaagcctaaatcattttaataaatgaccccaagatgat

SEQ ID NO: 60961 - DNA, 1963 bp, Oryza sativa
aatcgcgtgcgatgggatcaccgtccgatatcccgatccaacagataatatcacatgtgtctgttagggttggagtcaccatcaccactacggaattttaaagcagtagagattattgcagcctagttcaatttctctgtatatctctctctcctgtttctctttctcttcgatctctcgtttctaacgatctctttcctctgtacacaggccaaagccagcccagcccaacccaagccgccatcctccccactccccactgcccacgcacggggacaccgcttctgcttcgtcttcaatcctcggacgtttttcctccatgaaagcagcaacgtatccactaattcccatcacccatcctatcatctccctcatcaatcttactgtttaatgccaaaaatgaaactacctcgatgagctgaatccgtttctcaaacttctggtgacctctctaccttcctcctccacacacaccactgagtatgaatggccgtttttttttcttccaatctactcactaatcccttcctctcctgaatcaattttgtcgaagcaagatttcggcaataataaaaggggtggctatcaagataggaaagtggatgggtttggagaccaggaattttatacaggttcagggccttcttattcaaaaagtaataccctactcctgtcgggggattgatccgccgagtatattattgatcgtatgatctgggtgaaattcgtgcccctagaggcacccggacccctccttatataggggaaggggtccgtattacaaaatacagtccatatccctaacggaatatgtagttacagataaaatacaatcgtaaccgactaggatctcagatattttcttgacatacaagtttacattttaacctgagtccttctaaagatattctatctacacatggcaccccatacccagtcggactatacatgccgtgtaggtatggggtatccataatctccacaactaggttgtttacctaggaatagatgtcacctcctttcagccatatttctatctaggtggcagcctagtccgattacttggcctctacatagtggctactgcttacttgcttagcattttctagaatactgaatagaatttagaaataatatcatgtcttagccaacaatatgatagtgtcaaagtaagggtatggaaactggtggcattcgatattggaccgaatgagcctgaatagtttaattttgaattagaatgttattgatttcttatagatgtatttattctgcctggttactgactagtaataggtccggctaccggtcactggccggtaaacattatttggattcaaatatttccagtaagttctggtaaccagcaataaccaaccaactaccagcgttgcaaaggagacctgcatttttgtattgggttttaaaacctcggttcaagcgaaaactcaattacttggagatggaaccatagcttgttagtgtttgagttttgtcaatttattctaaattttacttggaaactatgtgtagcaggaatagtaaatggtctcatttatcaattctgcatgataagtgcatgcttaagtttgcttgttctcttgggtagtgtttggttgatgggatgggatgggacgggaccaacccacttttagaggtgtttggtttaggggtgagtggaatgggttggttcctagagaggaatattcctctcagatccgggaccaagccatccggaaaaatctggcggacgaactcatcccacctgggatgagcgcacggcgtgaggtgccgcttcgccccgctcgctcgctcacgtcgtgctctgctcctctgcccatcgtgctcgctcgctcgacgacaacggcgcgctcaagcgatggccacggccgatcccgtggtggggagggcggcggccgcgcctatcccgaggtgggctcacgcgacggcggcgaatcccgcg

SEQ ID NO: 60962 - DNA, 1661 bp, Oryza sativa
aacttcataaatattcaagcaaaagtcattgagcaacatgacttcaattgttccacttgcaacaacaaattcatcagttctattttctcttgcatgtatagactccaaatcacatgagtagcaacatcattcttcatatcagatgacaagtgattagccaactgggacatgttcaaccaaaaactctgtttctcttcttcctctgaaacaacggccatgaaccttactggtttttaagctgctatttcgacaaccagatctgccaactgccaaacaagctcattcatctagttttctgtgcaaatttctgttgctacaatctctgctctattgttttctgaaacatgtatcccacagggcgactaattagccatagaattaaaaaattcaatacattatttcaattggaaattttctagacagctcataaattttagaaacaatgaatacccataattttaggtagtatttccagaaacatgcagcttcagtttaggagaccacatggtggtcgcatcctggcggcgatatctgcagagggtcaccgccttatggcctaaacagcgaggggctccagcagatgaggcagggagaagaggtctctacctgcacgctgagccgcccctcctcctgcgcgtttagttgccccctcgcgctgccgcacggcgctctcatgcctgcttgctgctcggtgcccgctcaccgatgaaattagcccgccgctgctgctgttgccatgacgagagagccagggtttggtatggagaatggggtaacacacatgtaagggctgtgtggctaattgatgttgtatttgggggtataacaatccttttattctgtaaatcatttttcattccctttttcttttctttaactccctaattcttggcacacctaacaaacatccaaaccaggggcaaacgggagcttcggttacaaaagtgatggcaaaatcataaagtaaaaaaagaggggtaaaatcacaattgtgtttgaaaataggggaagaacacaatttccccatttaatttacattgagtggttctcagggatgtcagggactcgtggctgatgtttcagaaagtatttttggccaccactattccttgcaaagcattttgttccatgttgttttagcagtgaaaccgagactctgaaaatgcaatgctctatgctgctccctccatcccaacatataatgcacccacaattttaggaaaatcaacatttgcaaactttgactaacagttaaagtgtactaataatataatgtttagtgtcatgcatgtgacatcattagattcataaaaatatttttcatatgatgttaatttgtgtagtttttgatgatatatgtatgaaattaatggtcaaagttttacattgaagacactgcaaaaaaattatacgcctcaattttttgggacggagggagtattgaacttgatcactaaatctgaatacatgatactctagttacattccttttgttagctagttctgtctgatttcaagaatatatttagatatcttaacattttcttgagaccaccaaatgtccctgtttggcgtgtttttttacacaatttatgattttgtttccgattgtcaataatgaatggctaacaaccttcttatgcagttattggaattctaga

SEQ ID NO: 60963 - DNA, 1015 bp, Oryza sativa
cctccccctttgattgcttctccccttcatgccagcccggcgactctagagtagaggatccccatgatagatagatagatatgcaagtgtgctacatcatcatctactagtaattattatatagattattttaaatatcatataaatatgacatatcatttataatattgttgtatttttagaacttaatatatatgtaatcaatgtcgaaccattatctccacatcatttatatattatttaaacatatatatctatcatgtataatatgcattcatctatatattccacggcaaagtgtggtgtatcgactaggattctatataagtacagcagctgtaagcattaaaggctgcctggaaccacacacaaagcaggcagccaagcatagcccacagcaagctcgaccatggcgtccctctcctccctcctcctcggctgcttcctcctcgcagccgccatcttcctccaccgcaacggcgcctccaccactaccacccacctccatttctacatgcacgacgcctacaccggcccggctcccaccgccatgcgcgtcgtctccggccgctccttgctcgacgatggcggtgacgcggtgccgcgtcagttcggcgacatcgtggcgctgaacaacgcgctgacggaggggccatccgccggcagcacgcgcgtgggcacggcgcaggggttcgcggtgcgggtgtcggagggcggcatgtgtggagattatggatacccatatctacatgacagttgtaatttagtcggatatacggtaccaaatatagatggaatatctctatgaagactcgggttaggttctaaacttgtatgtcaaggaaatacccgggatcttagtcggttacgtttgtattttatctataatcccatattccggtaggatatggattgtattttgtaaagcggactccttcccctatataaagagggttcgtgtgcctcttgggcgcgaatctttttcccaaattatacaatcaataacacacttcgg

SEQ ID NO: 60964 - DNA, 1239 bp, Oryza sativa
  unsure (1)..(1239): unsure at all n locations
aagggccatccaaattttagccaataaccggcttaacaaaaagaagttattttgtggaaaccattttacaaaaatgtagcctgtttccctgtatgaaaccgggccctgatgacttctccgtcgaaaaaaaatccattttagcttcacccagtttccaggttaattaaaaatgagttgtgtaataaaaacaagcatataagaaagttgcctaaatataaatcaagtancatcattttacatgagggaaatttttattttttctattataagccattgtaaaaggttgacttgacactatgctaaaaatgcttatattttagacgaagggagtagtattttttaaatcacttatatcttttcaancggtatatatatntgtcatggttataataccacatacntatnagtagttaatttggcacggcgggacccaacacatatcaagtcttatacgtacctaatagtagttaattaagcacggcgggacccaccacatatcaagtcttatatgaaattaggcctcacttatgaaaggtattttgaataaggaaggacaagtagagttctatatggaaactatagggactactcggattgtatccatattggtccctatagttctatttggtcaaggggacacctatgggtataaatagaccccctaggaggagagggggacaatcaagatagacacagaccaatacaagcaaacacacgccaagacaagctgccagatatcaacatcaaaaataagcctagacaaacccaatatagtgcctgtagaggctaacaagggatctagcgctatctctaatctcgccgagtgcggattcaaggaggaagactatcccgttgtcgactacatcatggtattctaggccgccaagtcgacaacggttgatagattatcccaaattttgtactggtgtgattatgatgaataaatagcaacaccggcttcggccaacaggagtagggatattacttgccaaataaggggcccgaacctgtataaaaatccttgtataaaaatccttgtctctatctcttttacctcaatcttgcataaactttggtaccgacaatccccttaccatgtagttgtgacctaaaacatcgccaatattattttaaacatctacatatttgaacgatcgtacttcactcaaaatatataacaaaacaagtccagggtaccgagctcgaattcgccctatagtagtgtgtcatacctctgcc

SEQ ID NO: 60965 - DNA, 2228 bp, Oryza sativa
atttatatagagagcaagggtgagtacttacgtactcagcaagccaggggaacttaggtggttaatgcaagtttcaaagaataggttgttatttttcaatcagttttgttttcaaggttttcaacaatctaagtgtgtgctttccacaaccagagcgagacaagtctcagctcagtcggggtgagaagtaacaaatttatttatcaagattttcacaactcccagagttggcctcaaagctggttttcccaaaccaaaccatttttccaaacttcccaataatagtggtccccaaacgaccaatcacttccagggacttccggtcccactgtcccccggacagctaattgcttcccaagcattaggtttcccaaaccttaacaccttttcataaaacagggtaaaacaaaaactacgctaaggaatcacctcacattcgcccatgaccgtgggcacggctgttcgaacagtttaataacctctgtagagggggtacactatacccacacgacgttactagccttggtcacccagcccgtgcagaacagccacgtctggtgactttggggctttcacgacaaggtatttcgaaagccgacacagggttaccatatgccaatgagaggagtcccagaccaacaacaggttaggtcccagaccatactgtgccaggaagcccgggggttctccccgacaccaccccgttgaatccacatgtctcttggcatcaaggctcccttgattagctatttactcagccaggggcgtcccattccacccgtgtggtcgcactattgtatgctcggatgtaattccaaaggaatcggtccttagatgcgaccgcacaagtattccgcccaggaatggccttgtgtcgcaaattttatttttaaaactcattttctttcacaaggcaccgacccaggcgtcgggttttccaaagcttttgtaaaccaagttttacccaagaagttacacagattttaagtttgaaggagaccgtcgatactcgcacagagtgcacgaatatcgaggcgcaactagatagttacaagggaacatgatataacaattaacaatggaaggatcagatgcaacaagttgggtaggcccaccggtctgccttgcagacggggcaaatagattaagtgcaatcctatcaatgcataatatttttcaagcaaattaattaagttcaaatataggctcaatatgttcaaaggtggcttgccttgctcagggtcttgatcttcacgaatcttcaagaaatccgcttgacgaaaatccggtaaccgcaactatacgcaaacaatcaaaaacctaaccaaaagactgaaagaaagatcctatttagactaattaatagtgccattaaattgatatcaattttacggaactactggaagtagaacggagtcaatcggtcgagcggttgaggagatatggattttggaagcttaattggatttctggacaaggaaatgatctattggattttttggagtacgagaaatggcttatagaatttatagaaataatattctcaagaatattattgacagtcactgacatgcaggaccaatgggttgaattattggaatccccagattaagaggaaggattttatggaatttggaatataggaaatgttttatggagcaggagatatgatttattgcatttatggaaatgaatattctcaagaatatccttttatcactcattgacatgtggggccaacatatggtgagagagaggtgaattgggagggagcagatatagacttttggtcattgtgtttggcggagggagtaaaaatggacttcctttgtttcaatgggccgaggagggggagctggtcgatgggccaggcccacgagcggggagagagaagggggggggggtggctgactaggcaggggttgacttggtctggtggggtcagcggctgaggtggcgtccaggtggacgccacgtcggacagggaagggagaggaggccgggcggctcatcggatggccaacggcgctcggtgcgctccagcgaacggtggcgaatcggagtgggcggcaggcactgaaagcgagaggaggaagcggggaatcggttccacggatcggaccggagagaaggggcgccacggcggccggcgacggtggcgaagctcgccggattgccgacgtggatacgcgatgggagggaaaagggggcgcgggctatggttcgat

SEQ ID NO: 60966 - DNA, 1309 bp, Oryza sativa
aattgtttcataccccgctgtagaactggaagttcctgcctgaggcctcgatggcgacgctgaccggctggtgggccagggccttgagcagggcctgctgttgttcctcggaccttctcgtacccggagatggtcaccgccgccgccgcctcgccgtcgtcgtccccctccgtgctgccgcggcggcaggtgccttcctccatcaggtacgggtaggactcctcggtgtggaggccgccgttggcggcgatgtaggagaaggcgtagtccatgaggccgccgctgcagccgttgttgccgtcggtgtcgcagtcgatgagctcctgctccgacaggcgcgtcgggttgccggtcacgatggcgttgatcccctccaccgccgccaccgtcgagaacgcccagcagctgccgcactgcccctggttcttcacctccgtcaccgcccccttcttcctccagtccacctccttcggcaaacttgccgcctccacctcctcgtacctgaacaactgatcgttgctgttcctcctcgccggagtgagggtgaggccgaggtaggcagccttgaactcgtcgtgggtgaggtcggcgaactcgttgaggcccagccagtagccggtgatcttcttgttctcctcgtcgatgtggttgaggttgtccttgaacacctcgaacctcctcagcttctcctccaagctggagtaggccttgcggtacttggccatgaacttctcgaacagctccatcagcctctcatgcgacgccagatcctcctccgagtagccaactatggacaattcactgggcatggctaccgctacgcatgcgccgccgcacagcaggaggagcacaagagccaggggaagcttcgaattcattgaagccgccattgttgcaagctactactagtaggatgatacaagctgctgctgctgtgcatggtagagatgagagaatgcatgtgtatatatagcttagcttttctttctttcttagatcgattgttaattttgcttgaaagcaaagacacgatcgatcgatcgatagatcaactgcgtgtgctacatgttgaaggttatatgaaccatgcgagagctttaagacatggttagcatcttggatgatttggtatctgaagaactagactttgcttttaagcatgcatatgatatgaacgctgggcgcttactcttgtagtagtagtagtattatatggagcatcagggaaactgttttaatctctcgaggggatatcccctcgttttttgtatgtcacttaaatggttataaaaaatttaaaaaaaattgg

SEQ ID NO: 60967 - DNA, 26329 bp, Oryza sativa
tccatttgtacccatcatctgcgagcccaccattattcccacagcttttcatcttcagtgtgtacttgttctccatcgtcttgctcaacgtcttctccggcgagaaaaccctatatatttattcattcttttaattaattttatcatttttccaccaagtaatatatatatcactcctccaacgagcatgtcacaagtaaattaaattacaagcatgcgcaggagtaacatatatataagcatgcagttaattaagctagcatatatacatgcatatgtacaaacagagacagaggtagctacacttacactgggctacagctacttgcagcgaaattgtgaccgtcggcgagtagctgatggtcgccggcggcggtgaaggagagagcgctctcgatgtcgctgatggttggcccagaatacaccgtggagatgagcttgttcaccatcgactcccgccgccgccgcccgcaaggagcctccacctgcagctgctcatccgctgcagctgcggcaaaatattctctctcatcctcctcctccgcctcctttgaattggaatttgaatttgaattggaattggaattggaatgcaccgcggcggtctcatcgaggatctccctcaagagctcctctccgacgacatcgccgccgtcgcgccaatactctttgttctcttgcatcgcaccatccatatgatcaacctaagctgctgctgctacttgcttaattcttccaagataggatcagtttgtttatatggagtattaactggctggttagctagctagtgtgtgagtgtgactcattatataatctaccaacccagcccagggtatgcgtgtatatatagtgagagtgagaggccggagttcgatctctcttcatcgtcccaaaatgacaaatgtacccctcatggtagctagatggatagatcgatcgatcgatcgagtgttagcctgaattatatgtctatatacatatattcactgatcattatgtaaacatatatacatatattcactcatgatcaccaaacagaacaaattacgtgttgagagagatgagtaagcgcgtgtggtgcagttattaataattaaattaattcaatcggtgtaggttgaagcaggccaaaatggattgaattgaagatgggtgcaggtatgtagtaggtgacctttgattgagattttgatatcccggcctgcccttaagtagtaataatccagctagctagctcgatactatatatgaatatatcggacgtttgcaggatgaaacatctggagatgtgtttatgcatgttcaggaaactgcatatgtatattaagttctatatatgttactgccaagaattggcaatcgatggaaccaactgacccaacacaacatatataatggtgcaactaatatgcaattgtcaacaactaaagctagctagcatctatgattgcgaagaattgacaatcgatcgatcgagacttttaaccaatgcatgcatgcaccacctttttccactagcttttacccctgtgctgctacttctcctaattattctctgatccatttgaactgctcgaataattaattagtatgcagctaggtagggcatgcatgcagcactgcctccaaacaatctctagtatgtagcgcgccctaattaaactatgtatatatgtgggcgtagattaagctctctgagacgatatcctcttgacatatattataatgtcaaatattttttaaaatttatagaagttaaatttgacatttatgtttgtggagtgagatttatcacatatttatctatcttattgaactttataacaaaattttataattatttaaagatgacatgtaaacaacgaggagaatagtttctcctcgagtgtttagaatagtttcgccatatatatcaactatgaagtatatactactactgtatctagaaagcacatattgttcacgtctctatcgatggatacgatcgatggaaatattctgcacgcccagcgcagctaattaatcaaccaccacactgatagaaccatgtatatatatgctgaatatgtggccggagaaataactaattaagcgcaagttcagcggggctaggtatgcagctggaaactatacctaatctcatataatatccttgatttgtcccctaaaaagagccctacagagctgtcgagacgaaagaataaatgcaggaatgaagacaaactatgtttcttaataatttgatcactttggccaaacgcaaacatcagctagattattggcatgcgtgccaattcagtacggagtaccatgtaaaagctccacccatcttcaatatattccggcatcatacatttgattatgtaattgcaattctggcaaaatcttgaataatcagccttgtctccaaattaatgtgcagatcaacggcatagttatacatattcttaattaattcttttgtacttgtgcatattgattaattgatccgtggtgtaaatactcgatcaaacctttgaaacactggcgattaacaaattcttaaatgataaattagaaaataaataaacaattgatgtaaagttgcgcgcataaaaatggaaaatactatcataatgtcataaacgtattatattactttattatgatataaaattgattgttgaaattttacaagtccgatcaatattttacaaaatattgaatactacctttattttttaatgtatgatgccgttgactttttgatcgatgtttgactatttatcttattcaaatttttgtgcaaatacaaatataatagttaaatcatactttaaataaataataaaaattatatatttttttatataagatgaacgatcaaacgcatcttaaaaagttaacggcgtcatacattacggagggagtattaatttatgatcggcgcgtgaggaggggggaggggagagttactgtgttcgctagctcagatattgcctattgcataggcacaaggtgaatgatcgatcgaattggatagaagtatgtaggattcatatgccactagttcttgtgattctgtgaaggaagctgatgagctagctatctttatcagctacgctcgtaccaaatccaacaaaaaaaaaagtttgtacgcatgcatgcgcacaccgtccacgggaagaatacagatctgccgcctttggcgtcttgcatgcctttaatttggaggaggttgacttttgagagggagggcaattcgattggttgatactcgtaaaggaagtcgttttggacagcgacacggtttacaaaacacaattttgacttcttttttctataaaaatatttattgaaaagtaatatatgtgcacttttatgaaagtatttttcaagacaaatctattcatataatttttacatttttaaactcaacaatttaagagttattcatgatttatattttaaatgtttgatttaaatattgttctaaaggactttttctatgagtatggaggaagtataattaattagcagggtcatccatgcatgcatcgtcagactcacgtactgctggccaagctagcttaattaattacttgtcgatatatatgatcgttgatgcatgggcagtgacgtgcgactgcatgaataattaccaacaagctgatcgattgatctagcagctgccatactgatactgtactgctgcaaattaattactgtgcgtgtaatggtgaataaagagttgacttataaagaagggtactgggcgggcggtggaatgatgagatttatagtagtaacagtgagaggagagcatgcagtgcagtggggcactgacgacagtggggagcaaagcaacaagaggaattaattagggagaagccatgggatacgacaaggggttgacctgctgcatgcgtaacctgctagcgctagcttgcatggctggcgaccctgcctctgcatgcatgtactcgcctccattcgatcgattacctcgcgtttgcatgttactaggcgcgcagtagcatgcatatttagcttaatttgtcgtgtgcattggccgggactgatctgtgatccatccattcatcttgactcttgagtcagatcgagtcgacactagctagtactcatgcatcttcatcgatctactacttcgtatactccatctttctcgaaaaaaattcatttcttacattctaagataaaattagtgaagatggagaataactaaaatacccttaatcattaaaaaaacagtaatagtgatgggtaggtaaaaggtatatattgaagagataaaattttctgctttacgtgctgagggtaggcagtatggtaaaagttgattttctgtagaacaaaatttaatctgaagttaaattttttttggacagagggaatacaccattggtaataatatataattaagttaaccaagagatcaggtcacctgcatgcatgtatacgtatactgaccaaccgatcgatctcagtcgatcaacagcaaagtcaaagcactacaagctattgatattttcattttgaaggacagggttaaattaaattaagatggatcgagatatcggcggatctaacacgacgagaacgatgagggctcgagcctctactacggataattataggatcatgtgagtcatcactaataatttttttttcatatatatacaagcaaaggaagggtcataattttatttattttatttaaaaccctgctattattttctggatccgtatctcatctagagtcagcttgcatagcatatacacgcatggggtttgttggccttagcgagctggaccattcctgcttcctagctacatatatatattgttgggtggtgcgtgcaaaacagtagtccggagtagtgttacaagtaaagacagtatagtagacataatagccaactagatcgatcgatcgatataattaatgtacagtacatacacatagggtcaacgcatgcatcacaacgttagtactctcttcctagtaaaaagtacccctctctctctctctctaagcaataaaaagtacttggcatttgacattttttatggtcttcgagttatgaatgtaatcagtattatttgatattgaaaaacaagtttataagattatgacggatatgattttccaaaaactattatgagggattctaagagataatgataactgaggtttcaaatattcccaaaatggagtatatataattcaaaacgtaataatgtcttaccagatcgatggagggggcgcataatgttgtaccgtggattgaaataagttcactttagatctctcatcttgacatcgaatttgaatcgtgtcattgaaccataatactagatatagtgtgtcccttcgatttgcaatatcggagtacctaaggtcgcatgactgtattgtgcctagttttagcaacccggcaaaatcaacgtgggccccacacattaacaacctagtcttcttccacctatcaaccattccctcttttctctctctctcagcaggatgtcgggtggtacgaagaatggcgatggttgctaggagaggaattggatggcggtgttgtcactgcgagcacgagcagccgcctcgactcctctctattctaactggcactttattgggagagaggagtcgaggtgaccgctcgagagctccgtgccgtcgtcgcccatctcctctcccgttggctggcgcttgctacccttttccccattagccattgccttaggtttggtgaaatatgggaaagagatggaagaagggagagaggaagagaagaagactaagccgctaacatgagggtcccgcattgattaagccggttgaccacatttaactcgtgacttaagccaaaacctggtataatagtaccattgagacatcggatgctccgatattgcaagttgggggacgtgtggatatgggtaccccatacccacatggcatggttatccgactagttatagaggataacttaaatctattagataaggtaacagatcatgacttgggtattacgtttccttgtatattacggaacggcctaaagtcctggtttgataatattgtagagtagatttaggaaaccaatacggtattggttgaggtttctattttgtaaccctgccccccaacctatataaggctggcagggagccccctctaggggcatgagacaacctgatcgtcagatcaatgcacactcggcggattcaaatccccaaacaggagtagggtattacatctcattgagagggcctgaacctgtctaaatcctttgtctccgcatccatccacttttaggtctcgtgcgctacccccttttattattgccgaattcatgtttcgacagttggcgcgccaagtaggggtgcgtcgagttcctcgtcgaagagtgcgatggaatcaatttcaggagaaacggcgagatcaatctcaccgaattcaatggcttgaactttgaaccgggtttgttcattccaatctaatttttattagattatttttttatcatagatcgatcttctggtatattttcttgtgtcgatcttgtgtcggtcggcggagatcaagctgaagctgtcgacgacgccctcatgcatcgagactttcttcgtgttttgctgacggacatgtggtggctatcgctggtcacagcttaccaggagaaaacactgcatgagttgactcaactgatcaacatacatgcacgatccaaccaacatgcacattacatctacagagttaatctgtttactagttgattctaaccagcaattattttgttgctatctgtcttgcatgtacaccgccggccgtatctactgccggctatatccgtcagcgccgaccggctccaccgtctccgtagtcggtcgccttcgagctgttatcattaggctttacagctgccccggtcggtcatctacatgctgccgactctccgaggtcgcagggccgttgatggcttccgccggctactgctgattgcggcattgcgacccaagctgatcgacgcgcacgacgtatccaagccacgccgtacaacttgggttggctgttccaatttaatttttattagattgattattaattaatccctaatcgccggccgttttgatttcctggcaattttttgttgtttttcacatgatggttgagatcacgacacggccgtcatcgtctacgtcttcaccgaccggccgcttcgtccgccgccgactggtgtttccgcctgcacggctggcttattatgccgccgttgttgggcgtctacgacttcaccgccggcctgcctccgtcgccgccgactggtgtcctcgcctatgcggttggttggtcacaccaccgttcatgggcgtccacgtcttcaccgaccggctggccttcgccgccgccgactggtgtttccgcctgcacggctggcctattatgccgccgctattgggcatctacgacttcaccgccggcctacctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcttgcctccgttgccgccgagtggtgtttccgcctacacggctggcctattatgccgccgctgttgggcgtctacgacttcaccgccggcctgcctccgtcgccgccgactggtgtcctcgcctatacggttggttggtcacaccaccgttcatgggcgtccacgtcttcgccgaccgactggccttcgccgccgccgactggtgtttctgcctacacggctagcctattatgccgctgctgttgggcgtctacgacttcaccgttggcctgcctctgccgccactgactggtgtttttgcctatacggttggcggactccgccgttgttaatgggcttcaccatctacaccactggcttggttccactggcgccgactggtgtttttgtcaccattgatggactgcttcattcccacatcggctacttctgctgtcaccgagggaatacgacaaagctaagtcatcatttattttattctttatatgatatttttccttttcctctgcctcactacaccaattggtcttccattgagcagtgagtcgggggctacagatgttatatcatattttccataatatttatcttgattgcttgcgacataatctgagtacaaaagtacctatcgagttatggagttctatcttcctatgctttccgtttggtttgtcaatggatggttgcctttgggccgattcctagcacccgggggctcgttggatggaccgagtaacgcaaggtgctaagtattattcggaataaatcaaaagcatagagataagataatttattttctgctcttaataattaaaagtacccgagtagtaaactccgatccgtgaaactttgttccattaatgacgaactcatgtcactcatatgcatgtttgggaaatgcctaggtcgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgccttgaccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggttggcctttatgccgccgttgttgggcgtctacgtcttcaccgaccggacgcctcgaccgccgccgactggtgcttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctacctacgtttgccatggctgccgactggtttcttcacttccatgactgcatgattctgccagtgttgattggccttaccatcttcatcgctggtcgtctcgtctgctgctgactagtgccctcgcctctacatctggtttatacagctaccactactgatggacatcatcgtcttccgccgccgactcgtcttcactaccggtttgcttctgttgccgccgactcgtgttcacttcatcacggcaacacaactttgtcatcatggtggagcgacttcatctttattatcttcggcactggcaaactctattgctgctacttcacaagttttgctacatcaccaaccataacgttgttgtgaatctcgacatatcggcatgcgacgccgtgttatttaattacaacaagtggctctccaacattcatgatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcactgagttgaacaacagcatatactttcctccaagtgaagcatctacaacagtttgatggattattgtcactgacatcatcaccagcacctctgcttcatcggctctgacattccgccgttgctaatggatgattaagacttcgccaacttgctatttcgccttcacggttgaccaactatgcaaacgctgatgagcgtcttcgtcattatcatcggcaattacaccgctattgactggatcaccgacatcgtcatcttcatgattggtggatttcgtcatcgcctttgatatgcctcgtctgtcaccgactgattatttcgctgccatggctatacaactttatcgctgggcaccttcatcttcattgatggctgacctgactgttgccgactggttgcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaatcgtgactacgtgctcaggggcttactagctcaattacaagtattatatcttcaatttggacttgctccggatacatgcaacatgaattcatgatcataggtctattttatatgctcaaagactggactatttattattccccgtaagggttatcaactgaatacttgcgccagtcgggaatcaattgttacatctattttggagtatcccataagggataatcactcagattagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatctagtgcccaataccttaaaatccttttataccgcagttactcaactttttaggagttggtacaatgcatcttaaaaggtgtcaaacagtaaagctttatatagctgccccgctgactttttatatagtcatggcgctgtttgggtttatcaagcaattgattgaatacaacatcattgctttttgccacgtaagtgtgcatttttattgaccaatattatggcttaggctgattatatattttggtcattttccagacgattgataaatccttatgagtttatttactcggattttataccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatgttatttggaggattcacaccgcatatgctatatattgatatcaagtcacttggttgattacaattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacatggcatggttatccgactagttatagaggataacttatatctatagaatatgtaacagatcatgacttgggtattacgtttccttgtatattacggaacggcctaaagtcctggtttgataatattgtagagtagatttaggaaaccaataccgtattggttgaggtttctatcttgtaaccctgccccccaacctatataaggctggcagggagccccctctaggggcatgagacaacctgatcgtcagatcaatgcacactcggcggattcaaatccccaaacaggagtagggtattacatctcattgagagggcctgaacctgtctaaatcttttgtctccgcatccatccacttttaggtctcgtgcgctacccccttttattattgccgaattcatgtttcgataggacgttttatatctagcattacggttttggaggatggtatttaaactgtacgtcaccatgagggatttaaggtgaactaattccataaacatatggccacgaggcccgataaaagaaagagtacgtcatggggcctacctctcccaagagaaaagctcatacatctcgctcgctcggtttcttgcggagaatgtaatgtttgggggctttgggcccaattttgatcgcaagcagttgcgggcggcgaaacgatttccgtgtggtgtcctggcccactcagattcacgggccgaatttttgctttgatgctccgcctaggggtgagcgatggatgggccaagtaatctgttgggcgaaaggtgcatgcaagggcccatttcgtgttggtgagctagctgtggctgcttcttcttcttcctcttggtcgtcgtcgtcgtcgtcgtcatcgcttggatgtaccaaactcaagctgtagagacaaacgatatcgatcaggccggtgaaacttggtttttagacgaaggacgtaactaatattcagttggtttaataattaattaacgtggtctttctttcactagctaagcttgagaaggaaaaaagaagaagaaggggggcgtactccagtgtactacagggcagggaaaataaagatgcatgcaagcatgtgtcagccaaataatgggagcgggcgggcatgcatgcatgtcgtcggtcgatcgaggccagggcagcagagcagagccggcgggcggggcgggcgggagtggagtggacaggtcatggccggattctcatgcattttatttctgcagcagccagcagggcagaggagcaacgcccagccggcgctacgtgcatctgctctctgctagctcgtgcatactgccgcccttgcctgcgcatgcatgcatgcactacgtactactgtgcctgaattattcacaccagctgttgtagctactccctccgttccgttttagatcacaacacgttttgattttggtcaaagtcaaactgctttaactttgacttagtttatagaaaaaaatagtatcattttcaacccaagaaaaatttattacgaaaatatattcaattattgatttgacgaaattaatttagtattataagtattactttatttatctataaacttagtcaaacttgaaacagtttaactttaaccaaagtcaaaacgtctcgtaacctgaaacggagggagtagtagccatgcaattcaagcttaaaattgcaagctagtataatcttagtaatgcttaaaattttcatatttagtaaatcaagccatataacaaaacaaaagatatttacataaaccttttaaataagatggatagttaaatatgatgtaaaagtcgacaacgttacacattagaaaacggtgatactccctccgtttctaattctttttttaagtcaaaattatttaggtttgaccaaatttatagaaaaagttagcaatatttataacgccaaaattagttttattaatttaacattaaatatattttgatactatgtttatttaatattgaaaatgttaatatatttttctaaaaacttaaaaaagtttgattatttaaaataatcaaacaacttataatgtgaatatgaaacagatgtactccatccgtgctaaaaaaacacaacttagaaggagatgcgactcctcctagtactacaacgaatctaggaaagagaatggtagtcacatactgttctaggttattattattatttctttggatggatggagcagtatattgcagaccaattaatctggtgcgttgcatgcctgactctgatgcccccagctttggtagctactccctatagatcgatatgactgacagaaggatgatcgatgcatggaacgacgacgacggacatggcttggctgatcgatctgcttcccgccgctgtcaagcaccagctaccactgcatccatgcgcgcacatctcacatgcatatgttctggttgcattggttgggcgccagcactagcaaagatggatgaggtgtacgtccaacaccccagggccagcatattgcagcgcgctgattgcagagtgatggcctactacaaactaatagcagccagccagccctttagctatctatctaactccaacatgcatatagtacgcactttgtaagacaatgtctcaagaacaaaatatgtgctacataagtaccactattttccgcgaacacccaaaaggattgcacatcaatatataattagaaaaaaaaagttgaagttacacgacgtaatcagccagaccggcttatgccagggaaagcgagaaaaagcaaattaaaaactgaagcttagaaaaaaccatgaaccattaggagggtaccacctccgcaatgtaggcaacattcaagtgatttttatatttcggcccctgattatttgttattttcagccactgttgtaatacttgtcgatcattaacgccaaatcagttaaaacttttacattttagatcatgtaacagacaataagcctacataaatacccctaaccattttgtaggttcacctatccttgttttttccttctcccctagctactttctggcacttggacgatagctcacaatatgcaggagtatataactggtgcaggcaggcatccatgcatgcaatgcagtttgacggtagctggccgggatcggataggatcggaatcgcatggatggattcatcacctagctagctagcaatgcaagcatgcatcaaatcaaacctcgctgtcagcaacaattttgcttgcaaggagctcaccgatcaatccagtatagctatatgtacttcctctattttcaaaatatatatagtaccgtagcttaacaatatactccatctgttttcaaatatatatacttcaggttgtttaagtaaagattaagattaaaggaaaacattctatcaatggttcaatatattttgaattttaaattgcttggagtcattttctaagcatttggttgactgaaaaatgtttacatttttacattgaaattattatctagttgtgcataaaatttggacttgcttatgtttggaaacggagggaatattgtgtatccatctgtgtctcttttttttcacaattacgtagatccgcccttgtatgagtgtatccatcttgatctttagctagctactctctctgtcccataaaaaaatcaatctagtaccggatgtgacacattctagtaccgtgaatctagtcatatgaatatgtcacatccagtcttatattcgtttttatgggacgaagggagtagcgatcggtctttttctaacagccgctggccatcgaggcacatgcaggatcatatcgtcctcgatcggctagacggctagctagcttcattcgttgccttcctcaacataaaataaaattaaagctctaaagtatgagcaatgcttattcccacactaagcaataaggctgaacccgcccgttgtcagctaaagtaactagcaggaagacctcataagagcagggataatagaggagactgctatgggcttatgcaagatgttatagccagtgcatataatagcatgctctgtacacatactctactacaaataaataagcatttttatatgtttggtgggaccgacatgtcatataccttctttctcttgatatggatccaagcagtcagcacgtctaggcgctcgtgcctagcgggcggttgaagaagcgccggcttccttctctcacatcgctttttctcttccacgtcagctcgagacatcatctgttagctaatcgtctacttattagacttgctctaagccttggtgtgacttaaaaaagtgaggtgacactcatcaaatttttttactaccggtaattcggttaattatgtgatctggtagtagctatttactactctcaaaatatttattaatggttaactaacaagtacatatttaatgcttagtatatgctataccactgtggatgcactacttttgggtttgggaataggaataacgattgaaaatttttgctttcatcatacatattcaaaattccaaccatcaaatctatattagaaaatattcgtaaaatccgataagtttataatattatgactaaaattttcgttgttgtagatagtatttatttcttttttttcatgctactaaaatgaagttaatatagctattgagggcccaaatttttgtgtggctgttaggacaggccctgtgttggcttacgtggaggttgaaaacccagcgtgtactgctcctgccgtaagcaaaggtggaggtgacaaactgacggggacacggatggacggtcgggattgatggatgggcaaatagatggacggatacgatggatgggattggacggaaggctgtactcgggccccgcggcccagcggtaacttgacaggtgcagcctttatactgtacagtagtagtggaggtgtatttgcagctgcggcatcagagagagactactgtccagcaacatgtgctagctcgagaacatcaactgcatgcaaacagtacaacagcatgttgttttccaatcgatcaaaaatatttttcttttcaggtcgtgccatgcttgtacagtatacgtacataactgctctctgctcctcctctcttttaccgctcctgcaatccacatactgccaagtaatttttctcacaaccctactacagtagctctgacgagtactccatggaggaggagtagtatttgtttttctttggcccaagtccaaaaaaggtcccatgggccgactattccctagtcggctaaggtgtgtttagttcatgtcacattgaaagtttttttgaaattgaaaccatgtgatagaaaagttggaagttggtgtatgtaagaaagttttgatgtgatggaaaaattgttaatttgaagaaaaagttgggacgtactctccgcagcctaagaagaatactttgattttatatatatatatatatatatatatatatatatatatatatatagaaaaagagagagagagagaaaggagaagtcgtcccttgtaataaggtaacctccacacaaattttaagtaactagagagaagaaaagaagtgcattgggtagaaaatgtagtcaaagataatacattgatctctaggttaactttaaatttgtgagtagatgacgcgaataaaattagatgtaaccatcacctttaccgtaaaacttgctctaattcatcactctcctattatcattcacttatagaagttctataagtgccaccttgctgcttcgcttgagctcctctgtcgcattgttgttcttggcagggtctagtgtagacgaaaagaggtgtattttgttcaggaacataatgatggatcctagaaccccatagtacactattgaagtacagttggaatattcgagaatgaaaaataaaactatatatactcgatcgatggatcgatctccacttggtatatgtggcactacagagatatatgaccgtactatgcatatgggactttttctttttcacaattaccaagagagattgatgagatcaggcagcaagacttgcatccgtgtacgttagtggccggatatccatgcaaagtgttacaaaagtaaggcaggctgtggctgctagctagcttcctctcaagctcatgcatgcatgagaagcggacaaatcgagcagattctgcagcatatataagcatcgcatctacatatatatacgtacgtgtacatgtgccgctagttcgatctcactagctagctagtggccagtgttgtacgtatatactctctccgtttcaaaatgtttgacaccgttgactttttaaatacgtgtttgaccattcgtcttattcaaaaaatttaagtaattatttattcttttcatacatttgattcattgttaaatatactttcatgtacacatatagttttacgtatttcaaaaaaaaatttaataagacgaacggttaaacatgtgctaaaaagtcaacggtgtcaaacattttaaaacggagggagtatttgtgatttgtgatcgaaatgcatatatgcaagctgctaaagagactagagtagagtcgtagtagatgatcaagctagaaatgcccaaattaaagtatactaattacgtatgctttttttttgttaaaaaaaatgaattgatcgattgatcagctggtcgtggtcagtggtcgcgtaaatggcacatgtaggagtatactcctactacatgaagagaaggcatgcagtattgtactacatgaaagaaggatggtgaggtcaggtcatgcatgggatcctgtgcaacacgtacacacatgcatgcatatacgcagagaatcgcatgcagatgccgatgcaatatgtgccacggtcgatatatatcgatcataccatcaattcacatgcatgcatgcatctgtgtgtgctagaaagaaattaaagaaagaagaatcttcttcacatactccacttgggagtagtacatgatactatcatgcatgctggcacggaccgcttcaagtttagttgcgatgtactactagcagctaacagtcaggacacactgtgtactgttatgttagcgtggagacgagccagccatgcatatgtagtgctgtcatctgttcatttgttgcttcagcgtacgtacgtaagtaatagcagctggctgcatatatatatatatatatatacatacatatatatatatatacatatatatacatatatagatacatatatatatgtatctatatacatatgtatatatatatacatatgtatatgtatatatatacatgtatatatatatatcgaccttatctgaatgcatggctagcttgaccagctctacctagcttacatgcagttccctttaattactttccacctgcgtgcatatatatataagctgctgcatgcccaggtgcaggaatatcctactccttacatttctatatattcgataccgttgacctttttagcacatgtttgaccgttcgtcttattcaaaaacttttgtgaaatatgtaaaactatatgtatatatatatataagtatatttaacaacgaatcaaatgatagaaaaagaattaataattacctaaattttttaataagacgaacggtcaaacatatttacaaaaatcaatggcgtcaaatatttagaaacagatgaagggggtatatataagtatggcttcttaatcaaatattgctaaatagcagatctagtactacttgtatgttgcaccaagttttctgaaagtactacttatgtattattcatgggtctctcctaaggaggccacaaaagagctgaaaaataaggttagttacttagagactgtttggtttggtgccacacattgccacaccacatgttaggcatgccacagattgttagcttagcgtttggttacttgtttcagttgtggcaaaccacactttcttgtttcatgggcctacatgtcatatactcattttctaactaaacattgccacacttgttgccaacaaattgttggccacactttatttgtcatgccacatctatgacaaattgagttatggcaatgttaggcaacaaccaaacagacccttaattactgttcggaattccactatatatgttactatctatatatgcttgatggaacgtagcgagctacgtaacaagctcaagctggctatataatctttagcttgtaaacaaacgtacgcatgcaagagatacaagagatgaagatggatggacgacagctgtacgcatcgtcgtcatctatgggtattggaattgcatgaagccagccagctagctagccatggtagctggagtagctagctagaggtcgcataagtggggatgtcatgcattgaagagagtttgtttagtttcctctaaaggcaggccttttataatttctgccatgcctacccgtcgatcgttgcttgcatatgtacgtacacagcacgatcgatggatctatatatacatacatacatcatatatatccaggggcggatccagaaataaaaaattggaggactcaattacacagtttcttaaacctccagtcatctagagacctttagtttatcatttatagtgaaaataatagaagggggtgttccaggaggtatctataggtcttgtgggtgtaggggagactcgagtccccctgcacccgcgttggatccgccctatatcgatgaaatgatattgcatgacgtacgtgacgtgcttatgcatacatacatacatacatacatatatacatatatatatatatacatatatatatatatatatatacatatatatatatatatatacatatatatatatatatacatatatacatatatatacatatatatatatgcagctaacagcagtgaaattcaattactactcttactccagtaagtagcaaaatgcagatcagggaacgcatgcagtaaaagcctccgtgtcttttggcccctcactaccgatggcgatgtctaaccaccactctatgtatacgtatgtatctacagatcgagctagccaccatggctacctaagatatataggagtaatacgtactccctccttccctaaatgtttgacaccgttgacttttttaaatatgtttgaccgttcgccttattcaaaaaaaatttgtgaaatgtgtaaaactatatgtatacataaaagtatatttaacaataaatcaaatgatagaaaaagaattaataattacttaaatttttgaataagacgaacgatcaaacattttttaaaaagtcaacggcgtcaaatattttgggatggagggagtatatgcttacgtatatcaattgcaatacatgcattgcttgcattggtccctccggctagatagctagtcacatgcatcatcgtcatacatacaagtacatgcatgtacagtgacatgaacagaaagtagtgtagtatcgtagctcctcagtccttgatcgatcactcgcatgcagctagcttcatcagctcgaccggtatcatatatgtgtacatgttgatcgatcgagttgagtatatgactagtctgtgtgccacaatagcatgcacagtgcataactgtttcagtttggcaggcagaggtgcgtgcagataagccagctaagccgcccgtttcgatcctctgtatttatatgtgccatcctcacgcttgatggcttggcatatgcatctctctctctctctttctctctcagctctctttccctcttcctccatcgatcgatctcttgcatgcaagagcaacctgcttcgcttcagacaaagctccttgctacctaacaagctatagctgtagttgaacacacaacttgtgtccagatcgaccacttcgtcttctcttttttatttgtttcaattcgttcgagagctagtatgagatagaatattaaccgatggagagagaatgtctagctagattattcatattttgaagatatatatatatatatatatatatatacacacacacacacacacacacacacacacacacacacacctaccaccggcctctccttccccttctgccttgcgtattaaagctcctttttaatttcagcttgcagtgtatgtatatatatatatagctgttctatctttctgaagattcttggtaagcagttagctagctttattcctttggctctacctcgctgttgtctctgctccacctagctagctagctacctcttcctaatcgatcgcttcttcttcttcttcttcttcttcttcttcttcttcttctttttagtatctctaactagctgtgtgtatagagatattcctgggctgccgcaggttatattcgttattcttttcctattcttaaaacaaaaaaaaaagttgtagccactatatatgtgagagagaactagtgaacaaaggggatttctgtagctgcatgctaggtagctacaacatcagtaatctcgatatacgtacagtactacaagatagtgcctcgatctgccggcagtagagagtgtgatgccgcagctagcagtcggtgatttctgacgtggcatcatcaagattcacacattacattgcatgcatgcatatgtctatgcatctttgagcttgttgttctgatctcaacaacctagctagctaatatttctctcctggccctgacctgcatgatgcatggttgcacgcatggagagagaagaaagagatcgaagctaattaaacgcatgtgtatatatgtgtgggaatcttgatgatgctgcatcggaaattaatgactaagcatcagcttaattgtaccaacgccgccggcgagagtgatcctccctccctctttctgtgacacattgactagcaggtaagaacttatttcaataaacttgtttatatctagatgggccatataatttagtgtaggttaatttgtgaaattaattcactcacatttgattttttttttcagttgcatatatgtattcctttttggaggactggttatgacttagctaagctagctagggaggacttcacaagtcataacaaataagttgaatggttaaacatatttaaaaagtatatggtgctatatattaaaaacaaattaaatagagtaagttattactggtataacatcattatttagaaaagagagagaaaaaacagtgtgcaagttatactccacagcaaggagctagtaacattgacttttctttttgtcctgtagcgatggatgcatgcaaaaaaggctagtaggattgatgcggtggggggaatcaatcaaatccagtcgcgcattctacgggcttcaattcgatacgacatgtatgctgatcgatcaatgctgccagctagctgcgtacgtacatactactgtacgtatatactgtatgtacttctgctcctgcagctatatactgtacgtactacgcggtagagcactgtagcatacagtacgtacgtgtaggagttgttgtaatttgcagccatataggagtatcgatctctatcaaccatatggttcacaactccactccaaattataagtactaagctctgctaacattgctaacattgatcgatccatctcatcccaggtaataagtatatacttaacgcaatgtcacaatctatctaaaataagtagaatgtaacattttctactataaaaaattctgatagaggcatatatctagatcctattgcgttagtaaataacatatcttattacaagctaattattttgtgaccgagaaagtatccgggtacgtagtaggagtagtatatacatgcaggtagggtcatcatcacaggtgctagctacagtaacttgcattgtgtcaacaactcaggtcctgggctcctggctacctagtgagagctacgactatactacctagcaagatactactaatccgtactatactatgctcctcgactttacatggcggccggatatatggatcgatcgatatcacattggcacttcatgtactccatctgttaacgccgttaaaatttttaaacatgtttaaccgtttatcttattaaaaaaattaaataattattaattcttttcctatcatttaataaatatactagtactacttaagtttttaaataatatttataaaagtttttgacggttaaatatgtttagaaaaactaaaagcgtcaaatatttaaatacggagggagtatatatgtaacgtactacgacactacgtacgtactatatactccagtagaccactgtacaagtatagttatctcttcttttcgcaataaataaagcacatcatatcaggagtgacgttacaatattcatgtcgacacgtcgtatatgtacgtacgtactctactatccgtagcattacacaggtagctaagctaggactaagagtagtacgtacgtatgtatatatatgtacttaatacatacgcatacatgcctgtatcattcatcgatcctgtacaacgttgtagactactcacttctgattctgacttcttgtctcgtctcttcttcttcttcttcttgagctcactactagactggagtaggagtactaggcccacaaacccacaatctgtgcatgggccttacctagcaatagtccgtactaaagattctgtaaaaagcccatttggaaattttctagcgagggactattttgaattttagcccaacagcaatagcagccatttgtctcaatcccggaacaagtccactttgtcgccctaaaagaatgtactaatgtgatttgtatccatcaaccgcaatattagattagatatcataacccctcaactataaaaacgggtgcaaaacaattctctcgggtttttgctgacatggatcgttgaccttatctaactaagtaagacagcatatgggaccagttgaggggtcaaaatatatggtattgtggttgagggatacgattcagataggacatataactgagggagttaaagtggactttattcctcccaaccccacatgccacattgtacatttgtacacaacccaacccatttggaaaatgaaatggatgtagtagtagtatcatctactgttacgcatagtgcagtgccatgatctagagattgctgtgactaactggtcaggcattaaacaatttttaagcacgctaattaagctcaaaccggccggatccgacactgctacatcctcgagcacagtgccggcatcgattcggtttcgctagctgcaactgttgtccctgctcggtcagcttcagttcgtcgcaattacagcaattattaccaactagtataaattaatacatatgaagaagataacaaagaaaattggactacatatttatgtagctagctacaacaccaactttaaaactatgtatttatgaaaagtgataccgtgtattaatggtgtaatatatacttgtagataaatagattattagattgactatcaataatttagagttagtaattgactatatacactattaaaactgctctatattcatactgactgacagtggcggagccaggataaaattataacgggggctaaatcaaaatgaccaagagcaactaagagagatttagggttggttttaaaactttttgggccttcttagtcttttgggccttctaacaacctcaaacaaagtctatattagcccctcatctataaatatatagattatgggggctttaatggtatattaggaggtagggggtctaaagatccccttgcccccatgctgtctccgcccctgctgactgacagcttaatttctctgcttcccttaattattcttccttgtttccctataaaaacctttgcttttcacttttatcgagtatatattcggcgctcatctgacagtgtcgtcgtcctccttgtgtgtgtgcatcgatgagatgcgattagttttaagtaattaatcagtcattactagctagctgcagtgggggaaacaatatgtatatatataatacatatgcataatttgtactccctccgtcttataatataaggg

SEQ ID NO: 60968 - DNA, 1070 bp, Oryza sativa
ggtatgctgaaaaggtgttttttttattgtagtatactgctgctagaactgcataacttagatatggttaaaatatttattgactgcagttgcaaataggaaagccagtggtagttcatcccagacagataaggattacattcaatctttaaagggtttgtatttttctaataaaagcaaatcattttacatttattaaggaaaaaaactgacataatcaaatatgtatgttacagcatcatacccagaacgatcgtactactgacctccgacatatgaatgcccattttgtggtgccatcttttggtatcaagagagagttaaaaccctctctgctgtctcgaaaagaaaaatagtttacaacctatgttgcaaaagtggcaaaattgaattgcctcctttatgtcctctacctgaaccgcttgcaactttattgaatttcaatggtgatgcacgttccaaaagatttttgagacaaattcgatcatataattcgatgtttgctttcacctcaatgggtgcagctattgacaagtcaattaataatgggaatgcgccttatgttttcaaaatcaatggtgttgtgcatcacagaatttgtactcttctgccatcacgaggtgcaccacctaaatttgcgcagctatatatctatgattctgacaatgaaatccaaaatcgattaaatattttcgaaaatgattgcgacaatgctgatagaccagaccctgaaattgttagcgccttaacacgcatgtttgataccaataatgaacttgttaaaaatttcagatatgctagagaccgcctctctgaacatggtaatgaaaaaataactcttcgctattaggctgcaatgctaaagatgatgtgcagtataacctaccaacaagtggtgaaatagctagcataatagtaggcgatttttcagcaaaagaatataaatttggtgtgcttgttcacgataaagatcatggaatgcatcaagtgttttcattgcatccatcatatatggctttgcagtatcctttgctatttccatatggtgaacgtggcttccatctaggcat

SEQ ID NO: 60969 - DNA, 1218 bp, Oryza sativa
aaagtcaagagagtctggatcttcacgatttggatcatgtttgctgtcaaactcaaaagctgtgcgggatctctctttgattggagctaaccggctttttatgaagtgccgcgtgatttgttctccttacaaaccctgctcctttagctttatcatgcgctccatcagttccactgcttgggcagcctcatctcctgtaggcaatgaattccatgtgtcttggtagaccgtagggagacaagaatactcgggaagggctggttcaggattttgaacgtagaaccagttggcgtgccagcctttgtttgaggtcttcaagggcatggagaagtatttttggcttagtgttcccctgagttggaaaccagcgcccccaacaacacatggtttgctcttgtttggctggggcttgaggaagaagatgcggcggaacaaggcgaaatgaggcctaatgcctagaaaagcttcgcaggcatgaataaaattggagatatgcactatggagtttggattcagatgatgcaagctaatcccgtagaagttcagaattccccggaagaatcttgaggttggaagagaaaatccgccatagaagaagtgagagaataccacgatctcatgtgtatcgggggtcgggattgcctcgccgaacgctggtcgccacccgatgatttccttcgccggaagaacgccgtgcgccaccatttcttttagattctcttccgttacatcggagggagcccactgactctcgaaactttctctctcttctgccatggatgcaagttgaatggattgatttggtccaagatataggtggaggggaatgaggaatcaatgcggtggacatgcggagaggtttcgtgggattttttgagaatggattggggcggattgatgaaccctagctttgacggtgcggtttgatactgtagcaaggagtggggaaatggcgagagtctcggcggggaaaacgaagcgccgcttggactttggtactttgttagggtatcgggagtgctaacaggcctaggcctgtccagtacttcaggccaatattattaccaggcgtggcccattgtgatccttaggaacttaggcactttttgctttagcaatttgtgctcacaatgatgtgacccgatgctgctaaaatcctttttaatgcgattagataattctttagaattactacgatgcaaataaaaggtacccaac

SEQ ID NO: 60970 - DNA, 15519 bp, Oryza sativa
tcccttatattataagacggagggagtaggaagcaatgggatccaaccctacctggcctacatatatggatgtctccttttccattgatcgagatcgtcctctctgcaaattttctgttcctatcgcctgcactacactgctgatagtgatagccctcctcccccacaccaacattttccttccttttctttagtttccccctgcatgcaaatgtctcacaaagcttgtcacttgctacatattaaccatactgctctcccatctaatctaatcctcgaaaaaaaatacattatcacgccgatcgatcggtcgactctctatagctagctcaataatgtatatatatagtaggagtttgattcttttttttttactatagtgtcagttgcttaataatgttgacccatgcaggatgtgacatataccagatcaaaagtgcatgcatgagctcggctatgcattttcaatctttaatttttccccctcctttctgcaaattaatactgtgaaaagaattatttgccacattgatgcatgtatatattcctgcactcatccatgtgaatgtggcacttgcattttgattgaaactagagaggcgccaaagggcaataaaagtaaaaaaagaaaagaaaagaaaggctttagcttgggaatgacaggagtacgtacgtcatggtggtaaagtgcaacggctacataataacaagcttggtggatggaggaggaagaagaagaagaggaagaagaaaagaaagaaagaaagaaaggtagggaacacattggcaatcatgtgatgattcagaaagagagatgacacttgactacactggacgactagcagtagcagcagcggcagctagcaaagagagatcgatgtgatgcagagcaaagcatgagggactagtagtggttattggtacactgggtgtgagtactacggttggtaggtgtaggtaccaagagaatttttagatcgaagccaagcctaacgatatagtatgagcgatgagatgcaatgctgcaatggtagctagctcctgctgctgctgagtaggataggtctctttctgtctgtctcaaccatagcaacatcaacaacacacacacaaggactggattattttttatactattcccctttgcaaaaagttatttcacatatagacccataataaacatattgcaaaaataaatccaaaacttggcacaagagtccttggcggtgatcgaggttagacatctcaccgtcaatcttgttttcacggtacataatttgatgaatcggaagagaggttggaggagaaaatgaagttgtttttttggaagggtacacgtgaaaaagggtgagtgacgattccttggtgcgttgagattggcgcgggcgcgcacacggctgtcggatccaacgggctgaggtgggtgagtagcccaagtactcctactggtttcattgggtcccacccactcccactcccagcagaagatagcagagcacacacactccactactccactgcactgcagtctctctctctctctctcgcaatcagcattgcacattttgcattgcatttttattgttattattctcaggctcatcagctggatgtccctagctcttgctcttcttcttcttcttcttcctagtccccagttcattctcgatctgccaacttcattctcccgtctataaatccatccacagctagccacccactctctactggagtagttgtaattgtttagagcgtgtggtcgaattaatatccatggaggacgagaggtggaagctgtcgagcagcaaggggaggagcaaatcgggcagatcctgcagcagcagcagcaactactactaccactcctccgatttcaacagcagcaacgccaccacgctcagccggagctactccgccagcgtcaccgccagcaggcacgctaccaccgcttggtccgccgccggcgccggtggtggtggcgccagcagcagcagcagctcgcagcatcagcatcagcagcagcagcagcagagcaacaattcgcagcggctgtcgaagaagtgcgtggaggcggtgaaggagcatcgcgcgaggttctacatcgtccgccgctgcgtctccatgctcgtctgctggcgagactactagctcagtctcctcttccttcttctttttcttcttcttctagctcagtttgattcaattttatttatttgtttcccttccataatactccattgctagctccatgcatcatcatcatcatcatcatcgatctctgtgtgtttctgcctgcatcttaatttgttctttctgtaattaatcttgcattgctctctctacaagtatatacttactagctagtagctagcattctcatcttcttactatctatttagttccttcctagctacctagtcgatcagctagtccaagtatgtaatgtatataaaggtgaggtgagctagtcgtccgggaatgttgattttggagctagccgatgaattgtgcttgctgatttctgttaaatatttatgaaatgccaatggtatatatatcgatctggctgtctgtaattctcagtatttggaggcaggcaggcagagctagagtggaggcagtcaattgagtgacgacgactgaagccaaaaatgagtcaatgcatgcatgagcatgacacggatggatgcatgctagggatttgaatcatcatcatgattgatgatggaccgataatccaaagagtaccaataataatccagaggagaggagaggaaagaaagggagtagagtacagtaggtgtgggggcattggtgtctgctaatgagtgaataatggttggtcgtagccgtagataggcagaagaataatacatactctactgagtatatggtccagtcccgggggggagctgagtgagaaggaggcagggcgagttgatcagatgaagcatgtgtgcgtagaccaagtgtcgtccttctcctccggcccggccccccatgcatatgccttcctcacctactcgctcctcctcgctaaataccactcactcactcactctagtgtgcagtgcaatgcaatgcaaagtactcatctcttccatttcaatcaattgactagctagtcgtcggtcggtctaggacttactccctccgtcaaaaaaaaaaaaaagtcaaaccccaggtttccgtgtccaactttgactatctgtcttatatgaaatttttttataattcgtattttcattgttgttagatgataaaacatgattaatattttatgcgtgacttgtctttttaattttttttatattttttttaaataagacggacggtcaaacgttgcacacggaaactagggtttattttttttgggacgaagggagtatatatcttgggcgttgacgcctgctttaatcaagccgctaattgattgaccaacgtactagtgactgcatgatctgtacgtactactatctgtctgtagctagcttatcagattaatgcatgcattcatgctcctatatactactccagtagtggagtagtatatgctatgactaggagtatctgatatcatcgatcgagcagctgctaatgctgatgctcatgtcgatgctatggcggattggcaggcgaattgaagggcagtgtgcacaacgtagtagagcttgagatgcagagcagagagcagagtagagagcagatgtgacgggcgggccacatgcggcgcacgtgcgagattctgttggccacgttaattggttcatgcatggatctgctgcccgcccgtacattttcggttgatagtactaccctcatttctccgcctgccaacacgaacaccacacccatgcaaatgcaaccaacccctcttccattttactcctccacctatctactagctagtactatactctatttactgtcctgtaaatatcatcagttactacaaacttaactacaagacacattaatcaagcatctaggagtatgcatgctgttacatactgtatactactacactctgcatatgctgctactaacattgttaacatgtcatgaatgctgagcaatgctagcaaagcaatgcaatgcaatgcaaagcgaccagatctgtgagttggaggcctcaacagtgcgtgccgattacctttttctttctttctttctttcttttgccactcatccactgcaggcaggcaggtcgtgcagctgcagcaacaggacagcaggccccttctccttggctctgtgtgtgtgactctcatgactcacacgctctctgatgactactagtgctactaggacagctagcaatttggccctccatccctgaaacacacacaaatgcatgtgcacgcaatccatccgtctatctgccttgagtattttattatgaaaaataagacttagaagattaaaaaaaaaactagtactgctacattttgctttaggtgtaaacatatatatctcattatctaaaggggaaaaaagaggagaggtatatatatatgtggtctatctatgttgagttttgattataacaatccagattgatcaatgcagttgtgtacaaaatgctattggatttgtaaaatagaagaaaatgcaatatgttataaatataattccacttttaaagaaggagcactctagttttcagtgatataaaaatacctacaaatttcagccactttcactttgtgacggctttgatcatgccaagatttgtataggtgcggcacaataaccttatcctctccccgtcccttctttcctcctcgtaatgcatttggcctctccaccttgccccgcacatttgtcacccatgctcgcaggcttcataagtcaccaatagcgttggcacatttcaccagactccacccttcctcctcctccttatgcttatgcctgagtggccgcaggtttcctcacccttcccgtcttccccttctctgatatagtctcctggccacccctctaaatcccggtgaaccaccctcctcatcttcccctaacccacccctaacttctaattagtaggttttttgtcataatttaggttttgttagtaaagagaaagatgaagagatcgatcatcaaggagagtgtcgtcgtcgtcgcaatcgctgataagcccgggctaccccctacccccaccaccctcttctctctctttaatttctctcttgttgcctcccctagtttggaggatgaaggatgaaggtgactcgaatactatgattagttacattactgacatagggttatgagaaccaacaaaaatcaacatgttgatggaatggaagagagatggacacgaatgtatatttaacaagtgcatatgtatttttataaatatatatatattaatgcaattatatatattaaaaatagatcacatgaaaaatcctatatatatcttaatttattatgctcagtttgtggttgctatgttgtgttatggttgttttattacaaaaccaaaaacttacaattaatggttgtatatgttttcttttacagatcaaattatagccacttcaaacggaattttaatagtagtagtattattgtttgtgacatacagattataaaaagaagggggggaaagggaaattgatgggcccgtgctttgtggtcaggtcgggtgggtcattgtatttcagttgaatttaatttgtgtcggcccaaccccaccactggcccatctgtgctctcgtctgcctctgaaatgcatgggtggacgaacaggtcaggtcgtccttttcctgacgtggccagtccttccttccaaaataaaaccatctcgtataaaataaaatatctttatagtataataactaaatctaaatagatgggagaaagtatgatgagtatggatttggtttgtagaaactgttctcgtttggcccagcttgcaagtgtacgggaggaatggtagtaattttcttcattttcagtgaactcaaatgggtacaattttggtggatttgagtacagaaaacaaagtacttctttgacatattttctttgctatgcttgctaagctgcagctagctcctttctggttcaacttgcagcttggaaattgatttcttctctacgataatgtgtcctccaaaaaggaaaaaagaatatttgaatcaagttgcagtagatttttaagttaattattagaagaagagatgggatacatttcacataattcgatccaaggggaccaaattaaacaaactgtggccataagcatatacttcttccgtttcacaatgtaaaactttctagcattgctcatatatatatatatatatatatatatatgtatgtatatatatatatatgtatatatatatatatgtatatatatatatatgtatgtatgtatgtatatatgtatgcatgtatatatgtatatatgtatgtatatatgtatgcatgtatatatatatatatatatatatatatatatatatatatatatatatatgtatatatatatatatatgtatgtatatgttaatgaatctagccacatatgtatatagattaattaacatctactccccccattctaaaatataaggcataaccaaccctaactcaaagaccaagaaataattattaatccctccgtattttaatgtatggcgccgttgactttttaatcaacgtttgaccactcatcttattcaaaatttttatgcaaatataaaaatacttatgtcatgcttaaagaacatttgatgataaatcaaatcacaataaaataaattataattacatgaatttttttgaataagacgaaatgtcaaacatttgtcaaaaagtcaacggcgtcatacattaaaatatggaggtagtatcatcttgtagtttgtatcatcctaataaatacaatgcatgcatccaatagaattagagaacatgagagtagaggatttaaaaaagtaataatttcatggagaatgggccatagttatattatggattatcaaaaaaaagtggttgtgccttatattatggaatgaagggagtatataaatatggacaatgctagaaattcttacattgtgaaacatatgaagtatatgcgtgcatctcccaatcaaaaccaaaattgtaagcaagagctggctaagccatacccggttaatcccaacgcaatgttgaccatcgatccaacccaattattgagaaataacgagaactacctccatttcatattataactttgactcttttttttcgttaaaccatcaatcaagtttgcaaaagaatttagaaaaatctataacaccaaattagtttaactaaatgtttgataatttgtgtgttttgtgttataaatgttgctatatttttttttataaactttgctaaacttggaacaacttgactagaatcaagtttgtagaagaatttagaaatatttatactaccaaattagttttactagatgtttggtaatttgtttgttttgtgttataaatgttgctaattttttttataaattttgctaaacttggaataacttgactagaaaaaaaaatcagaacgacttataacataaaacagatggagaatatacatgaatgaaattgtggatgcactctccatgtatagtactctatttcttttttaaaaaagggagtaaaatcatggataatgtatatatccaccggtgtacgtatcgaatcagttgcatcgtactatatgattgcaagccagatcgaaaccacgcatccccaagtacaaccttaaccgatctgttatgtgcactagaaataacctgtatgaatttatcattatatcctcgtcgtacggtgcaaattaatcaagagtagctgtcaattgtactccattagaggaattaattaaagatttatgttgccgctgctgctgccaacctcttaagtggtccgtctgaaaaaattgattttcgcagatggatgatgaaaacccatcccggtttatatttttcaggtggacatttggcttcgagaatcataccgtctgaaaaaaataaaagaccagtgtcactaaaaatctctttttctagtagagacagatgggttgatatgacgagttggcgacgccctacggcgcctatgggtttactatgcaggagcgagttgaaatgagttcgtgaatttattgttcatggctatatatattatctaaacaaaaactagctagcttgttgagtttttttccagctagcatgctttaagctaatcgatctcgtatgcttcaaataattaagtgtgttgatcagcgatttcgtgccaggtgacggcaccaccactcttttctggtctaaccagattgagagccgctcggtaactttcctttgcacccaaccttctccttgttatgccaccacgtatccgggctttaagcacggtcctcttggctctcgccgataacttttgggtggggaatattcatggcactctcacggtccctgtcatttcttagttactcgtgctctaggacgcattttgtctggcgttggacgagtgaccaacgatactcgactcgcttggcttgccatgcgttatttctcggccaacaatcctttgcttgcgccaatcttctttggcaagctaaaagtcccgttaagtgcaaattattcctttggcttgcgttccagcaacattgttggatggccgaccttcttctcaagcggggtatcaacagccactcggcctaccccttctacgcccaagagctggagacggcgaaccacatccttctcgattgtgtttttgctcgtcaggtctgacgccaagtcttgtattcctctggctggtctgacctcgcctcttctcttggctgctcgctctaggtctggtgactaccttctagggcacgcctatcagagcatcttcgcaatggtttcgattccctaatcctcttgatatcctagcaggtgtggaacgaacggaactctagatttttcgactactcactctttttcaattttggtggtattggagttcatccgtttggaaggtcgtctctagtcttttgtcggcgctgctgtttttggagtatttctaggattttagtgggctccaccaccaccttccctcatattaggagtcttttcttttccttaaagtttttttttcacagttttcccgtttccattttttcatgtacgttggcgacaatctttctggccatttgcgttgtgtaattctctttttaatatattgacgcataattcttttgctcgttcatgaaaagtgtgttcggtgataatgtgtgtgggtatgagtgtctcatgtaattgaaagggaaagctctgccgtcactagtccgtatatgccatggaggatgaatggataacccgcgtttgaagaagctaagtatccaataatctaattaaacatttaattcagagattattggtgggagagcatataccaattaacaaacttagctaatagtcatcatccagttgttcatacatgacaaagagagagttaggggacgacgtacagctcccaagttgtagtacaacttgaccctcaaaaagtcagcacttgtactgcacaccatgcgtagtacgttcgttcgttgatgcacatatatatgcgatggcccgagcaagacttcacgctttatatagtacaatatatttaatttagttccttacttattgaaaatttgatctgacttgtcaatttagaattcatctcccgctaacacacgtcactggattatatattatatcaatcaatacttgtttcagttataaaacttttgggaaagtgatttcatcctcaatgggatatcctctcgtttcgtgcatgccacctaaatagtcataagaaaatataaaataaatggcaatatagactaatatgaaatatatcgtttcacaaacatgcaagtttaaattcaacttcgataatttgtaacaaaaataacaaatattattgtaatagggggataacgccctccctcctatccggttgaaacacctaaaatagtttacggaaagattctaagtgtaaaacagggaaaacactctcgagttggaaaacactcttgagtggcttcttatcagttatatgtaactcatcttacttaaagatgaattctaactacatggcaggtaaaccggggtgattggaaagttgatggaggatgtgcgaaccctcgagaatagaagacattcggctaagaagaactcgaaggaaaaacctattcgagttgagatcaagtcgaatggaagattttgtgggggccacttctcaaccactcttgccagctggagccaaaagactataatgaccctgagaatatactgtaatacccctaaggttgctgacatggcaagggcgttataggaaattcactaaagcccatgagggtagaaatgtaacatcacatgtaagaccgtaggctataaaagctgatcaaatccctgtagcaagacaagatatttttaatacaaaagtaatcctcaagagttgtgtttgttgtttgagctcatttctaaggataggcgggaaaatacttctttccggtctatccccaatcttgttcgtgacctaaggtcccaataaatatatttgtgaatgtgcgataactattttgagtttaatttgttatttttgttgcaacttgtaaaagtaaaatttggttttgcatgtttgtagagtgatatatatatttcgtattaatctatattatcaatttttttcaaattttttaataactatttagatggtatgcaaacaacgaggggatgtcccctcgagggatcagaatccacatccaaaactttttatgtttatagtaaaaagtaaaattcgatcaaacttttgatatcttgaccactgatattagaacaagcttataaaatctaactgtactttgtaatattatgacttctcatggcaaatttatggacgtccttttaaaaatatggatattcgagatgtaattgatgatcaaagtttaataaaattttgttctaataaactgtaaatatttattactggataaggtaaaacgtacatctagcttaacctaacatcatcgtatcccttctttttataaaactaatatccactgaatacctaaaactcaacgtgaaacatattatttattagcactattaaaacacatatgcaagcatgccatatcaactcattaagcacataaaacttaacatgcaagcatataataattatatttataatttgtttcattataaaactaaacatacacatactggatcatcattctcaaattaatcatctattatattattaaaggaatagaaaaaggagcctccacgttcactcacataacctagaaattttcatattaatcgaagaaaaagaaaaatgcagactccatatagaaatacaatttagaaatagctgaaattcggaattaaaaaataagaaatattagaagaggagactagagtccatatagaaatacaatttagaaatagttgaaattcggaattaaaaaataaggagtattagaagaggagactagagtccatatagaaatacaattaggaaataactgaaattcggaattaaaaataaggaatattagaagtagagtatagagtctatatagaaatacaattaggaaataatagaaattcggaattaaaataaggaatattagaagtagagtatagagccatatgaaaaagcattgtccatatagaaatataatttagaaatagctgaaatttggaattaaaaaataagggatattagaagaggagactagagtccatatagaaatacaatttagaaatagttgaaattaggaattaaaaaatcaggaatattagaagaggagactagagtccatatagaaatataattaggaaataactgaaatttggaattaaaaataaggaattttagaagtagagtatagagtccatatagaaatacaattaggaaataacagaaattaggaattaaaaataaggaatattagaagtagagtatatagtccatatagaaatataattaagaaaaaaagaaattcggaattaaaaaaataaggaatattagaagtagagtatagagttcatatagaaatttaaaactaaataaaattcagaataaacataataaaatgaaaagttgtgtttagagtccatataaaaatacaatttacaaataactaaaatttaaaattaagaaaaacatgggaagaagagtttaaagtcaatataggaatacaatttagaagtaactgaaatttgaaattaaaaattaaagaatattgacagatgagtttagagtccacatagaaatacaattagaaataataaaaattcagaattaaaaaagaaatattaaaagataagtctagagtccatataggaatatatatatatatatatatatataatttacaaataactaaaatttgatattaaaaataattaataactaacacgtatataaaatacaatatgaatattacacattagtagtttcgtaaagttattgcaaaatttaaaattacgttgtcattgtaatatattttaataatataatgagaaaacatatatactattatatgagagaaaatataatgatgctagccgcgcaatctgcgcgggccaccatactagtttttataatatatcaatccgagtccttcatcatttctccattatctaacatatatccagcagcaaagcgttgggcatctctaaacccgagtttactttaacacacctataatatatagacgtgtatatatatataagctctcacaatccagcctcctacctagtggctggcccagaagtcgatcgatcgatcgtgacggcgacggcgcgagccacgaccatggccaggacgatgacgatgagggtttcttcgctccttgtcgccgtggtcctcctcgccgcgctctcgttccaggcgtgcagcggccatggcggcatcaacgacggcgacgggcaggtcgacgccccggcaacgcctgcgtcgtcgtccggcgtgcggtccaaggggctgatcgccgtgaaggtgtggtgcctggtgatcctgctggtgttcaccttcgccggcggcgtctccccctacttctaccggtggaacgagagcttcctcctcctcggcacccagttcgccgccggcgtcttcctcggcaccgcgctgatgcacttcctcgccgactccacctccaccttcaagggcctcactaccaaccagtacccgttctccttcatgctcacctgcgtcggcttcctgctcaccatgctcagcgacctcgtcatcgccgccgtcgcgcggaggagcgccgccgccggcgttagcgacaaccaggtcagtgagcagcagcagcggcagcaagccgagggggcggtgatgagccgcaaggaggaggaggcggcggcggtggcgcacccggcgatgctggtgaggacatcgtcgttcgaggacgccgtgctgctcatcgtcgcgctctgtttccactccgtctttgaagggatcgccattggtgtctcaggtcaggacaaagcttgttgcaatctgattcatttaaattcagttcttttaactaattaaattcagtttgactgattttttttttgctccaagtctctgggacaaaattctgtcagtgtgcaattaatgttcattgctagctgactcatttttaggccaattgttatgctaaaacctagagttgtttgttctgtctccagatatttcgatctctttgatttggctaattgatcatctcatctcactagttacttgaattatttgtcctcttgcttaatcatttttacagctgataagttacaaattttcaaggcattaattaatttcaatacaatattagcctgttgttttagcatgatcaaaattacgggatacattatacatagacagatgatgtaacgattaattgctagctagctagtaaaactgcatgtgctatataatttgaacgatgatatggtttcttgaaaatcttgagtgattactggaagaaaaggaacaaaaattggaatgtatatatggatgaaataattggactctctgatgtcaatatgagatgaattgcagcgagcaagagcgaggcgtggaggaacctgtggacgatcgggctgcacaagatattcgcggcggtggcgatgggaatcgcgctgctccggatgatccccaagcgccccttcctcatgaccgtcgtctactccctcgccttcgccgtctccagccccgtcggcgtcggcatcggcatcgccatcgacgccacctcccaggccgcgccgccgactggacctacgccatctccatgggcctcgccaccggcgtcttcatctacgtcgccatcaaccacctcatcgccaagggctaccgcccccaccaccccaccgccgccgacaagccgctcttcaagttcctcgccgtcctcctcggcgtcgccgtcatggctgtcgtcatgatctgggactgatccatccatcctagtattacactgcttcatttcttcaattcctgcgcccatgtatgtatgcttaatttggcttgtttaattaactgtatgtacacatgctgcatgcatgttcgatttctatcaccccattcattaatcgtggccgaaacagttcatgtccactaatgattgctgtatctatctacatatatcaaaccgtgaataaaagttgttataaaacgtactgttggtttcgttggatcattttttctgatgatgaaaaatatcgcatgaatttgagtgcgcagagaccaacaaagaaaggaataagatcactttgactccctcaactgaccaccgaatctaaatcgtatccttcaaccgcaataacagaaatcttacccccaacttacaaaaccggtacaatttgactctcttggtggttttggaaagtggttttgctgatatggcgcacacgtggcagtattgacttggtctttgtcccacgtggcattgacgtggcgcttatgtagcattaaaatttaaaaatataagcagggtccatttgtcattcacacaaaaataattgtaggccccactgatatgtgggtcccacatgtcatcccctctttatcccttcttccttctccttctcctcccttctctatgtctccctctttctcacatgtgggccaccggaccaatcaaccccgggaaagccatggcgaccacgccgaccaccgccaccaccaccctctccgccgcccgcctcctcatccccaccgtcgccgcatcgcgcgcttccttctccaccctcgccctcccgcgatctccctatggggtctcccgctccaccgccgccggttgccgcggccacctcgccgagccatggcgaccacgccgaccaccaccaccaccaccccctccgccgcccgccgccgcatcgcacgcttccttctccaccctcgccctcccgcgatctccctatccctctcccgctccgtcgccgccggctgccgcggccacctcgccggcgcggcctcaaagtccaagggc

SEQ ID NO: 60971 - DNA, 2610 bp, Oryza sativa
cttgatgtcaaggtaacatgatatgaattgatcactttgcattatgaacaccaataacttggagttgttcttctccttagcattgttgcctctgttcttgcaactgagaactgtatgcccttgtttcgatcagtggtttaatgtactatggtccctagcttagatagtcatgtatgaatttgcgactaaggaatcatgcatacgataaaacttggtggaaataaacttgaagtttaaaccagaatgtgaccactagtgttcacaagtgatgaacatgaagattaagtacgggcacgcaaaacgagaaaaccattagcacataactaattgagttttaattattttaaacttagaaaattaattaatctaatattgtagataagagcaacttctatatagaaagtttttgcatgtaatacaccgtttagtagtttgaaaagcgtgctaacggaaactgaggtaaaatttgtatcttcatttgctgacaaggccgtagattgaaaagcatgcaccagtggtatgtcaaattcttgtgcaaatttggtcgcagctcatacatcatattgttcaacatttctctttaagttgcatacaaattcagggctagagaaatcaacatgctatccaatgaagagacagtaaagctgcacatcatattcctaggtcgttcaattatttttctgtgcatgattacttacatccatgttcaaatgatagtttatttgagatttatacctgaaccgaagtttatttgagatttatacctgaactgaagcccgtgttattgtgccgtggagccggagaggaaacttatgcaacctgtgcagaactaactataggcctaaatgcatgtgttgagaatacactgctaatagcttgcggagcagtctagagatcaaggccgtagtgcaaaatgttatgaattctagctgcggtattattagcagtcctctaattgatgctgtaagcttcaagtgaaattggtggtcaatgcaatgaaatactctgggatccagttctgtgagggtaaccaatggtttttgccttctttaaaagttctgtctttgtatccattagattgtgtattgtctgtttcccatcggcctagacccatatatagggtgcctcgtctttggcttggtcccacactaattagattagagatcacatggtattaaccaaaacaatgaaaattaacatagaaatgaaaacgttgcatatgcacagcgcctccgacttccttgcctctgtacgtcacctctatgctgccaacttgatcatgtgatcttccatccagcatcacagcatattaattttgttctcaagctttatcttccatagaaaatgtactgctgctacgccaggagccaggaggcaaagtaaaactggaattaaaccatacatgcatgcatcacattcaggagaagcacttgcccatatattctctgataataacctgattaaccattgaacaaccgaattcaattaagtagaagaataaaaacattcggcaagacctcgtccaaataaaataaccgaataaaaatcatcggctgtcaatttttgatatcaacacacacacatatgtacgacgttgaagagaagaaaagaaatgcccatgaaaattatggtgagttctggactgacttggttatatggtaggtcttacatcacattattatttagttttggagtggttggacgaaatagtcgtggctgggatgttgggcttggcttgtttgggtcgatagacggatgtagaatggaaacacccggacgaacaattggaccttccctaaggtaattgcccaagcatatagcatttaataaatatgagaatgcatgaatctaaattagcattactaagcatttgtcataagtgactagggactcataggtaattatgggtacaaaggaataaggtaaaccatagtcaaatgcatgtcacaatagcaagtaggatattcatcattgcatacatttttatttgtaaacaaagtaagttcgcaattgggatcaacatgcttaagggaggggtgatgacttatctgctcaggatagtccttattcttgataatacttgatccaccttcacctcctggaagttgcatgagttgcctcacgactaaccgatacacattctatgataggcgataaaaaccaatattcaaacaacaatcaaatatgctcaaacaaaatataaatgttggagtcatacctagggctgctcatactactctcgtttgcttatggattgtatggtgctaagagatctcaaaatggcggtagcggcttatataggcaagggggaaaattgaggtagcttaggctctaaattactcaacatgcaagcaccttatgggcaagagagcttaggggctaagacttcttaatccttctattgtcatgatggcttatttaggagctaaccaacacacatgatacatacattttgttaacatgccgcttagtctacttactgggctatggatggactatcactacagtggctccactctacataaaatgattggcactagagacgtgaaatggctcatagagtaatctaaatgtaatgattcaaatggacaggctggggattggcttatt

SEQ ID NO: 60972 - DNA, 4495 bp, Oryza sativa
ggcccttcccaatttggagaccatttcccaaatttattatcttttgaaccaacaggcagaattgttttccacattaattctccaatttgaaacgatttttccttcacctttttattgtaagctttagctactctcaatttatctttctcaatctctctcaaagctttcaatctttcatcactaacctcatctattccgtccatcattaagttgtgataatctactgccgacaaattattttgtctggccaatctaagggcgtccagattcacctcaacatgcaaaatggcctcttgcccatatactaattcaaatggtgttacctttgttgcaccatgcttagatatacgatgagcccacagtgcctcagacaaaacctcgtgccatcttttaggatgttcctctattttcttttttatcagcctaattaaagttttattgcttgactcggtctgtccattggcctgagcatagtatggtgatgaacaaagcaacttaattttaaagattccgtaaattcacgaacttgatgtgacataaatgatgatccttgatcagttgtcaaggtttgtggtatgccgaatctatgaataatatgctctaaaataaaatcaatcacttctttatgggtcatattttttagaggaacagcctctgtccactttgtaaaataatctgtagctactaaaacaaatcgatgacctttggaagaacaaggatttatcggggcggatgaaatctaaagcccatccacgaaacggccatggtttaataataggatgtaacatagcagcagacggctaattggatatcaccaaatttttgacatgactcacaccctttataatatgtaaagcaatcttctaacatagtgggccaataaaaaccagctctccttaataaccatttcattttatgagccgactgatgtgtaccacatataccttcatgtacttcacccatagcaaccttgcttggtctaaacttagacattttaaaagcaacccatctacagatcggcggatacaaatctccattaagtaatatatattttagggcttgacgccgaagttttctttcgacagtctgactagggttctcaggtaactggttaaaggttttctccaatcatcaggatggaccacataaatcttaacatgctctagcatcggtctttcaatcataaacaatttacctctactgactcgataacgggatgcttgttgcgctagattattagctagaacattctcttccctagaaatgtgtttaataacaaaatcatctaaatttgctatgatctccaaacatttctccaaatacatattcagtgatccatcaaagcattgataattcctagaaacttgttgcacaactaataaggaatcaccataggcctctatattctttacatccagggattctaaaatttgcaatcctcgcaaaagaggtcgtactgggcttgattattggtgcaaaaatattctaaatggacggatgtctcaaaaatattgcgtttggtgaaattaaaacaacaccaacaccgtgttcctctctacaagctgagccatcaaagtaaagtttccatgggcatacagacgagtaactaaccctcttcatatcatcattaatcctatgatcaacaataaaatcaacaacaatctggcctttcatggattttaaagattcgtaagccaaatcatactctactaaagcataagcccattttcccattctaccacttagaatcggcttttgcaacatatattttatgacatcggtctgacaagccacaacacaagtactagatagtaaataatgccttagcttggtgcaagcataatataaggacaagcataatttttcaatgaacacatacctcgtttcagctcccagaagtcgacgactcaaataagtaacaatatattcttttccctcaacttcttgtgtcaaaacagcaccaataacaccctcttctgcagcaatatatagccgaaatggtatcccggccttaggggctcttagcaccggagaagtagacaaatacttcttaatttcatcaaatgcttactgctgttctgccccccaaacaaattcggtctctttttttaaccgaagtatgggtgtaaatgcattaactttgccggacaaattagatataaacctcctcaaataatttaccttccctaaaaatttttgcatgtctaacttacactgcggcgctgttacttttctaatagcctctatcttggcagggtctatctctatgcccctctcatgtactataaatcctagaaatttgctagacgacacaccaaaggcgcatttaagtggattcatttttaaaccatactgacgcatcctctcaaacgctaaacataaatcggctaaatggtgatccatacattccgatttaacaactatgtcatcaatgtatatctctaatataacaccaagtaaatcatgaaagattaaattcatagctctctggtaagtggcaccggcattttttaaaccaaatgtcataacgacccactcaaataaaccgacaaaactaggacaacgaaaggccgttttagacatatcttcttcggccataaatatttgattataaccagcattaccatctaaaaagctaatcactctatgtcccgatgcatcattaattagcatgtcagctatgggcataggatactcatctttaggggtggctttatttaaatctctaaaatcaatacacactctcaatttcccagtatttttcttttcaacagggacaatattggaaatccattgtgcatacctacacggcctaataaaacccgcctttaataattggtctatttcttctttgatccagtcgtacatattagaattaaatcttctaggtggttgcttataaagcctaaacccagatttaatgggtagccgatgctctatagctctcggctaagtccaggcatttcatgatattcccatgcaaaacaatcgacatactctctaagtaaaccaattactttaactttataatcggctgtcatgttttgatttataaatgtcggtctaggaatggtgccatcacctatatcaactttctctaaagggtcagccgacgaaaaaccttgtcctaatttttctacttcatcaaaatcatcaatagcctcccaaatatcgttcttatttgaccgatattgctctgcacgtttttgtaaccaatctaaattgctttctttattcatttataacatcacactactgagccgagctgcagaagccggctttatagacacgggtacaaaaccatccttagtgacaataacataatcataatcagaaagatctaagcctgttaaacactgaatattaccatactgccaatcaactgaggcatcggctaaagcaacgcaagccgaagtatctgcatgaacaacctctacatcatcacctacccactgtattaaagtttgatgcaaggtagaaggaacacaatggtttgcatgtatccaatcacgacccaacataacattataattaccttgcacctcggcgacgaagaaggcagtagggagagttttgctcccaatagttagctccatggaaataatgtccttagcttctgttggctctcccgtgaatccattaagtgtcaaattagcttttagaagctcactgtcctctctgcccaatttcttaaaaactgaatatggcattaagttcactgtagctccaccatcaaccaacattctagaaataggcctcccattaatatgccctttgatatacaatggtttcatatggcggctcgattcatcaggcttttcaaaaataacatctttaggagcaagacataattgtgcaatctcttcatcgacgaccctaaattcagaaggtagtgtaaaaaccatattaatatccattctttctggaagcggagagccatctctaattaccggggaaccacattctaacagatcatgctcttcatcactgttttcttgaactgaagctgcaacttgtttcgccctccattccctgcgaacacgtaccatgggttcaggattgatatcattgaaaatttcttctctcatcttctcagccttagactgtctcaactcttgtgcgcgtaatctttgcagcctccgcttccgagtgtgtccaatatctggagggcaccattggagctgtttacctttgccgggctgcatagacacattttctccacatgaaccaccaccacaatcagctgctggcactgcagcggaagaactgttcatttcggcaggcacggctgtgattgcggttctgttcatctgggctggtactgtagcagtcggagcactgttcacctgggcctgttctgtaacaaccgcactactaatcactttctaactcacatgtgaattgcccgctcctccactgatcattttttgcctgccaaaactgcactccaatttcctcctgaatccccaccttctttcacacgacgccccttatt

SEQ ID NO: 60973 - DNA, 731 bp, Oryza sativa
aggcgcttgatattataatcctgtatgcccgcacgtcgactctagatgatccccggcgaggacgacgagctcgagacgacggcgagatacggcggcgtcggcgcggggatttgccctaggcagtggcggcgaaggagagaggccgagagagatcgatcggccgaaaacttttaagtgttggcgaagaagacgagggcgcaccgggaatatatatacccctggatctttactcccggttgatcaaagcacgctggagagaacatttttataaactatttagcaaatgtggtactcaccccttattaattatgacccacttacccctcctatcgcgctgcattttacattgttcttgcaaaccgagcttgtcaaagacaagttcaccgcgaaatactgctatttttaggactaacagtgagaacggtttcatctgttcattgatgtctgttgtgatatttgtggttgtcatgaccgtgctccgaccattgtcgacttatcttacagccaaggttctatctgtcatacatcttagcttgactatgaaggaatttttgatatgggttaaagctttgaatatactatttgagtcgattcatgtgccatcccaagagtatgaaaccatcccgctattctggcccttatggggcgggggatattgaaatggatagctcaaatctttagggcaagatatggatacgccccatgcctttatgaatactttttacaatttg

SEQ ID NO: 60974 - DNA, 988 bp, Oryza sativa
cagaggaagtattagctaagtgcaaggaaatatagggtctgtttgggaagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagggcaacacactttcattttgctttgttaaaaaaaaaaagaatttacaacatctatttttacataaggttcatttaatttaacaactgcattttttttcaatccctatttttt

SEQ ID NO: 60975 - DNA, 2159 bp, Oryza sativa
catacggtgcttcgcttgtctatatcatttatttggcatcttaaacttctcaagcttaacttgtgcatacaatattgttaggttttagtgttctatgcctatgaaagtgcaaaaggccaataactgatggatgaaatttgtgaatcatgtgatgttattttgcgcaccaaattgcattgcatcgcattgccttttttccccatatctttagctcaagtagtgtgggccaggaggttgatttgaaaactcaatgcatcgaatcttgcttgtagctgcttatttcctattttggtggttgcctacttcccttcctagtaatccatcacaatattttggaactttaaagctgtgctcaaaattatttctgaatatgtatgtcattcaacatacactccttacactgtaatcatacagaaaccatgcacacattatctcatttagttactaccatttgcatgttcagttgtgtacaaatgtatttgtcttcatcggacaatgttgcttccttgtgtcccaattagacttaatttcttcgtgttatgtatttatctttgccaaaggtgcaaagtagcacttagtttgtatcatgtacaatttggtcatctgttacagactttctataaagcgtccaagaaccgctttgatggtgatgcagaatttaaagacagagctcaacaagcagtcgttagacttcaggtcagtgcaccttcttggatctggaatatgttaatgtttttttttttttttggggggggggaacaatggaaacactttgggtgtcattccattagagatagaaaatgagtatgttaaaattgcatcttatcatcctcatacaatgcctaagaaatatattaactgtagggaggggaagagagataccgtgctgcttggaacaagatttgtgaaatcagcaggaatgaatttgacatggtttacaagctcttgaatgtaaagcttgaagaaaaggtagtgtcacactctattggacgcgacttatatttctttagaaggttgcttatcaataacatgaatttgctacctgaaatttctgtttgttgttttagtagaatatttgcgcaaccatcatccctttccttttctatataggatctgagacttaaacttttactgtatcaatttttatgatatttttggatagattgttctttctcttgttcccatctgagccattttgaaaagtctctgataactaaccactagttttacatgactcaacaaggtgtacctcatcttcatatgaagagtggaaacattttgctgccaaaattttacaaattagtcagttgctgattggggtccttttacttgatatttctctgttgcatagcttgtgattcctattggaagatgtattgacgttcatattccagggatgttagaaacacattcaatttgttgaacttctgtctttttagctgaatccattagtcaatattttcaggagatatttatagggcttcacttatctgttttgtcgatatgtatttgttgaagtttccgatggcactaatattaatttagttggatttctggatttctttcttattagtaaaaacatcagtttgtctgtttatgatctgttacagcttgtatggctgcattttatcttaatccattttgacaatagcacctgtagctgtgtgtacttgctttcaaccaacttttggctattggtatcatgaaatgcttatgtttgtcgttttcttccctgagcatccaagcagcttgttgatttatattttgtagtgttgagaagagagctattcttttcagggagagagcttttataatccttttattccacaagtcttggaagagttgaataacaaaggtttgatcaaagaaagcgagggtgctaaagtgatattcatagaaggccatcaaatccctttgatagtggttaaaagggacggtggctttaactatgcctcaacagacttagctgctctatggtgagttgctaatcgataattttggtgtgttcctacagtgcaattactcttatattagctataatttgcagaaacaaagtgaatatattttcgtagttgattcagtctatttccacaggatcagaatttgtgaatgtaatcgttctatttgtgcttttatgcaggtaccgtcttaatgttgag

SEQ ID NO: 60976 - DNA, 977 bp, Oryza sativa
tcatccagctagcgatgagtcatccactcgagcccacccacccccgaaagttccggaggaccccgcgccggccggccgccacgtcacccacccacttgccaagctccccatctccgccggcggggatcggatcgagctcgccgcagccgcccgctcgctcgaggacgatggcgagatcgatcgatggatatggaggaggaaaaaaagtttggaggatttgagctcttctcacgtcgcaagccaacttcaccacgtatatttaaaagcgaaagggcagcaaaactctggcccacctgtcagtctccccatcgcctcccaggccatcgggattctgtgctctacggccactgacaggtggagtaacactggcacgtgcgggcgtgggccccacctgtcagtgaggctacgcgacgtggggttggccggaagtgcagtacggatagggtcgggaaggcgtgattacgtgaagacctcgtccgagtactgcggtggctctgtatgtacaggagtggtgggacccacgtgtcagtggaagggaagggaatctagtgctgtgttcttcccctattttcccaaaccacatctcttattttctcgcgcgtttttcaagctgctaaatggtgtgattatgtaaaaactttctatataaaaattattttaaaaaattatattaatatatattttttttaaaaaaatagttattattgtaataatacgagcttttgttttatgtgccggaggctaaagtcaacagctagagcgcttgctggcttgctgcaggatgtagtacgtgtctgtttggtctggcgtgagcaacttgatgcatatctatatttttcttcttcttttcttcgagacacatgatgcataggagtacatatctctattcggtagttggatggatagctttaaaaacgtaacacatgcagcagtgtcagggtctgtttctattcataattattcttattattattttg

SEQ ID NO: 60977 - DNA, 1202 bp, Oryza sativa
agtccgggccgaagatctcggcgcggaggaagcgggagtagggggcgtcgtcggtggtggagaagggggaggcgcggtcgcggtcgaggagggcgaagttgtggaggcgggaggaggagcggcaggggataagcggtcgctgtacgtggtcttggaaggggatggcgtcttggggacgtcgaggaggaggcgggccggggaggcgacggcgggatcgaggcggagcccccccgccatcgccggcggcacgttgaggcgcggcggcgccggcttgggggacgcgtccgtcgccatcgagagagactagggatctctttcttgctcgtctgctgccccgccacccaccgccgccggcacgtcgaggctggatgcgccgccgacgacgacaacgacgacgaggaggaggaagaggagcggagatgaggttgcaacggtcactttggttggagtgggcaagtcgcctactttttctagcacgagctgtctccctctgactgtgggccccccacccgagtagccgttgtactctctctgccatgcgggccggcccattagcatttccttcctcgctttctttctttaaaggcccgtggaaaaaccaagcccatggattcgcatttgttttgggccggccagatcttacgtgtatgatgtgttgggccaacatgatactaggcccaaacatatagtacttttcttttctttcagatgctactattatattaccaccgagaagaggaaatgtgaacaagaaagaatgtgatagaggcattggatgagcaatgtgatttttttattagccgcagaaaatattgacagtccgggcgatttaactcgtgcaatatctcatcaatatatgattgatacaaatatagagattatattaattattattgcatcgccaatatttaagccagccggccggcgagagcatcttatagctagatttccatatgacatagcataggatggatctacatatactacttctatatactatactctgatgaagatacatacatatagtagtagatacaacgtgtacctttcgatacgatgcatggtggatcagctggaaattaacaaaagcaacaactatagtagtaatacgtgctgcactagctacgtacgtacagtacgcatacatacctatatatatcttgtaagtactagatcgactagctagctagctagagaatact

SEQ ID NO: 60978 - DNA, 10794 bp, Oryza sativa
atgcttgtaactcaaagatacaaagtggataattgtaataataataaaataaacatggttcaccaatctagaaatttcaaccattggcggatcttaatatatactctttccttgtcaaaatatatatctatctttgtatttcaaatttttacctcttaaccacttaagaaatgcatttccttaagatcttattcggtttagaggggattaaagaggattggaggggattgaggaggaataattccacaccacaatatgtgtggaataaatctcccccaatccgtccctcacagggattaaccaatcaaggcctaagggagctaccaaaatttatctcacaagttatactttcaattctttttcaaactctctgagacatatacatacatgtgtgaaacattaattttctttttttttctttcttttctatatggtatataaggatagaatgattattttattcataccgctgttcgctgcatgcgaggatgacttggcatgctcacgtagcaccttttgtgggtccaaggactatattaacccaaatgattaatttgaaagacttatttgaacgatttgaaacctcaaggactaaactgagctcgaagcgaaactatagggatcatattcaccctaaaataaacatggttcaccggtctagaaatttcaagcattggcagatcttaatacatactctttccatgttaaaatgtagctatctttgaatttcaaatttttacctcttaaccacttaagaaatgcatttccttaacggaactaccaaaatttatctcacaagttgtactgccagttctttctcaaactctttgaggcgatatacatacctctagctattctacgttgttggttcattcgcaggaatggatcatggacgccatgttcacgcacacggcaacaagatgcagcaactggccgacgtcttcttcttccgcgacgccctccggccgggctccgtcatcacgccgaccatcccgccgacgacctcgctgccggccttcctccctcgccacgtcgccgacgccatcccgttctccgccgaccgctttgccgacgtcctcgccatgttcgcgccggcgtccctcgccatggcgcgcgagatacggtgggcgctcgacacctgcggccagcgggcggcggcgctgctcccgggcgagaaggccggctgcgccacctccctcgagtcgctcgccgacctcgccgcgtcgctcctcgggacgcgcgacgtccgcgcgttctccgccgccgaccttcccaccgacgccgcgaccacgccggcgcggcgcgggaggtacaacgtgacgtccgtgcgggagctctcggcgatggctggttccggttcgtcgtcgtcgtcggagccggcgccggctgccgtcgtggcgtgccacgacctgacgtacccgtacgccgtgttctactgccacagtaccaagccgaccgccgcgtacgcggtgacgctggtggcggcgaccaccggggacggcgacggcgaaggcgaggcggcctcgccggcgaagatggaggcgctcgccgtgtgccacctggacacgtcgcggtggagggcggacaacccgttcttcgtggcgcacggcgtcaagccgggggaggtgtccgtgtgccacttcctcaccaagctcagcatcgtctgggtcccacgccacgagcaggggggcccacgcgcagcagcttaatcatcatcgatgatgtaaacaagctctacaacctaaagtgaacaatttggcgtggtttgtgcgtaatttgcagcaacggtcgatcgagctatctacttatatagtatgtaaaaagtgaataattcagtttgtcatcgtgtgaaccacatgtgtgctgcatatttgtgcgtgtgcatgttcataattaatatggatattgtgtcttcaatatgggtacatacacaagtgcttttatttaacagactatctaaaaaactgtagtaagtttttaataaaaaaatttcaaatctaactatggccctgtttagatctcaccctaaaattttttaccttgtcatatcgaacgtttgaacacctgcatgaagtattaaatataggcttaaaaaaataactaattgcacgtattaggactaatttgcgagacggatcttttaagcctaattactctatgatttgataatttggtgctacagtaaatatttgttaataacaaattaattaggcttaataaattcatctcgcggtttactgatggattctgtaattagtttttttttatagtgcccgaacactctatgcgacaccctatataatatttgatgtggcacgtcaaaactttacacccctagatctaaacaccccctataattgtaatataatccactataactaaaatataatttgtatataattattaaaataatatatgcaactttatacctaacttatatagaaattatactgtaattagttacagtgcagttacactgtagttatacttcattaaatcatatttaactaagttaaatatgatttattgcgcaataaacttgatttatgatgccagccaaggggggggggggaaaaccttacaccgacaggcgcgtccgacgcatcgttgtctaagagggacgggcacatgtggccgggcgggcgcaccacatggtgcgcacgtggcgccgacaggcgcgtcccacgcatcgctgtctaagagggacggacacacgtggccgggcgagcgcaccacatggtgcacatgtggcgccgacgcggaacccatgcagcaccgatgtgacggtgatcggacgaccacaacaaaggggcgagggctcactagccaaccggctggggagtggcagcgcacggtccggcggtgactgttcgatgcagcagcatgcacgacatgtgacagagggaaagaggaaaaggattctggtgctcatcaagcgtgggtgacgggagaggcggcggcggaagcttgcgatggcgacgagatggtggcggctgacatgggacgatggcgaggatggcgctccggcggccacgggcttcgtggaggaggtggtcggggtgcgttgcagcttggggaaggtggagaaggacagggttcaaaatttcgccgaaacagggtccagaatttctgaaaatcgggtttatcggtgggcacccaagaaaacagtattggccaaaaatttcggccccttttgaatttgccgcggcatttttccggcggaaaaagtacacccaaggtccctcaacttgtcatcgagatacaaaatcgtcccccaatcgcaaaaccagataccagacatccctcaactaataaaaccattcgctttaggtccctcggtggttttgaccccggttttgtccgatgtggcggctgagtcagcgtgggacccacgtagaccccacatgtcaggcaatccatgtcagcctcccccttcctcctctcttcctctcttctacacacagtcacacacccaggcggtagcgcgtcggcagcggcggcggtagcgcgtccatggcaccacggcgaggcggggttagcacgtccacggcgatggctggcagcggcggcagtggcgggggccgcgacggggaagaagggagggcgtcggcgtcggcggtgataagggaggggagggcgtcgccacgtgggcgaggtcgaggacggagaccccggcggcggcccggcggagctcctcggcggccaaagatgggcccggggaggcggtagcgaggcgggaacggtgcgggcgtgcaggtggcggcagcgcgcgcctcctgctgccttcgcgcgccatgccggcgcccgcgcggccacgccctctccgtcccgcttcggcgcgtccggccggcgcccagcggcctcccggctcacacactcactttgacctcccgctctgcagacgccaacatcgttggtcatcttccggtccttcccttgcttgggtgacgacatcaccctgcagcaattcctccttggagactgcacgcgcgtcggtttaagagcaacattaaaaaaatcaaggttttttgttgtacaaatcaattcagttttttaactacggtgtgtgtttgattacccttttccagaggtcagggtcgggcttcttgaggacgatgacgcggtcgagcagagtggcaaggtcagggatgcgccagccgcaattgacgggcgcgacgcggtggcgctcgtactcggtgacggtggtgttgcggcggcggtcgaggcgggactgccgcatgtagtacacctgcggcatttggcatggttggcacgccaggggccgcgtgttgaagacgtacgccgtgtagtcggcacagcggtaccaattgaggaacgtgcgcatgggcatctccatctccgcggcgacagcaccccgcgcgtcaccaccaccgcgaacccccacaacactgacaccgtccactgcttgtcgccgtcgtagcacaccgactgctgtgccacgcccgccgatacggcgccgtcatcctcgatctccccttcctctgctgcctctcccgaaccgcctcgatggcagccatcggtgacgccgtcgccgccgcattggccctcggccctcggcgcgttgcagttcatgacggcggtgggggagatcgcgcgcgggcgggcgatgccggcgctggcgccggcgttgggccgcgacgctatcccgtgcccgccatccaccgccgtcgacccgctccccgccccgacggagctccgcctccagtacctcaccatggacatctcgccgccgccgccgccgccttgctcccctgctcccgcgtcgtctccgtcatcactgccgccatatcgccggccgccggacctcctctcccacctcgcaccatcggtctcttccccacctgtcggccagcagcgccggcctgcccagagcccccagagagaagagtgagagagagaaggggaagggagagaagaggggaaagaaagagaggctgactggataggctgacatgtggggcccacgtgggtctaagcagacacgtagggcaaaacctgcatcaaaaccgccgagggccgccgagggatctattttgaccagttttgtataattaagggaccccatatatctggttttgcgattcgaggacgcttttgtatcccgatggcaagttgagggacctttggtgtactttttcttttcccggtccacagcctcccaaaattttggcccacgcgcggacgcgccctagcccagtcaaagtcctagagcccacttccaagttccaatcccgtgaccccatccactcccaaccccgtgcgccgcctcctcctgttcgagagtcgagaaagaggcgagacgagagctgccgccgacgtggccatacatcgatatgccgccggccggcgccgtcgccatgcatctatctgccgccgccgtcgccattcattgagccccagtgcgccgccttgtcctgttgttcgagagttgagaggcgagaactgccgccgccgtcgccatacatctggatggcgcggacgccacatggagctgcatcatccccctcgcgtgtccgcttcctccaaaacccgtgcggccgtgccttagcctcctcgagaagctcttggacagcggcacagcgcggcctctcctccctcccgtcgccatgcatgcttgatattgtgctcttcgattgcttatatgatgctttgcactcagagagtactggttatttacagactacatactccctcccctccgtcccaaaaaaaagacaaaccctatctttccgtaccaatgtttgaccattgctacgtggttctttgcacgcgtgagagaaacaacccgtgacgccgccgttcttcccttctgtccactccccgtctcctcttttcgttgtgccgccgttcctcacctcagccacgccgtcgctgccgtttctcgcctcgccgtgccgtagctaccgtttctcgcctcgccgcgccgcctccgccgcgccgcctccgccgctgtggttccttttctcgtcacgtcgccgtctagacaccgccactctctgcatgcatcgattcacggtgggtagagctgagcggcgcctcggcgtgggcaagtgcggctccccacccaattcgtgtcccccccatggtgtcgggcagccacgctaagagcccgggtcccctagtaccctggcccttgttgatatccctgccttcctactagcccctcttcaaatcttgtgctcaggtgaagtaaattaacgatttgtaatcagtcaatgtgaatatgtgatttgcgaatcagtgaatagtgaatgtgaatatcagaacgttctgctgatttgctatattgtagtttgtatattggatttgcaaaacatgaagtgcacacaaaagttcaagagaaatatatttttctttaaagacgcaccttgataatgtcattgtgaaggtttaatacgagaacaaaattagttctaaggctaggtttatacttagatgtaagatttctttgaaaacaaggattggcatttcgtgggcataatgaaagtgataaatctagcaaatagagggaatttccttcagcttttgaaatggcttgcacaaaataattagtaagttgatcaggtgattttaaaatggcttagtcacatatattgagcaatataggcgaggaagacataataaaaactttcatggctatgaataagcgtagattaaggtatcggcaagtaattttctttccatgtctaagatcttttttattttaaatatctatatgatagtattcgcacgttttgaacttgcttgttataaattagccaattattgatgttaaatgatattatttctatgtttgtatcgcctttttactaaatttttacatctatatatgatttacggtgttcaaaaatttttatatgtaatatgaacttctgaaatagtactaccagaaaaaaattcctggctacgccaacatatgttattttttataccaaatgatctagatacaatctacttgatttcatgcacaaattcagccaaattttaataaattttgtccaaaatttttctcgtatcgctgataaaattccgatatttccgataatcctgtttatcggtacctttgatattttttttatatcgatagttgaaaccctggagaaggatctgaccgatcggaaaagtggtcttttaccagtaagctgtggcatgcttacgtttgggtttggtaaactacgataaaaatacaaaacttactttatatttgtgctattgtttgcctcttacctctgtaaagtcgaaagaagctcaaaggtaagcttaggcttagcaaaaggagacttctaattcatcttcaagctgtagttctatgaaaaagaattggcagggaataaatccacggttttgatctttctggttagattgtaataaatttttgtcaacaacccaattcacaatatttccaaacgacaatatccactgcaacaatggagggtggagatggagatggcaaggatacaagtggatagaaaagttctagtagctaggaaatggagaggtggaagaagaaaacaggtactcgacgagaatccaagcctagacctaagtcgccgccactgccgccattcgcccgcaccgtccaggccaagcttccgttttgggattctctccctctcctccttcccgtagtactgctgcttttatattctcttcttcttaggctctgttcggctgccattatttttactgtgctgcagccaaccagcacagtgtgttgtttctttcggctgtggcaacacagcggcggtacaaagcagccgaacaggcccttaggctttacatggaacatggtcttgggctgcatcaatagtgtggggcggctgcaccttaggaagcccatcggctcctaacaacccgttcccttaatttttggcttgtctccaagccaatgcaataaactcctagatcccatggcacctttagttctgagaattcttcgggatgtccaaaatacaaaaaaacattcaccattgttcctctagcttgcagttgctgagatgaactttggaaatcaaaaaggcagcttgagtacataaattgatactttccattagataattgttggttactgagtaggccaaactcccatgagctagaaatgtgttcagcttgttatcatgctcagcccctgtttgactgagcttgaatataacaccttacgaattttgcacagaagaaacaaccatctcggtagtccctctagttggaattgcataactattaaccttccatgtagcagtaagcaagagaagaagcactttatcaaaatccattgcttcatcagcccatttgagagaaccaacaagccaacaaatcaccatgcagatgtagtacatgattgagaacttgtgagctcttctctttaggatgttgaaccgtgccaaacagcagaaaagtagcatcaacaacatggtgttctttggcagtgacgatctcacaatcacatgatttagtgcattcttccctcatctaggtattaaattgataatctgaaccatctgagcatctagatcccacactaactgcactaattgggcttgcatgagttccattgggtccataattgtgaatgccttgccttgaagaaaatatttcctatttgcaaagtgaatcattgacttggtgccatgtaaagtaagtagcattctacacatgtattgtttagagttcaaatcaagcataccactagaaaaccaattattgtgcataaataggatgtgctgaacatagcacttctgaccaatgcaagcataagaatgtaagatcaatgtgtgtattgattcttattctgtgatgaacaattggcatctgtgattattggttttgatatttggagattatcgttgaagtggttttggagataatcaattttcaggtgatgatcggattcactgttattttatgtatccggtccgaccgagcagaggttgccggtcagaccggtgctatgtgtgcggtcagaccggccggcccgtggtttgaccggccgatgctgtgtcggtttcggtttcgggttgtttctttggatatccgtgattgtttcatggttatggcttctagatggatactatacgtatgtaatactgttgtttgctaataatgagtcaagttggggatagcttggtctcggaatatggtttctttgtttgtttcatgtgtaagtgactcgatgcctcgagacagtatatgcggtgatagaccgggagtcggcttggagataagacgatgtccgtggtggtcagatatcatgcgggatatatactaaggctagagttgatgcacgtggttggtgaagattccatatggcatacgatggaggtattgtgtacgtatgggatgcggagtcgaatttggaaggagtccaaatttggtacgattggttatgtaaagtttgtatcttgtactagagggtttcctaaggtgtttaggactcttagtatgagtttggttcgtggctttaggctgcctacctcatgtataaatagagggggagcgtgaggcttcccggtatcgcttttcggtatcgcttttgagagcaattgagttgatagtttagatagggtttcaagtttagtcaagatttttgtaaggagtgctgttggtgcactttgtaaacacagagagaagcaataaagtttttatctactttgagagttcttcgatttgtgtttcaccagggttcggcggtccaaccggcggcgcaccagcggtcagactggcaaaaggcggcggtcagaccggcagagctaaggcggttagaccggcgatgcagtcaggcagcggcaggcgatttcgacggttcgaccgatcgatctacatcggtcagaccgacgttcatcaggcggtcagaccagcgcatctacttcggtcagaccgcgatccatcgatttcgagggtaacttttatttccgctaaaagttttcggtttttgggtatatcaaccattcaccccccctctggttggcttagttcttgtgtttcgatcctacaagtagtttcagagccttgtttgcttctttggattttaatcgatctagagtttttgccatggctactcctgttaggttttcaactaagcctcatgttttcgatggaatggatttttctcattggtgtagtaggatgcaatcttatgttatggctgaagattatgatatttggagaaaagtttctcatccttatgtaattcctgaagttattaatactgctgctacaaaaactgagtttgaacaaaattgcaaagctcgtaatattcttttgagtgggatttctcattcggattatgatcgtgttgctcatcttcaaactgctcatgagatttggactgctttgagtaattttcatcaaggaacaaataatattaaagaacttcatcgtgatcttttcaaaaaggagtacattaaatttgagatgaaacctggagaagctttggatgactatctttctcggtttaataaaattttgagtgatcttagatctgttgattcttcttatgatgctaattattcacaatatgagatttctcttcactttttgaatggtcttgacatgtctatttgggagatgaaagttacattaattcaggagtctgttgatatgtctactttgactttggattcgctttacacaaaactaaaaactcatgagatgaatattcttgctcgtaaagttgattataagtctagtgctttgatttcttcctcgacttctttggatgttggtgcttcttcatcgaagtcttctgtttttgctttatttaatgccatttccgat

SEQ ID NO: 60979 - DNA, 3461 bp, Oryza sativa
gcatatatttagatagtgttgggaggtaatcttccgcgcatgtaaaacggagctactcatcggcgcatgattaattaagtattagctattttttaaaaaaaattaatatgatttttttaaagtatttttttaatatttgtttgtaaaaaacatacggtttagtattttgggaagcatcgtgcgaaacgagagatgtgagttgggaaagaagaggaaataacacagccttagaatctgcgagagaatagggcatgggccctgtgggcagaaagagtgcaccggcaacgcatttatcgtgtctgcaccaattaatcttgggagtagctacatttatagcgttattttttttaccaaaaataattagcatgtatttatattataagtttctaaattacatatgtaatttagtatatttataacgtaaatccccaactataagtaggatgtaagtataatattgtattaggatgtaaatattttttatataatttatatgtaaatataatatacaccatagttttgtttccttggtttctattaaaaaaatatttttaatcaacttgaatcactgattggacagtgtgaacgagtaatattcattgtgtcagagcgcgggcataggcattgttcaatagcttggttacactttactctctccgtttttaaatattagaaattttaattggatataatatatattagtataacgattctaagatgtatcacatccaactaaaatattttatatttaaagatagaagaagtaattatttattggctaacagtagtttcgtattctggcgctgtcctgaaagaatctgggacggaatcgagtggcccaaaaaccgactgctacctgtccaaaaatatgtcgacataattctagcaaatttgcttgtgaaatctccctttggtagaagttaccatcactcatgtaatatgtttctaatctccacttaataaagtttatgagttctaaaagaaaacaatttcatacaccctcagaaatcagaacacctcacacaagacaagacgactgtcttttgcctcaaatttagcattctgagctgccaaagttactaggctttcgtaataaataattttcttcaggcaatcaaaactttatgtctaaggctgtgtttaattagatttgaacttttttcttcaacttctaatttttctataacatcaaatgtttaaatacatatatgaagtattaaatgtgaacgacaaaaacaattgcacagtttgcatataaatcgcgagacgaatttttaagcctaattacgctataatttgacaatgtgttcctacagtaaatatttgctaatgacagattagttaggcttaatagattcgtcttgcagttcacctgtggaatctataatttgttttgttattaatctatatttaatacttcaaatgtgtgttcgtatacttcaaataattttggtacacgaactaaacacaacctaataggctttctcgtgaaagtacccagaattctctaaaggaccggagtcttttcattgagcagtgaccaagaccaatagcaactaattctgggtcaatgctcacacttagggtgtgtttagttcgtgaaaagaaaatttttatgtcacatcagatgtttgattggatgttggaagaggtttttgaacacgattaaaaaaactaatttcataactcgtctggaaaccgcgagacaaatttttgagcctaattaagctgtcattaacacattgtggattactgtagcacttatggctaatcatggactaattaggctcaaaagagtcgtctcgcgattttcatacaaactgtgtaattaatttttgtttttatctatatttaatgatccaatgcatatgtcgaaagatttaatacgatgtttttgagaaaaaatttaggaactaaaccagaccttaatgccatctttcatgtaccgaacatcacaaaaactatggatcaagtgcttacattcgatgccatattgtacttgttcttttcatatgctgaagaattttctaggaagactttgggtcatgtgctcacacctggcgctatatcttgcatttacggattgatgtgcaggttcaattttccattttactcccagcaagctaacgtaccgacattcatacgtgtttgtgtctggactaaggcaaagttattttttaagtaaatcgaaatgattttctgttgacacgtttatcaaactgctaaacggtttatttataaaaaaaatatgtatagaagcttttcttaaaaaaatcaaataagtctattttttaaaaaatttataatagttattaatattatctatctatctatcctatacattaggcatttcctacgagctctcacgttaatcagaaaaatctagccattaattattaattatttagattgtattatcacaaccgaagataataaaatataacctcatgggctacctataaaacccatctgaccacggtacatttaaaacccatctgactgttatgtgtgctttatcatgtaacaaacgaatcatatctatgtatcatctaacaaaaaaatcaccatagatgagaaaaaaaatcaccatagatgagaacgagcctaccttcattacgagagaacagatgcgaactcaagcgaacggcgaacggcggcgcatgagattattttcaccaccgacgagctacctgctgctgtgaacgactcaccgttcatcctgatttgaagcgaaaagaagatacctgcaaacagtagttgtgcgtacttatacatacagcatcgattgatttgcttggcattcctaacactgctttttgaatcctcctatggcatgcaaccatcctgcggcctaattgactgaaaaaaggcacacaatgacgggctactgttgttgtcgctcctgtagaaccgagctgttacttcattggttgtattgcttattccgccgtttccaatacttttctcattaagatttaaatatatggagaaattatcggatgactttgtattacacagagtttttaaaattttgaccttatttttcttcctgcacaacatgttcttatgcgaaagaagaccggggtgaattgcaataatcatggtacccaaccatctacatgcgtgcacaaatgaatgaatattttaatagcgtaatgcaatatcgatgcacctgaatgtactctcaacacatataaagaccaacaccaaaatccctagctctctaaaattcttttaaacgtgcatctatatctgcgtaatatatagtggtgtcaagattcaaatcatggtggctagtccatgctaatattatatttatttatttatttatttattatgttgcttttgctaatatatttttttctgagtcaacgagttagtataggatgggatacaggctagatctgctggaagaggtaactcgaagatcataactgaatacctttttagttaacctcgag

SEQ ID NO: 60980 - DNA, 28633 bp, Oryza sativa
tgccgcgccaagacgccaggccgcgccacgacgccgtgacgccaagacgctgcgacgccatgacgccgccgtggcacgccaccgccgcgcaatgtcgccgccgcgccgcgcgccacgccgaagccacgccgcggctccgctgccgccacatgaatgaacgatcgatcgtgaacgaacgaaacgtgacttaggcgagaacttaacgacaacgtgaacgttaacgaacgaccatgaacgaacgtgaacttaacgtgaatgtgaacgaatgaacgtacgtgaacgtgaacgcgaacgtgaacgaacgtgaacttaacgtgaacatgaacgaacgtgaacgaaacgtgaacttaacgtacgttaacgtgaacgaacgaacgtacgtgaacgatacgtgaacttaacgtacgttaacgtgaacgaacgtaaacgaacgaatgtgcgtgaacgaaacgtgaacttaacgagaacgcgaacatgaacttaatgtacgttaacgtaaacgaacgaacgtaggtgaacgaaacgtaaacttcacgagaacgcgaacgtaaaatacagtatatgttactttgcgtttagcctaatacatttttttgtatgttgcagaaaagaagttgttgtcgtcgtccctcaagccggagtggtagctagcccttgaaggaattcgcgcaggcaagtgatgtaaatatatgattgttagacttagcatatatgattatctagggttgtaatgtacgacacttagacttagcatatatgattatctagggttgtaatgtacgacacttagacttagcatatatgattatctagggtcctaatatacgacacttagacttagcatagttgactattagagttttaatacaagattatttgagttttaatataagattattagagttttaatacaagattattagagttttaatataagattatttgatttataattagacttagcatatatgattatctatggttctaatatacgacacttaggcttagcatatatgactgttagagttttaatataagattcttagagttttaatacaagattatttgagttttaatataagattattagatttgtaattagacttagcatatatgattgtctagggttctaatatacgacagttagacttagcatatatgactattagatttttaatataagattattagagttttaatacaagattatttgagttttaatgtaagattattagatttgtaattagatttttaatatatgattgttagagttttaatacaagattagtacagttttaatgattatctagggttctaatatacgacacttagacttagcatatatgattgttagcatataagattgttaaagcaaatatgacctatagacctaacaaatattttttgtatgcacagatggctgatcgcgacgaggaacagatactatacaatacaatcgcagagggaagcaaccagtactggaacgaagaagaggggaacgaggatccaagccagtacttgatcgaggaggggaacgtggagagggatgcggagacgaacgaggaggggaacgaggaggaggaggctagtggaagtcatccctccgctggacagaagagggcacgcggacaacaaggtgccgcgaagaaaatagagggtcggcacatcataactgaggtggacgaagacggccgacctagtgccccggcagaagcagccaagaattttgtacgccacaacggttgggttgtgagggacaacgtgcctgtcagcacggtgtactggcacagaacaagggcacgcagggataatgacagctttgtcccggaatcagagaaagagatgctgtggaccacaatgctcgagacgttcacgctacccacgggtacggagaacacagtgaaacagttgactcagaagaaaatggcagaacaattccagagcttcaagggagatctctacaagaaatacatcctgaagggactaacaccgaacttcgacgtattcccaaagctaagggatcattgggacgagttcgttgcttacaagataggccaacaagggcaagcgatgatggccagaaacaaagaaaatgccgccaagaagaagtaccatcaccacttggggtcaggcggatatagcgtcgcaatgccgaagtgggaggagatggaagcaggattaattgagaggggtatcgaaccggccaccgctaaatggtcggatcgatcaaagttctggtactatctgcacggtggaacacttaacctagttgatggctcccttgtcttcagcgatcagatacgcgagggtgccagttgactaacggacgcagtggaagcctcttctcagggcacattccgacccgacagagagaaggacgagctgtcactcaccctacagactcccgagcatccaggacgaacacgagggaaaggcatgattccctggaagattggattcaaggaggacatccacacgtacaggagtcggatgaggagcaagaaagataccgaggcgaagattgcagatcttgagtacagggtatcgagctacgagctcagcatgcaagaggaggtggcaagaaaggtggatgaacacatggctgcacatcggtcccaggatccccaaccgtacattcctcctgcaatggtcaggccatcaggcaatcgtagcagctgcgcctcaacggggcaggtaggatcacagagcatggacgccatgcaaacccaggacgaaaccacctgccccgttgatgagatcacgcaacggacaccatgtgagctgcatattcccttcaagaacttatcaatcaaggtatgctcgtagttttatgattttttgacttgtacattccgcaagttgctgcttaggttgattactaatagatgacctctcatcacgtgaaggtggcgtcgggaatgaccatcccaacggacatttcagggacttaccactgcaggccaatttcagcaggatacttgagggtcgaagttgagctggtggaagccgcgtacgaggacctcgagttggactacccaggaggagacggtgagactcatctacgagacacaagccacgccattatactatagcgcaagcggtacatcatcctccctgggcgacaagcggcgtctcgtgcaccatctcctccggctccgccatctcctactgcaccatatcctccggttcctccgccacgtcctcctgcaccatctcctctggctcctccgccacctcctcctgcaccatctcctccggctcctccgcctcctccacctccaccgtgtccgcctgcacctcccaagacaaggtctcaccaagctccaccgcctacccgcacaagggcaacgaagaaggcgaaagttgacgccaccaaaaacaaggagccgccgtacgattgcagtcaagaggagcttgacgcttatgtggcaagagaagtgaagaggcaactcaagcctcggagtcctgaaaagaagatacctattgacccgagcatgaagaacttttcaagggaatgtccacagcaaacaagcagaagatgaagctatcggactatgaccgaacacttaagaaagcctattacaagaagtccaaactagtccctcagcttggagaacaaccaaaccaagaggtcgagccgttggtgaccggcgaagaatttggcataacggaattcatttcggacaccggtctaactatggatcagttgattggaagcgcatcaatcccgaaggcggaagtggcatacaagtttgaactcggtaaaccgcttgtcacgcctgagcagctgcagtccctaccgacacagatgtacaaattcaatgaacggtacatggaaatgagcgccgagggtagagagatgttcggagcgaggatcagaaacctcgactttttgcaaggagaagatgttctctggctccatttcaaggatgtcttcgatctgtaccatctggatgccctcgatgtctctcttttgagcgcatggattttgtaagtatctttgagttcgatttgtttcgttcaataactagctcctgtcatatatgtaaacaataataatttcattttatcgttgtagaatggagattcaaaaggcccgacggcagggggtttacgatactgggttcatcgaccctcggaaaatcaacacccaaatgattgacaagtacgagaaagacacagaggacaatctcgtccatctctaatgcagcagcatttcaagacgttcatactactgccatacaacacagagtgagtttttattgtcgttcgaacaaatttcgtatatatacatatagcatgtacattttcatatatatatctcatctcacgcatattccagcttccactgggtcctgttattctttgacttggacgcatagagagtcactgtgtacgactcaatgaataaagaggagaagatttttgacaaggtcttccgactgatagacaggtgatataatgtcatctattccaaagtcgcgggaattttattgctattatgttgatctcgggtaataattaattaatcatagcttgcaactgcacatgtagggcttgggatcggttccgtcaattggtccgcgggacttggaaagaaaaacttggatggaggtttcattttccggtgaatatatgcatgatccaaaattgtattgaattaaatctctaattacagttaaatataaagattatattaaatctctcatcgtttctcatgtagtatgcaaagcaggaccagggaactaacttatgcgactactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggataatctcccacacaaggattttatcacggttgttcaagaacaactgatgggattcatcaatgaagaagtctttaatcccgatggtaaattctactacgacggatcgacaattcataacgtcggtccttccttttctgacataacgccggcgtcgaagtcgtagctatagctagcaagaaaatgaattgtactatacatgtatatatatatatatatatatttatatatgtgcgtacatttactttagtgttaatatatattttggtaacatatatatgcacataagatgttaagtgctttatattataaatatgtgtgtatatatatgtatatatacatatacacatatgcacatatatatatatatatatatatatatatatatatatatatatatatatatatatatatatatatatatatatatatatatatatatatatgcacatatatatttctccaccagtgattcggcacctccttctgcggacaggctttaatttggctgtcttggcatggtcgacgcaacggtggagtagatgcatggcaccggtgacaaccgccgcggcggaggccccggccggccgtgaaggagttaaggacgaggcggcagcttccttggtccggagaggagaggcgattatgtcgacgttggtggcgctgggcagcgatctccggccttgtcgaagatgggcttgctaatgtgcttggggaaactcttttccggcatgcatgatgacttccgatgaggtggacgcgatgtggggacctttcccgacgattccccgagccggcgagacgtactcctccattctaaaatattcgccgttgacctttttaaaaatgtttaaccgttcgtcttattaaaaaaaattatagttttacaaattttataaaagttttgaaataaaacaaacggtcaaatatgtttaaaaaaattaacagcgttaaatatttaattagggaaggagggagtacatgggaaggagatgagcttggcgaagcgacacgtacggcaagttgccgtgagagatgtcgtcgagttggtcctcgttgttcgcttgcatgctgtcgaaatccgcagaggctgtgctctcgtggtatggtttcttccctgttaccttccatgcatacgacatgtatgagttacttggtttttgcgcatggtcttgtagcatgcagatgacgtggcctcgtctcattggtcggccgggttgccttgcatggtactgttgctccttgcttgtagatgtttgttgcatgcatgtcatttctctttagacgatcgacgcgtcttcaatggaaaatacttcgtgtcgtgcgttcgatcggaagacaaatatcggatatcaactttctcatctgtactaatctaaagttgattcaccttttccatgactctgactttacatatgcacaattcattttctctctccacgtctcatctttgtatgtagttagcatttatttagcttcatgtagtctatgagtatatacatgcaagaggttctagttgtaagctttaaaggaatttttcttgtaaactatttatccaatttactatccgattgcacaattgtattcgttgcaattaaatctctataacaagatatcatatgattctattccgattaaaaaaaatacataagtttcaaccgatgagtttggatgtttcacgtgtaagaaataaatgattcaatcagagtttggctatattgcacattttaagttttatgttgccatggatcttataaaatgttccatggcattatttcgatgtttcgataaacatttttctgatgtttcactagtttatttgtgaatgttgcatgtggtattattggatgtttcagtaagtattttctaatgtttcactaattcatttttaaatgttgcacgtgttgtttgggatgttgcaatgaatattttctaatgtttcaataattataactcgttgtttcacgtataatatataaatgttccaattagcaatataatcacatttataaattttatcagaaatataaccaagtgagatattgtaaagatttaattataacgaacacaatggtgaaatcggatggtagatcggataagtaatttagaagaaaaattagtttaaaggtttattggtagagaatatgaagagagagatttcatgcatgtatacacgagagtagggtataggcttgcatcatagcagcttaactacgatggttttttttgcatccaatcagacaggtgggtgagcaacgtccgaactgtagcagtcgctttttttgcatgcagttagacaggtgggtgagcaatgtccgatcttttgctaaatatcggacgtccgatctgtagcagtctccggcttcaattcatcgttgctgattcttgatgctgctgtagtgaacggcctgaaaggagcggatatatagcgaggccgtcgtcgaggtggtcaccagtgtagtcgcggccgcgtcgagcgtggtgaagatgtcggcgtcgaggctgtcttcgtcgctaacgcggcattcgttgctggatatatggcggcttgtgtgtgtgccttggacgtagatgcgtgcggatgtccttcttcatgctctcgtcgcagccgttgctgctatcctctgtggccttgccgtaattgttgttgctatcgtcacggctgcagatgagcacggtggtgtcgaggcctcccggtcggcctcgccgaggtggcaggctgtacagagcttgtcgtgttggcaacgtcacctctttcttcggtgtcgtcagtgacgaggtggcgatgaagacggcacggcacgatggtgtagaaggcatcccggccggatttgccgatgtcgcgggcagcatgggggtcgtgtagcatatatggccgcctggttctttgatgtcgtcggtgccggcgaggtggcaaagtagataagttcggtgattgctgcggtggtggagtaggcggtgttagaaaggttgttcctgttacatgtgttgttacatgtgataatgcatgagataataggataaggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacatggtatcagagcgaaaatcgcatcgactggattgcatctagcgatggcatcctctagctccacctccagcaacccccctatccggccaatccacccctgacaagctcacccgcagcaatttcttgctatggaaagcgcaagttctcgccgtgatccggggggcgcgcatggaaggctatctcaccggtgcaaccaaagctccttcggagacaatcacggttgtgccggagaaggaaggtggcagacccacctaaaccgtgaaccccgcgtatgaggcatggctcgccgcggaccaacaggttctcggctatctcctctcctccttttcgaaggaaattctgacgcaagtcgtcaccatggagatggcggcgcaggtatggaaggggatcacagagatgatctccactcggtcgcggtcgcagtgtctcaacacacgactcgcgctctccatgacgcgcaaaggtgacttgagcgtgtccgactacatcaacaagatgaagatgctggcggacgagatgaccgccgccggcaagcccatggacgacgaggaactgatgggctacgtgcttgccggcctcgacgacaactatgaaccggttgtctccagtttggtaggcaaaagtgagccggtttcaatctctgaagtctactcacagcttctgagttttgagtccaggggaaaacttcgccagatgacggctaatcacggatactcctctgcaaatgccgccaagcgcggcggcaaaggcggcgacttcagtcgcggtggaggcggcgggggtcgcggtggccccaggaacaacaatggccgtggcgaacgcggcggcttcagtggacgcggacgcgatggcaacaacaccggcggctgctacaactccaaaccccgtccggtgtgccaactctgtggcaagattggacacgtcgtcaccgattgcaggcacaggttcgacgactcgttcgtccctgatccaaagatggcagcagcagcctcctaccatgttgatccgaactggtatattgataccggtgcaacggatcacatcacgggtgaactagagaagttagcaacccgtgagaagtacaatggcaaagatcagatctacacggcaagtgatgaaggtatggaaatcaaacatataggccattccattattcgcacacccacacgcaatttgcatctcaataattttctccatgtaccacatgcacagaaaaatcttgtatctgctcatcgtcttgcccttgataaccatgccttcattgaagttcattctcgtttctttgccattaaggatcaggtcacgaagaatcttcttcttagagggcctcgccgaaacgggttgtatttgctgccacggtcgtcgctcccttcatccaagcaagcacttggagttatcaagcctagtctcaaacagtggcatagtaggctaggtcatccttctttttcaattgttcagaaagttattaataataataatctcccttgtttaggagatcttcatgagtctggattctgtgatgcctgttagaaagccaaaagtcatcaactcccctatcctaagtctattagtgtgtcaagtgtgcctcttgaacttatgttttcagatgtgtggggacctgctcctgattttgtaggaggcaggaaatattatgtgagttttatagatgattttagcaagtttacttgggtatatttgcttaagaaaaaatctgaagtttttaagaaatttcttgatttgcaacaacttgttgaaaggctctttgacctcaaaataatctccatgcaaaccgactggggaggggagtatgaaaaattacatagcttttttttttaccaaaattggcattagtcatcatgtgtgatgcccgcatgctcatcaacaaaatggatccgctgaacacaaacatagacatattgttgaggttggcctatctcttcttgctcatgcttctatgcctttgaaattctaggatgaagccttcttagctgccacttatctcattaatcgcaccccatccaaggttattcaatttgctacgccattagagcgactcttaaatcagaaacctaattattcatccttgagaacctttggatgtgcatgttggccaaaccttcgaccttttaacactcgaaaactccaatttcgctccaaacagtgtgtttctcttggatatagtaatattcataagggattcaagtgtcttgatgtgtccactggtagggtttacatttcgcgggatgttgtgtttgatgaacaaattttcccgttttccaagttgcattctaatgccagtgctcgtctacgggctgaaattaatctcctaccacacactcttttgaatccgacttttaccactatgggtgcgaatataaatggtcatatgtttgattctcctgagcgtactgatacttctggtgaaattgcagtacaaatttggaagaaaatgatgtaggttgttggtatttcttaacgtcattactagaaatataattcccagcaatacccagcaatgacgcagaaatactcctggtatattatggttacagagttcatccacaagcgcacggatataccattgtagcatttcacctgagagtattccaagggtatcgtatgtattttatcccgtggaaagattatgtagagagagattgactaatagtttatatattacttgtgataatcatattctaagaaggggttaagataatccaagggtagagtgacagacaagcattaacaactcattctcataataaatgatctaagctaggtggaaagaaaagagaaaggaaatatattcctatacttctaatatacatagtatacatacattctagttaactgatatactagctaataccctctatccgatgccctcctggtattttgagaagccacccctgactgccgagttccttacgacagcccgtcatgaccatacaaccggggctaaatacggaggaataccctccccaggaaattaacttaggattatataccggcgcggaggaatacccgtactaagctgtgaccatcagcggcccatctctcatccgcaatatataacccaaataatgatatcccgcaatctagacaccacgtctaaactaccagatactactctaataccatcgtcatgacatagagtaatagcataagtaaacattatacccgcaccaaagcatctcccagataagctagccgtatattcagtataacatgaacataatgtagagtaggtactcatatactcggaaagtattccaataccaaaattgtacatagaagagtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggtgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgttcaaagctattttgtaaacacggtcctagagctatacaataatcaaggccgtgaacccacacgaacatgccttaacccaaggcctacgatgattcagaccgaactggcaacccgaccctgggtcccagctcgtcccaagccaacccaggccaaccattccatattttagttgttaagcaggttttaataattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggctgaggtgctactatcaaaaccatgcaccccgagcccagcctaaaaccattttgaggattttgaatagagggggaggtgtgaatccaattccacaataatccaaccattccatagtgtccaggtgatatgaatattcccaaagtctagagttgtaaaaccacctaatgttgcctaattaaccagcgaagcatcttcctaaaatcatactagtggtaccatgagtagagtgtccactagttggggttttgtttattctagggtgaacaaggaaataataacgataacaataataaggtcataagaaagatacataggcatggctagataaaacagtgataacgcgggaatttaaataaagcgataatgcaataatttaaatcaaaataattttataaactgggattcaatatgttcaaggatgatgtgacttgccttgcttgctttcccaaacgttggcttcaacttccacgaagagcggatcttccgaagctgcagcgtctacacgaccaacggaaaagaaaaggattttactctaataaactccatataacaaggtggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgaggggagggggcgcgcggaccgggtccacgggagtggggcccacgcggcagcctcatggtccacggtggaccgggtgcacccggctcgcaccggccggcgccgtgggtcccacgcgtcagtcgcacccgagagcgcgggcggctgacggccgggccccacacggtagccgcttggtgcgcccgaaggcagccacggcggcgcggccggcgggaggcggcgtgcccgtgcccctatggtcgccggcggcggccataggcacggcggagcggcggccgagagaagggaaggaaagggggaaacgaggcgacggtccacggctcaccctaggtcgacggcgatgacgaaaaggcagccggagcggaggaaggcggcggcgcggctcgggtcgacggggtcgacggcgttccggcggtcgggagcgaaacggaggggtggacgaggtcggcgaggatgcggcgaagcctaaggaggtggcgccgaggtgggaagtggtccggggcgacgacggcggcggaccggagctcggcggcgacggcgaagagagatagtgacgacgcgggctcgattccggcgaggaggaagggcggcgagaggcggaaacggacggaggaggtgcgggaagggtttaaatagagccggggcgagagagggcggccggggaagggaggaaaccggcgcgggaggtcggctgccatcaatggcgccggcgagatttgcgggggcaaatccgcctgtttgaacgcgagagagagagggaaaaatagggggaaagggagaggggatcacagggagtgatttccccctctttattgcacgcggggacggcgggaggcggcaggattcacggcggcggcggcgctagggcgcggcgaggcggcgggagcagcgggaggaaggggatgacgggtgggccccactcgtcagcgagggtggcgggcgggcccgcccgtcagcggcgcgcgcgcggggagaggccgggtgggccgcggggagaggagagagagggggagggagatgggccgagccggcccaagagggagaggaagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgcgacaaagagtattctaataaaagtacaaagcttacaaaagagaagaggaaagctgctaaagccatacccgaactcttccgaaggtttctagactcctgactcctattctatttctattccaccagctagatactactaaactaaacttaagagaaatgagagagctattgcttgaggtgtgtgttgaagtgaagagagtgagctccttatatagaggtagttatgacggttgtggaaggggaattgtccgaagtaccccgcaaccgccatcaggagaagatctggagcgtccctgccaaaccccacatccaacaatggagagatgggttcggccgaacctggggccggcccaaccagcccacaatttggctgctggcatcctggacttctcttctccgcagacttgtgaaatttggcccaattcatcgtgtcaattctgagttcttggtctattcatacataagtctggttctcgacatcgtccgattgatttatcgtctaagttgatgtcgattctcctccactttattgtcattctctataaaaggttagtatacctaatactagtgaaatattattattctaacaaacatatgcattgcaagcatcactagttctcctctattttagtaatattgacggtcgaaactgattgataacgaccgtcaacacaggttcagcacaaaataatgaaatacagtctcccggagtgagcacagaagatccggatgatgccgtcctttctcccgctccctcggcgtcctcgggatcgccacatccatctggcgctggtgcagacgctggctctgcctctgacgcctcctctgcaagcgctgccagccattcaggaggtgacagcagcccggtgcagcctggtgcagccgacagcacatcgcagggggacagcatgcagggggacagcatggcagccgatgtgcaacggcagcagtcgcaacaacagtctcgccctgtcactagtgcccagaggcattcgcaaggagaaagtttacactgatgatacactcagatataatttccttactaccagtggagaaccacatgatttagatgaagctctctctaatcataactggaaaaatgcaatggatttagaatataatgccctgatgaataataaaacttggcatttagtaccgccttgtaaaggtcacaatataattggctgtaagtgggtctatgagataaagcgtaaatctgatggaactttggatcggtataaggctcgcttagtggcaaagggatttaagcaaagatatggtattgactatgtagatacttttagtcctgttgttaaggcagctattattaggactattctatctattgctgtatctagagggtggtcctttcgccaacttgatgttcagaatgcttttcttcatggccatcttgaggaagaggtctatatggcacaacctccaggttatgaagataaacgaaaacccaaccatgtttgcaagcttgataaagcattgttgtatggtttgaaacaagcacctagagcatggtactccaggcttagtagtaagctttgtgatattggttttaagttatccaaggctgatacttcgttgttcttctatagtaaaggaggagttactgtatttgttttgatatatgttgatgatattattgtggctagttctacacagaatgctactgatgctctattaagtgatctgaagcaagactttgctctcaaggatttgggagatttgcattattttcttggtgttgacgtaaataagatacgtgatggcatattgctaacacaagaaaagtatgcttcagatttactaaaaagagcaggaatggaaaattgtaagtcttctactactcctctttctacagttgaaaaactctcagcctataatggttctgtgttaggagtaaatgatgcaacaaaatacaaaagtatagtgggtgcactttagtatttgaccttgagtaggcctgatatatcttatgctgtgaataaagtctgtcagtttttgcatactcctacagttcaacattggtggatggcagtaaaaaggattctgagatacattaagtcctctatagatcttgggttgaggattactaaatcctcttctacacttgtaagtgccttttcagatgcagattgggctggctcaatggatgacagaaggtcaactggaggattctgtcacatcctgatttttgttttaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattattaattttaatcatacaaagagcatttcagtaattattcacatattaaattaattattaaatggtctaattataattttgttaagtacttttagtgtccaagtattttcaggatttttcttgaaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttttcctctctttcccgaagtcttctttgcgtccctcctttaatcagtccttggtagtagaagcccagccgaaagtctagtttgcttccctgctacagtggcatcttcaatctccagccggctggagacagagcccgagccagccgcacagtacctgtatagccgcggttttcccctccaaatccaaccttttctcttgtgttttcctaaaattagttgaggggaaatattcctcttatcctcctctatcctctcccccaagaatcggagcaaaccgttgagtatcttatccgaatcgaactcgttttcgagtttatctccaaaaccgagtttttatttcccggatcgatttcttgcgggaggagtccgatctcttcaatccaaggctataaataggaccccctagtcctcctctttcgtttgccccctctcccgtggtctcccgtgtcccgtagccttgccgccaccaccgcctagctcaccggtcgccgccggccatctccggcgaggtagcgccgccgtctccatcgtcgtcgccggtcgccgtcaccaccgttgggtgcgctgtggtgagaggaagctcggccacccttccttttccgtcgccggtcaccggagctccgccgccccgtgcaagccgagtcgccgccgccgccccttcgtcgccggccgtcgtcggtggtcgtccggtgtgttggtaagtaccgtcgcgttcgtctcgtcgttctctacgtgtagatgccctccaaaatcccggccgaccaccctagctccggcgaggttgccatccgagccggccaccattgatgacgtcatcatgacatcatcatcttctccttttccagtttttctaatagattgaatcttctgaaattcatagtaactcagtttaatatggttcaagttgcaaaagttgtataaaataaagatctacatattaaaattgtccataaattgaattaaatttatttaattttttttaaatgggctttaattagatttaatcttgtaaaattcataataaattcatttgaagtcagaatgaggccgttcaagtctcataattcatctaaaattatgatctacgtgtttgtttactttttatgtactgtttatttggtttttattagtctttttcctcgttttgtgtgttagcttgtcgtttccgtcgttgcgaaggttcgcgagtgcgccggaagtattcaggaagattaattgaagaccgattattgcaaggcaagtcacacagatcctaaacacaatcctttgagcatgttgattctatatttaaattctctatttatttcaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagcaatgcttagaaacattagctcactaatgtgatgaatcatatatactacattattatttatggttatatttaatggtagctcacgatggttaatcgtgttatgataattaattgataattaaaacttgattaaaggtgggttgtgagcaaatggttttgaaagtcgtgctcatggcaattaaggaccggttcgcgagctactgttgtgagacatttaccgtaccaaccacaagccagcatgggcaacggctttaccttttgtatagcatgattcattgcggggcaccagactgtgaagcggcgagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttaagcaatgtttttcgtgattagtcccacacctctcacaataattatggatgttataactggtaataatttgcttagctcctggtttggagttagatctgtacagccggggttggttgttcaggtttggttgggcctgagcagcatgggtgtgctgttcagtgttgattaaaattgatgattaattactctactgttttatttatcttaaatctttgctaaatgctgcttttgcaaatgagcctatattatgccatcctttggtatccttgtgcacttgcatacttgctgtgtggcttgttgagtatgtcatatgctcattcttgcaataatcatcaaacctcctttgaagataaaggatccagaaggagaagacgtttggcttataccccagttgagctgcctgtgggagtggagctgaagccatcgctagaccgttaattccgctgctgttttctttcctttgtaagtatgtaacgttattattaagatggatttgtatattaaattgtcagtttgtgtacctcggctgattcctggacgaggattttatgcacaaattagttcggaaattactagtgaatttccgggcgtgacagattcactgtgtttttaggatcaaatctaatatcctggagtgctagaaagcaagccacagtatccaggtctagtacataagcagagtataaagcagttgctaatgctacagctgaggtaatgtggatacagactttgttaaaagaaattgggattcattcgcctcagtctgcctgtttgtggtgtgataatctaggtgctactttgtcagtaaatcctgtttttcatgctcgtactaaacatatagaggtggactatcattttgtcagagaaagagttgctagaaaacagttagaaattaagttcatttcatctggtgatcaagtagctgatgggtttactaagcctcttcttatacaacagtttcagaagtttagatacaatcttaacttagataaattatgattgagggggagtgttagaaaggttgttcctgttacatgcgtttgcgggtggacaaaaagctcaaaactcgtggctcggatcggcttgtagcaagctcggcttggatcgactcgaactcgtagtcttaatgagtcgagtcgagctagccttttagctcgtgagcttaacgagctaactcgtgagctgctcgtttagctcgttactataaaatatcaccaaatctttatgaacttagtgtttattgactagtgcttagtcttttatttacatcaaaactattcatatttagtaagtactatattagttagtgtttattattatgttaatacataataaaatgttaaatttgaaattattaatatgatactaataagatatagctcgttaacgagcctaacgagccagctcgcgagccgagccgagctagccttttagctcgttaacattaacgagccgagcagagctggctcattaagataacgagctcaaacgagccgagccttaacgagccgagctggctcgttatcctgcgttgttacatgtgataatgcatgagataataggatatggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacaggcggagccggcgacgatcatggcgatgaagatcttggcatccgcagaggcggaggcgaggatgaagcgtcgaaggcccccgtaggtctccgatgcacgcttgcagatcggttttttttggcatgtctcatgcctgtagatcgatctgtttgcggacgtgcatgcatgcatgcatgccatcgtggtgggcgcgaggccggccggtcgcccggcccctgcatacgggccggcccgtgcgcatggcttacgcgatcagcggcatggccgaagcccgccgttctgcggcgaatcgcttgatctcgatcccccatccatacatgcccgcgtgcggcaacatcggcggcggcagcggttgcctgcgatcggcaaggcgacgcgacgacgatgttgatcatcagacctcatcgaccggcacaaacatgcaagccaaacaaccaacagattagattcataatttgtaatccaaaatcaatctagctaattaattagcaaggacaaaaagtgattctctgtagatgtgatgcatgtgttgacgatatgattcaatcagtggcgtagccaggggtagtcccggtgggctcgggactacccccgaatttggcccacgaaccctcacccccaatattttagcctagactcaagcctaaagaagcaagcccaataagaaactagaagcacaggggcatgactcatcacttcatcagtgtgcagccgtcaccatcgtcgctccgcgattcataggaatttttttcgtataaaaggattgataggattcaatccttttgtctcaaaagctttcataggatttctacttttttctccaaatcatagggtctaagtaaaagagacttaattagtaaaagccaagtgtttttatgaggctttgatgagggttcgcaaagtctccctcgtcacttagctccagtcctgctcagtgcgaggacagtgcggtgaaatactctggctagcgtaaaaatgggaaggatgcgtgttttacatgcatatgtaaaatatatttcaaacaattttggtaagtctaaaaatatatgtagtattattgttcctatatggtctttaacattatattttgattgttgatttctttcataatattataaaggacaaagaaatccacatcatgagaaaatattttaggatcaaaatataataatactacatgcataagactaagcacggatatttttagttcatttattggtcaagttttcaagtagtgctgatttttatgaacgtattatttccttcatcgtataataatttactatcgtttgtcatagatagttgacatcgtcggactttttctgaatcaaacttttataaatttgatgtcaagaaagacttgataatagggcaccctaagttcgacccatataacgcacttctcaaacaggaattaggagtggcctgctatgtatgcatgctgtagtaagatgtatttaacttctccatgtataagtgcttccttatattttatgatgatgatgccccccacctctctctctctctctctctaagaatattgagattggcaaaatagaatgtgctgtacgactacagaagtaattaagtagtactccctccgtttcgaaatgtttgacaccgttgacttttttaaacatgtttgaccgttcgtcttattaaaaaaatttaagtaattattaatttttttcctatcatttgattcattgttaaatatatttttatataggcatataattttacatatttcacaaaagtttttgaataagacgaacggtcaaacatgtgctaaaaagtcaacagagtcaaacatttcgtaacggagggagtagtatacatatatgattgccaagatacacatgcaccacgtatagctagctagctgcacaacatatatggagtatttctcataacgtacgtacacactacacgtacagtagtgaggaaccatgattgaattaagaaggtacaaattaatagtacaataggatattatatagatgatgaatgcatggtcacacaagcatttttgccgagcgggccacactaaggttgccggccggccaaattgttgttaagatagaaattaaagagtgagattacataacataggggtggtaccccatcaaattcattaatcaaagttaaggtactgcatgcgatgaagaaagatcgaaaataggaaaaagatcgagatacagctgatccaatcatgcaccaacgagacttcactgcaggggctagcatgagatgcaacttatataattaaggagctagctagcaatataagcagtatagcagtaatagatgatgcatatatggatcgatggaggggagctagtagagaccaggcttgtagttgagagcgttgggcagccactgggtgccgtggatgaagcggtcgacggtgtactcctcagctttgctagcgtcgaccacggagaagccctcccagttgacgcggcggctggtgtccgatccgggtcccgtattgttgaacttcatgtacgacacggtcttggtcgtctccaagacgtgcttgctcttgtcccactccacccagcccttcgggtgcacgatgccgtcgaggaacgactgcatgaagatgacgtgcgagtggttcttccacgggcggccgaggaatgtctcgacgcccgtcaggttctcgttgggcttggccatgatgctgcagttctggaagctgaagccggtgtcgtcgccgggcttgtcgcggccctgcgccgtgatgatgttgtgcgcaccttcccttccgcggcgcacgaggagatggcatctctggaacaccgccttggcgttgccgaagacgaagtccaccgtgcctgaaatcacgctgtcgaggtacaactgcagtccgttctcagcgtacaaggtgtcctgaaagctctccagctcgcaccggtacagtacagtgtggttggaactagagcgaagagccaacgactggttcccctccggtcccgccgtgttctgtatcgtcaggtctcgggccatgaaaccgcggcctgaggcagctgcatacagtatatatacgtacatacactgatcaaaataaaatttcatatatatatatatatatatatatatatatatatatatatatatatatatatatatatatatatatatatatatatatgtcattccttcctatacaatacaatatataaacatcagcacataacatattataatgtcatactataattcaaaataacatatttcttttagaagtattggaatatagttaatatgagtctttaactgcaaattagttataaataatccaatgtcgtaagcttataaaaattagctatttattttaaaagattatcataaactatggtttataatctaaataatatagcatgaaaacaatgaaaattgtggcaagtggatagacatattgtaagcatcatatgcatgattacataatctcggtgtacttaatttatgctccagtgcagtctagctaaacaaattatttgtagagaggttggcttcgagtacataattcctaatattaattattccaaaaaaaatgatgccttcgtacgtagttatattttaccatccaatcgtgttcttgctaggctatgtgaagctttgcacacttgcaaaaaataatcctatataggttgtctcctatatactgcgcaatagatttggactctacaagcttgtgtatttaacatagtctcgaaccatcctaatccatcaattaataaataatgagaacatactttagtcttagatgtttatacaaaaatcgattcatttttttcgaaaatggttggcatataaggtgtaacacgctgtcactattttgtcatctcacaaaatctgaacttaaagtaagatttcataaagaaaatagaaaatacaatagggagcaaagtgaactaattatagaaaaacatagaaaattcttagaaaaaagctctttgcttccacttaaactagaacacccattaccataaccattacatatttttcgagtgctccgatgcttacatgtaaatatacacgaaccaattagagggcgatgattgtataaaataacacgtctattaaacactaatagtttttaagatttgtttaaaaaataaagcccataaacaatcaattctaaaaacgaaaacacattacttttaatttacactttatttgtgaaacgagactaagccaatcttctttaaactgattaagcaaattaatggaggtaaattaaatattatataatataaagacaacaaatagtttgtaaaaaaatatttaagaaatactggtgaagaatgtttttgggcaatcatacttttccactgcagcacgaataatccagtagatatgtttttcttatagtttctaacacaacttaatatgtatgcccgcgcattccttgctagttaataaaaaatattcaagctagctaaggtacgactaattaactaattaaattaagcaaggcatatgcatgcaaattaattaaacacagttacatattctttaggtagccataagagaataatactaggactacttactaacggtagccgatgaaggcatgtcgccatgcttgagggagccacggttgccggtgatcaccgtcttgcccactccgtcgccgaacaaagtcacatcacgcctcgtgatgttgagctgctcgatgtacgtcccctccccgatacggatagtgtaggacgaccgtaccttcttcgtgctcttgggcgctgccgccaaggcagcagcgatcgtcctgtaatcgccgctgccgttcttcgccacggtcacctcgaccaccggagaacgcctgccgtgcgccgccgctgatctggcgccgccgcgcaggagacgctgcagccgcggctttgcccaaccagggagttctgcgccactagttgggaggcagcaaacaagagcagccacgacgagaagaagagccagctgcagactagtgttcttcatgcttgctcttggctcactctaactggactgaacgagttgatgtgccagcctctggttaatttccttcatatatatatctatacacacacatgcccggccggctgatagatcatgagctggagctagggcgaagctagcagtacaactccgagcctatatatagctagctagggattgaaggctcagcccaagtatttaacctaacctaattgctagatccctcctacgtactattaccctacttcccctataccttggtcggccacttgtgagttagtatatactccctccatctacttttgatagtcatatttccaaatctgaaaattttatttttgatagtcatatttcaatcaacaacccatcatcttaatgactttctcgaatttaatgcgtgactctccattctaccacacatgattggctacatgggtattgagaaatgtaaatattaatgaatcgcttgtttacgaggaataactagtagcatatttaaatgaatgataagtagaattacttatccttggtctgtgtgtcaaggtgaaatatgactatcaaaagtagatagagggagtactagtgtatcaattatcatagcgtacaatattatattataaaccagctataaacacgtatcgaaaagataaaagaagagagataagcagcgggctacaaatttatagccagctgcagtattgactccaacacacaatgtgtgtataacgagtgggaccatatattaatactgtagtatatatatatttatagataactattatatgaattgactattaaattgactatatatgatttggagctgttagttggctatactattaaacaacttgctctcagttgtgtatccgaccaaaaaatgttaaaattaagataagtggcctgtcataattgttagcctagctactgctgctgtatatcctccactatatattactctactatagctattgtatagtagtacttaattagtactagtatatataggtctcctcccaacgttcatctcgatcgatccgcatcggtcaattaatatatgtttgtgctgtagttgcatgcatgcatgcatgtacgtagggcgggtctctagctgaagtaattcttttcgccattgatccccttgatgcttggtcggtcctgcatcgatcgatcatttccatcaatatcgatcacaagcaagctaggttccattttttagtatcgatcgtctctgtcttaatagtactgaacgatcgcgagagaagaagatcgataattatggggagcaccagtcttggatgcatattatttgtacctgtattatttcgccggtgcaatgttaatttcccgctccatattatcactaccacaaaaatactcattggtgccagttataaaggcctcataggtgccggttttgggcccggctccaattggtcggtgctagatctggaaccggcacctatagctttcaacaaataaaaaaaaagaaaaataatcccggcaacccatcgccggccgtcggccacctcgcctggcgtacgcaccagccatctccaccttcgccgccatcaccagatctggaggaaaagggggtagggcggacgaagaggatgagggagggcccccagggagagagagacctgcatcgatccatcatttccatccatatcgatcacaagcaattaaggtcagattgtccatttttgagtatcgatcgtctctgtgtcttaacagtgatcgatcgagagaagaagatcgataagggagcagcagtcttggatggatattatttgtacctgtatatatatatgctgctagtacgtatacaagctagcaatagagtctgtaatgcaacacagttaatgcttgtgctatatatcagattaattaatggccatactattgtcatatatatctgcaaattaaggagcttctttttaatttcactctcaagttctcaatttgttcagtagtacgtggtctgcctatgaatatatgttcagaccggagaccatgatcacatggtgggcgctggctctgtatctaacaatatatgcaagcatgcatgcatgttctatgttccatcgtatcctcataaaccaactcgatagatctaccagagatgactcaaactcaatgctggagatcgagaccatgatagggagtgtttaatttgtatattcggtttattagtcaaacactaatttaacccaaataaaatattagtctgttggtaattttgctgattatcttataatagtttcagtgaatatttaaaaagatgaagcatatggttgaccaacgttaatcacacttgaatttatcgtttagtcactggtaaaaatatttaaaagatgaagcatggctgcatcctgtcggtcactacttcaaaaattatttttgttgacggccaaaataaaaatttatatataacgtatatagaaatcgcagtgtagttacactgtagttacaatacaactatagtgtaattacattatacttgcgctacaactatactatagcacatccacacaagtaatatacatcacaaattgacacaactttgagtaataaactacaaatccacataagcaaccgtgagtataacctaatctgaaatttggcaatgaaaatttgcagaacctacaagagttggaaatggc

SEQ ID NO: 60981 - DNA, 581 bp, Oryza sativa
tactctagttatggtgattgttttgatctgctagttgttttggctgttgattctagatctctctttatgcttggggttgatgccgtttgtgtctggtactctggtcctctgttactaggaatgggggcaagtggatgttttgcttcagtttgctgtcatatatctcatcttcaccatcagatactatctgggctgtaattcatgagtatgttgcagacaattgatgattctatttcttgctgatcagggaccatggtgacatgtcttcaaagaagtacaggcacgataagcgtgtatatcttggagcactcaaatttgtgcctcatgctgtttacaagctactggaaaatatgccaatgccctgggaacaggtattgtaccctcacactcttcgatgtgaacattgatgtagccatttgtgagattacgtatacagtggcaatacacaatagaataacggaacttttcttttcaggtccggcatgtaaagattctgtaccatatcactggtgcaataacctttgtaaatgagatcccatgggtagttgagcccatttaccttgcacaggtaatgatctaaa

SEQ ID NO: 60982 - DNA, 1540 bp, Oryza sativa
attttgtaaccttgttctaatgtaaaattatggtcaaaactgaacggttaagaaggcgaagaaaatgtcaaatgtcttctttttttcccaaagggagtacatatgctgataagtacaatatttttaaaagtgagctcttatcagagttacaattgctgccgctctgctcaacggcccagatgtttcgctcggttcagttacaagatccgacggataagaagcttcagtgagatgtaacgtaaatcgagttatccttagtttagctatttgttacactgtttagtttatttaagacgcactgagcaagctggtgcagttaggaaggatagctaataaatgtgcatccagcagtagtattgatttgtttaaatgtgaatgacggttaataaaaacagtaacttaacgtgcatgacagatgataaatcatggtaaataaatatgtgagtctagcattgctcacatatatgtatagattcattaatatctatataaatgtggataatactaaaaagttttataaactgatcacatatatgtatagattcattaatatctatataaatatggataatactaaaaagttttataaactgatacggaggaagtatattttttaataatataaagaggtcccttgcaaaaaaaagttctatcacagggaccaacatccctctttgggccacatttgggcctaagcagcgcaaaaaccgcggcccaccagagggaagcggggccctctcctctactctcccgcggccaccttctccgagaaatccgcttcggcgcttctccccggctgcttttttgctccgcctcggcgcctcccatccaccaccgccaccgccatcgcctccgcctccgcctccgccgccgccaccgcctccgcaactcggcgctcgccccgctcaaccggcaggaggaccaaggtgagtcccctagcttgctggttgattttgcttggattgtggcgttgtgcggtggtctctgttcgacggcgcgcgcgcacggatttctctcctcatgccggagctcttcgcacgccgcgctgcctgcctccgcgatttgttggtgaaacctcacggtctcccgtctgtgcttggcccgtttgcgtacgtgtgccacggcgtgcgcgctagtctcgccgggcgccgcgcctcgtcttcgtgtcgcgccggcctgttgaaactaggcagtttcatttttcatggcatttgtttttagcatagtctagggcgcattgagaaagatgcttgttatcgggggttgtggattggtatggggacggtgggggcattccgtcgagcacttgttaggcaccaggattgttaggctttgtgtaggctaactgttacgttcccccactccatatgaatcaatgattcaaactcaaaacacaccacactgtttctgacacttgatacaaacaggattatttgggtatgcaagtagggaaatagaatcaaagacatgaaatcagcactaggttggagaagaggggaatagctgatattgaagaacaggggagagccgagtggacgaa

SEQ ID NO: 60983 - DNA, 13061 bp, Oryza sativa
atggctcttcaaagaagtgatgtctccatagtgtcttggctgtgctctcaggtattatagcctcgactatggttattgagctattcccattttcatcctttgcgaacaaaccaagtaatgtctattgtctgctgacttgcaactcatacttagcgcgtgctggtgtggatttgatgcacttttgcttcaccatccgagctttcattaccataatttgcacctgctatggatgtttgatattcttaaatcctctgtcaggtcgatctgcacgagttatgcagaatgaaccccattcctctcaaccaaggggtcctgttggcccttttccagcaactagcatgtgacatcgtcaatgacacgcccagaaagcttgagtggatgacggctgttgctgttgcaatcagtccaacagatcctatgatcgctgtgcatgtgaggccgatattcgagcaggtctatggcgttttgaaccaccaacggtcactgccagcaagcagttcctcggaagcgaccaacatccgtttgatcatgcacgtaatcaactcggtgctgctgacctacaagtgataaccatcttcagtagcgtgctctctcagtagctgctgtaagtttgggcaacattcttgcaatccctgtacagataaaattttgaaaagcgaagtaaaccgataaaagttgtggtgatggtggtgatacattgtggctgacaagccaaggaccactagtcattagcatggtgggcatctggtgtaaattggtccgttgtgttccagcccgttctgagctgacatttttcatgtgggtctgtcatcttgaacatgttattcagcgcatgcagaatatagctctgtactgttaacctctgttgagttgctagtttaaaccgtgattttagttcctagtttaaaccgtgcatgagatgtttgttgctgacttgctgtggcccatgagtgatgacctgaattgaaagtgatagactgaaatactccgttccgtaatatgggattttgactttttgcttgcactgttttgatcactcgtcttattcaaaaaattttgaaattattatttatttttttgacttacttattatccaaagtatatttgcacaaaatttttttttgaataagacgagtggccaaacagtgcaaacaaaaactcaaaatttcttatattatgggacggagggagtagcgtattacaagagcaaaatcaccagagaccgacaactgggcattttcgtatcacctcttacaaccggcattcccaataaaagaggttctaatacttactgcaaatatgttctcatggaacagacccaatatagaagttatatactaatcctaatagtgctctcatagcactaagctccgcctgtccatccatcctaatatcacatttcaccattttccggctagccttctcctgtaaaataaaaggattgaaaactagtgccacacaaaggaattaaacctgagtttaaacgggcgccctgaaaaggatgaaaggcaacaaatcacgcaccacaggcaagccaagcacaacacctccagccatgccacgacggcctagccttctgtgccatgtacagatacaagaaaattattcatattaataaataatattattacaactaaggcagctcaaagcttgtctgaaacgttgttgttcagtgcatatccatgcatatacagaaatgacacaaaagaattcaaatacaaaaccccagtaaactagtgatcttgtgcaaagttcaattgaagaggcgcggccggtcagcctctcaacgcaagagtgccatctcgcccccctttaatggaacaagactctctgtgtagggaatcatgttgacaaggtagaaatcctccccgacaaaatccaagccgcctgatctgggattcctgtacttgagccgatccacatgggccacttcctctacagacctctacagaccggctcactgttgggatacgtgtaggctacgatagcataaatcaaaattttctatcgcgtaaaccaggaatcatgcaagtattagatcatagatcgttaccactcgacgcgctgtgcagcggaagaagacgctgagaagtcgaaggaactctcgcgaagtagcgcgcgtcgatgtagaggaagtagtcgatcgcaccggctcgaccttctcctcctcgtgtgttctcctcgccgtactcccacgccgatcagcaccgcaaaccagcggcgcctctaccggtatccacacgtacagggacggaacgccacgcgcagatgtgctagcacctgcgcgcggctagggttttgctcggggagggaagtgacggctagggtttctcatgtgatgcaatgcctccgccggtcacaccactcacgaatatataggatccatcactcgggtctccaaggcccgtaggactcctattcagatccctatccgaattaagcttatattggatctctatccaatccccttattccggcccattaagcgtgcgaccctgtaggttcatatatactcggctgtaacccgaaaactccttttcggtccacgcgtcaacagcggcccctagcagaacgtattgactcactgggcatacataaagatcatatcggctgaacctctagtgtatactagtatgaacccctttgcctcacgatatcgattaagctcaaggctagatatgtgccatcctctaatagcccaatcattcactcgaacctgttgatagaatatttaacttgtgattgactcctcaatcacctttggcatggtcatgcacttccataatctacaacatcaaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataatctcaggtctaaggattcaacaccaacactcaatgagatcactgatgacacaacacatatggctcttgcagtgtctcatgttgggtctatccaacaacatgttcaccaacatgtgtccacattattaatttggtatctctataccacgatccatgagacatgatcatcaattaatacatgtgctgatcatataaacatatttgttccacatatgatatttgatcagggatcctttagaaatagtaacaaacaacattaagagtctcatgaaagaatcacatattcattaaccaataaggagttatctatttcaaggaacattgtcggataaatatgtaaacatagtatgtgatacaatcatctctatgattgcctctagggcatatcactaacacttaccttgtcgtagcggtaaatatgaaaaccaagtccaaggagcaggaaatgatcagcgaagtcgaagaacagtttgaaattccaccccctcatcaggtagattaccgatcgtgtaaagacgatcccattggtggctgatgtcatcagacggagaaggtgatgatttccatatcaccatctctgtcccgaggtactgagccaggcacagttctcctcctagctcgaccaggtcgagccgtgtttcgtcagatggtgaaacaacatcgtggagtacaagaccgaatgtctcatcttgtaaatcgaagcggaggaaaccctgtggaggaggagggcttccctcctggaggagttccttgcaaatgtgccaatacaaggaacccttgaaatacatagggtctgccgtaaccgggtatggtggatcctccgctatggtcctccaacacgaatcacggttgccgatagtgaacacctccatcccggcagcatcgtgagcccactgattgaaatcgatggatcggtcgaaggaccgaacaatcttgtaagtgttggtgccaagatcaaggcctaggcctgcagtctggaacctgctcttttggccatcaggcagcttgaggacatcacctgtagtaaggggttgcaatttcagaacgaaaatctcaatttcaccctcccaccgacaagcacatatctcacccaaaattttcaaaaatgttttcgaacctccgtgaatttggttaaaatttattcaaatccattcaaaatttatcaaactttcaaaagtaccggaattccaaaaaatttcagttgccaccgaaatttgctggaaaacgaaagtgtaaacccttgcctgtagctgggttgaagacgtacaacctggtattggtggggaatataacaagcccatcatagtgcgacatgccgtaaaccgacctgaattccccatgtaggttggtcgcacgcacaaggtgcgcatcgtcctgctcggtctcctgccaacggtagaaggtgattatgttggagaatgtggttggccagggctcttcgtcgtcgatcatgctgtcaagggtgtgcggggtgatgaggaaggacggcttctgctcgtgtctggagacggcagactgctgctgctgcttgagatgcgtggtgatgaaggacgggttggagatggtggcgcgccacgccctgcacacggatttcgaccgggaaagggttttgacggggaggcggagcaggatctcgtagacgagctcgttagggagggatgatgcgccggggtggcagtggtgctgcaccctcctcctcttcctcctcttgtacgtcttgatcaacgtcgtcgtcggctcttgtgggttgcgatctatagctttcttattattcttcgtggcaattacgtccatggtacctaaattaaacacaccaaaaaaagaagactggactcgtgaatgaataatatgggtggaaaactatgagcagaggatgcgcgatgtacttatatttatgaaaagatagagtgacagcaaacatgaaaacgagtcggaatcgccaatctcggatgaatttcgagaccacgcggccgacctgtccgcatccatctcataatcgaatttgccatggaaaatggaaatccaaaatcgactgctgagtagatagataggttcttcttttttttttaagaactcataaatttatttatataatgaggattacagacggagttcaaagaaaatggcatcccagtacatggcaataaaagataagacatagagaacaacatcacccatttagaaggtaaagccagctgaactaagaaaaacatcctccaagatagtccaaacaacaataatgaacgtgatcgataggggactatggcattgccgtgatgaccacgtccacgagcccctactgaagacgcggacaccgattgacagactggtgaccccttcggctgcctccacggaaaccgcgctattggaggtttgttgatgagtcataaatttatcttaagcttcatcggaccgaacaaaatattgtcaaggagttctccatcaaatctgaagagcacatactgcaatcctatcaataagaatcgactagacagtctatactcaacccgaatggagtcctcaacttgaatactactgcaaggagaattgaagaaagtctccgtaccccaacttgccttaaacatgcaagaattaggatggcggcatttggcggaggtacgcgacaccagaggtcgaagggataatgttctcgcagagagcttcaacaagcaggagcctgagcaaccaaccaacaagcttgccaccaagagatagattggtggccttcccgcgtctccgcaaaccaagttgcaacgacatcaccgagaacccaccggcaaaagctcaacctttcctctacgtgcaccattcctcgtccacgcgtaatatggtaatgaccgatctccacgtgagtctgtgtacaattgtgcgagcgagatcgtgagctggatacgcgagcatgctgggactatgagtatataccttttagcatgtttaaatgtgactcttatgttgatgcgaaaacacgaggcctggaagatctgcttaacttcagtgcaggtccaaaaatcttgcttttaggttcgtgagtgtgacagttgatttgatcctgcaatcaacaagaaataaagacaaagaaaccgcagttaaatccataaatgaagccgatcggccaaccgctgatgacgtatcatttatctttgagccgatgtcatatgtgaatcgatcggcaatcatgaataagtaagaaagaactaaatctactcgatcggctgtagatattaacaatatataatctttatgtcgatatatacttaaatcaagtgattgggatagatcggtcaccatgtcgagacagtataaatcacttagatcgaaatatatattatcaatgagattatagatgttcataacatggccgatcagatagatctagcatgtatcggctaatactctaataccactctatattaagatattaaagcaagtaaaatatatcaaacagaagcctaatatacctaaatgcaacaagatcttaacataaagggcggatttaacatatcaatgaaacatataagctataaagtagttaaatcaggtaagatcgactgaaaccccgatactaccctaatcggcaaccagaatgcaggctagagattgaaattctaatcatgacttataaggtcaaactcaactgatgcagctataagtacaaaaggaagggcaatatctagacaatcaagccgctggttgtttcatagagtggtggatatcctgtataatctagtcaacatagatatttaacctaatcagctgccttccaataatagatgttagccgattgaaggttagataatgatattgtcgaagattatacagaatatatgataactcgacgaattacataaaaaagattagagtatcataaagatggaagcactaatcccgagccataacaagttttacctctagttaaagatcgaaaccgatgcagctcaacccgaaagcaagaactcatcgaaacaaaacgaaagtaaagggtggcgatgcgccgagattgtattgaacgtgtgttagattcattacatggggctcggggtctatttatacccgagattacaaaatatgtccatatcggacacgactcttatctctaacaaactctaaaataccataagtctttgcggcagacttttgcccaaacatatctctaaggaaattacatgaaatatcctaattaatagatacaattgcctatccgagagctttgtctccatcgcggcaatcctcataaaacacctcgatcgattctagaaacatcttcgagaccatctttatctggatcggctgcatcatctctatcggctatatcggctaccctctgtccgatccatttcagccgatgcagactccagccgatgccttcacagccgatgcattctctgtttttcgaattgatctctatatcgaatccgcctcgatcccaatgtcaaacctggttcataatttaccaaatttggtcgtcaacatcttagcatttgacaattcattttacccgtagcaaagcagaggcatttgctagtttaataaaaagttgacttcaacaattttcctaattaccttcctagaaattagaaaccccttccccgtccttctcgctctccactagtagggagccggctccgataacacatgcgggatgcagagagaacggtatatggagagggatcatgcatgaaggaggtggacagtgatttatgttctactagcaaagtgcatgtgcgctgcaatgggaaaaaattataataaacgtgagattattgagtttaaattcgtgaccggagataacattttgtactttttcaatgaaaccttatatttcttttcatatagcgtgctagagtgtaccatggtggaagaaacttttacagggaaaatgacataaaataactttgtttaaaaaaccaaccagatcatttagggcccatttgtaagtggttgtttattagattgtcaatgcaaattgtttacttaattaacatgatgaatttcctatgcattgcaatgggtgaatgtgattagggctgggcattggtcttttccgttaattttgggtggcagcggccatccgcagctgagcgtggtcatgctggcaagtgagagtgggagagtggggctgatatgcttcttaaggtcatgaacatggatgcagagagcaatgacatctaaggtagctagagtagggatgacatctaatcaacatggatgtggagagcactgcgatgatgttgagcaggtcagcagtcattctcctccatagccgcacgcacacacgagtgcctcgcctcctccagcatcgttgttgcctgctacccaacagggtgcgaacaacgccggtgagctctccctccccccaatcggccttctacccctccctcacctagtttcctcctcctccttctcaagccaacagttgcaaggtgactctatccagctagatccccgtctctagggggcttagagcaagtttaatagtactgctaacggttggctccaaaactatctatgtcaagaatagagtaaacttgtaaaatacagtagataatagtttagctgttgttcagctacacacggatatccatgtaactatctgtattttaatctatctttcccacttctctctctctggtcatccctatccactcattccttcccattcaatgttttctctctctctctctcttagcatttcacagcaaagacaccaggaatagttgagcagcagtcgtcttggagcgcatgtggagcatgagataaattagtcaccaacttatctcctctttctctctctctctccattatccccctccaactcacttgtaatcttacgtggaacagatatcgccggtgtttggactgttattgtatctgctcttatcaccctctctcttcttatttctctcttccacatggacacctaatcctacatggcatctttatagccgacacgtacttgcttggcatgcacaatgcataatgcctaagctagttctaaggtgggtctcggtgttgtatattgccacccccacaatgtatgtgtaaaaggtgagtattaaggtggacaccacatttcaagagaaagagtagaggagagagatgaaagatatactccgtccgttccataatataagggattttgagtttttgtttgcactgtttgaccactcgtcttttttaaaaaaaaaattggaattattatttattttttttgacttattttattatccaaagtaacttttcgttttttatatttacacaaattttttaaataagacgagtggtcaaacagtataagcaaaaacttaaaatcccttatattatgggacagagggagtatttgtttatttcttatgtctagaccttatagggcttaataccccctctatttccacgttgtggatagccgaagacccaaaaatataaagtttaatcctagtgtgagatgcgtaattttcacataaattcagtgttgtaggagcagaacatcgacttagaatcgtgcgtgttatagttgtttccatataaattgcatagcttgaatacaatctaaatatccttagatcaaaacacaaatcagattatattaactcaaaccaaatattgatctaatttaatcagatttggagatccattggataaaataataatagatatacacttaaaagagaaaaaaaatgtttatttgagcataaatgaatgatacgtagttcattccctttaaataacaatgaagctgccataaaatgagtgagcattctcaaacccaaaactggataaggattttacatagtgatggtaagaaaagaatattgaagcacgaattcagaagagcgacttaaaccatattcacatttattaaattcagtattgaatgtctggacagtataaatccaactatagcgtacaaacaaaaatgccagaaaaaagagggagcatactgatggttcagattgaagaatcatgttgctttttcccagatgtgctaatctgaaattagtcgtagttacaacactgcatctctactcaaatgaccacattaagcaaataaatatctgatgttgataggaggcctctaacatggacatacaaatgaacgagcctaccaaaatcgaaataaagcatggcatgggagtttctcctcgggtatttgccaagtcaccatctatatatcctttgtttgttcagccctcaccttccccttatttacaacttcagtcgctttttgtgtgctcaccgttttcattgttagtcgctgatgaagtagccccatgctgaaacatttgcagctggatttgcaacatctggaaaaaggaaatgatgttatgaatcctgttgggtataaacaactaacataaaagaatattactgttcaatgttattccgaataagtatgccattggaaaataaggtgaagcatatttttttttgctattttggcgcatggtaacgaatgccaaactgaaatgatctagttctctattctcgttatcgttaattagtctaatgaaccatgtttactgtctaaagttagttgatgaccataatcaagcatttaaaatgcagcaatgtttacacttgtatgctgcataccattctgcagtgcacctcaagatatgtccataacaaagggataggtacgtcaaataactgatattacaaaataaaactgcttgctggcatacctatagacttatattacttcatagccgtcacatgaatatggtcaaacaaattaggtgcattcatttcaaatcattttacataacacccacttgaaattaggtgcatttgaaattcaaaatcaacccgtatcaagataaacataaggagcacaatccttaacaaaaacaacagataaaataaataggaaaaggagaaagggctatgtagagcataattctctttctcacttagctagctcattttatatttttcattcgagttcagtggtctcattttatatttggaggtgagagctcttactaacaactttcagcctatgtgcgtgcaaattcagaatgttataaagttatgcatccatatgacacccagtttcccatgaatctaagtcatcaatgtctaacccaatggctcataccaagcatgtaacttgagtgcagttaaagatgtgtttacaacagacatatccagaaatttgcatgcagcctgcataagcctctggtttgtattaacaaatgtgacacttggtagtgccaatacaaaacatatatcatgatttaagttagctttaggaatcaaattgcatccttacctctatctggctctttatagcattttcatatgccttctgcagtgaactttcaagttccctggtagttgtcactgaactaacagcaccacgtgcataaaaagtaggcgctgaaggatcggcagttgcatggccttttggcgattgattggaagtacttgcttctcctgattgtggaccatttgatgtagactgtggaggagttgaatacctatgttgaatacatgatacttatcagtgtcaggacacacagagcaaatgacaaatgattacatcttgctcagcttataaaaaaaaagtattagaaacacatttcattaacccaaccttggttacagaaatacctttttttgtgggaattggttacagagacagttaagaacaaccaaatatgattaactatgtagtactccctccattccataatataaggcacaaccacttttcttagatgttccataatataaagcatgcatgcaagcatacaattaattatgacatcttctctattaaattattactttttaaaatcctccactctcatgttatctaatcctattggatgcatgcattatatttattaggatgattcaaactataagatgataataattatttcttggtctttgggttaagggtggttgtgccttatattttggaatggagggagtataagcaaatgctatgcaaataaaaatcacaggaaaactgtgaataaatcgtgcaaattaactcttctaagagtaaatttcacaaaaccagactatcttcaggtaaatcatcacaaaaatcatgcttttacacaccaattttaggtaaccatatttccttcacataacatttcactactctttaaggcccaggctcactcattgttctcacaagcttatcttatttccatttctaatgcaaatgtatttatcacgaaaggtaagatatatggattacagataagcatgggttgagtgaagttccttttttaatacgacgtcatgtggaaaataggtactagacatccttaatccacaataaaatacattggggcatcgacaactacattcatgcaagcaaacaacaaagagatagtgagaccaatgagtatgctcagcctattggagatgacagcaacactcaaaggcataatgttaaatgtcatgagagagagagagtatgcctagcattggaagaataggcaaaaaaagaacaagctctacaatcattatacatcatattaatgaaccatcagtacagcacaattaaatttataatcatccaacaaagttcatagatatgtacttagtcacagaaaaaaaggcagtttgcaaaaaaaaaaaaagaatgtctaaactttgtagaagtcacaagttccattatccacaaaagaattttcagatttggcatttgttatcatagttattaccaagtctgaaatggaattacaaaaaagtttgcagtagtctctcccagcaaaaagtagaatcagtacctgttcaaattgttcgctggaggataagcaaaggatctcccatatagggaagcagccgaagcagctgcttcaagttttgcttggcgcctgcttatgttctcacctgctgctcgttctgaacctggtgtgccattacctggaactattttttattatgttgaattagaacaaagtataaacgttgtgcaaaatgatacaaaaaggtttagacagtcaccaggctgaactccaggatgaactccatgcggacgtgctgcagtacgcccattatctgggggcagaattggagctctacatgtagggcaagtgtgttggcgttctaaccatgacctcaaacaatg

SEQ ID NO: 60984 - DNA, 753 bp, Oryza sativa
caggaagaggcagtcgacgacgagcaggaacagcatgaaggagacgatcctggcgtgcgacagcatgggcacggagggcgtggtctcgatgtactcgaccctcttctgcgcgagccagtgcagcgccttgacgagcagcagcgcggcgaccatggcgaggaaggagacggagaagtcctgcctgaagatggtgaccgcgaagaggatctccaccacctcccgccacgcctgctcgttgagccgctccacctcggcctcccggagcgtccccaggaagagccgcttgacgagctgccaggcgacgcacatggcgacgaggcccgtgttgaggagcagcacgaagcagatcttggaggtggagaggtacaccatcgccgggtagaactgctccctgctgctgaacgcgtagtacaccgccgtcgccgtcgccatcaggctgaacgccgcgtacgtctgcagccgaatcatctccgccgccgccgccggcgatcccgccacaggctgcaccaccacccaccacccaccggatcacaaaattagcacaacaaacaaccagctcatcacgaatcaaaactaaaaaagaaaaagggacgggaatcgcgacgatatcgcgaaccccccacaaaccctagaccagatccaagctgctcttaccgatgcgattgcgagcacgatggtgatggcgggtggattctccggctctaggaggaggaggaaagattgggcggagacattgtcgcggggatttttttt

SEQ ID NO: 60985 - DNA, 12019 bp, Oryza sativa
gggagcgagcggcacgtggggaagcggaagtgggtggacggcttgtgggcccgaagggacggcgcactagcgtgggttacgttacgggctgcttggcccggtgggaagggggtggttgtttggtttgaccattttgattattattataattgtatttatttatataataaaaataaatgaatatgtgaaaaaaaagatatacttctcacgtcaaaactgtagagggaaaatatttggttgatcatttagtattccctctttgttataaatatttgacacctagaataagatttggtcaaaatttttagattcacatcatcaattttattttatgttatactactaagtttataaaatatgtaaataaatactccatccttttcatactgtacggtgacttgtttctaagtcaaatatttttagtttgataaaatttatagaaaaatatagtaaaattttcaacacaaataaaaatgatattaaaatatattcaatgtgtcaacggggttacccatatgccgaatgaatagagtattggggtacgttggtacgaggatctacacgatacgacatcaggcaaacaagaagacaagaattatactggttctggcccctcgtaaggtaatagccctaattcagcttatatgagattgatatggaaaaaccacggattacaaatagagaaccaacaatctcgagattaccggcgagacccttgttgagatgtttcgacgagatctcctggtgagtacacttcacgtcctccagattgtaggctacagtggtggtggtgttggccttatgattcgatgatctggacccctcagggggtgtgccttttataccctgaatcaccttagtctttaagtagaacttgaatgctatagaccctgcacgatatagtataaacccaatcctctccgagtatgattctgctattcacttgcccgtgaggataatttccataatctcgtgttaatttctttatcgtatacggaaatatattgtacacacgaaggtacgccatatctgtatattccataagtcgtaggataggaggtatgtcttatccataacatgacacaatgttagatttaataaaacgaaattggtgttgtagatattgataattttttttataaacttagttaaagtaaagaagtttgaatagggaaaaagttaaagcgtcttataatatgaaacagattgagtacatgatattattatagtgattttcaacacaaatcaatgtatacctctttttagattacacattcaaaaaaatattgatggtcataagttcaaaagtttaaccgaatgatggccaaacgtcaaatatttatgactgggtgaagtatattaactaactatatacaaaattttagtatgttatcttgaaaaaggaatattgaaaggctttttataagtcaaagttctattagtttgatgaagtctatagaaacacatagcaatatttttaacgcaaattaagcatactatcataatatattcaatgttagatttaatgaaacgaatttcatattgtagatgttgctaaaattttcttcatagaagtttaacttaggaaaaaaaatcaaaacatcttataatattaaacagagagggagtagattaaactagcctgaagctaactgctggtcaactttgcatagaaagaattattaaaattttgaaaaataaattttatgaatccagttaaaatgagttgtgcaaatgttgcagcattaattgttatttttgaaagtgcattaatccccctagtgggttatggtgattaatgacaaatgtggttaagggactaatgagtttattaagctactttcaggtgcattagtccaaggtgtggaagatggatgcttggagaccccccaaaagtataaaatcaaagcggaccggaactcgaggagtgcataggataatttatttattgcaatcgagttttaggaaaaaccgtactattaagaggggttccaggtggtgctctgagatatggtgctcttagtgtgaaccaagtgacaattttccctagaagtcatttttgcaaatactccatctgtcaaaaaatgcaagtctggaacttcctgtcttccaggtccggaagttccggtctggtgaaagagattttcctatgtattgttccgaagtttctgtcttccaggtccagaacttccaatctaatttccagttcaaaattgttagtaacggctagatgacgtcacctagctgttatatctaaccagcttgtttccagctctttctttggccattccactttcccttttcgaccccagagctgttgctagcctctcccaaatatttcttgccttctccactcaatcttgagcctaattctagtgagaaagagagattgagggggagagaagaagatttggagatgtgtgaaaactaggatcttgggtgagcacttggtatatcttgtgggctgacatctcggtgcctattactcttggagataatctcctagacggttaggtgtcacccgcgagaatccgttgcatattgtggatgtctcgggtaagtttgtgaaggatctcctctcctccgaaagggaacgaggtaagttaatgaagttcttgtgctgagattctagaggttttccaagtagagcaacccacacttgtggtgaatttctagaagtaggttaagttggatcttggtgatcactcaattctagaaatttgcctaggggtgtttggggttgaaggctgaggatttcctctagggtttttgtacaagtgaggcaaggggttaattgagacccagctctttggagctcctcaacggagagtaggatcgcttgatccgaacttcgggaaaaaatcgctcttatctctttctgtgatgtttctgtgattgtctctgtgattgtgtttctgcttagaatacctgtgaatcatcttgggagaactggctaagtttactgttctgaatcttgaattacatccaagtctctgttatacccggaagttcctgtccaaagaacaccggtagtttcggacctggaaaacgggaagttccggtgttccatatcaggaagttcggggtctgtttgaattttaccgctgcgatttatttttaagttttcaaggacaacctattcacccccctcctctaagcttcatcagcacattcaattttgtcatatggccaaaggcttgacgtatcacggtcctttctcagcacaacaatgttgtctagctgtccaaactacagtgatatagcttaattgtaaaagcatctgcaatgtaggggtgctaaaggagagagaaacaaaagactgttgggccttttgcatgggtactaatccaaaggagagagaagaaattgtctcaagccaagaaccaggtaagggcaagttttataaaagaggtagatgctacatctaattttaaccagatcatcaactaataaatataaaggtaacatgtataatatattacatctttgataattctaatacactaagtcccaatgtttatttgcccaatcactcttcctctctctccttttgtcttgaattttgtgtagggttgcctcttgcatgtcttctctccttcacctcactatttaagctcatgtggcatctaggagattatgcttggatgcttatagtatttgccctaacaagggtatctttgggacccataagagacaacaaacaatagaaaacaatgttgagagagaagatgctctagttttcttagtatattccaagatgatgcaaactacacggatttttttcagcgtgatgtttgtgcatgtggcggagcttaggacccctaagtaaatgatacattgcggatgctcatagtcaaagtatagcttattattaacaattcttaaagaaaatgtttaattagtttggtcatactatgtttattttctagttgaagtaacagcgaatcgtggtctaggcataagatgcatacgactttagggtctgaagaggcatcggatgtatgggatggatgtgtgcatattggggggatttgtaattatgacactgcaaacattaaccattgctataatgatattggactcacatttcatagacacagatggacccatttgtcatccactcagagtgtcaaaacagcgaagccctcatgtttgcagtcctaatattgcaattttctcgtgcatattggggtgatttttcaacaaaatatttagtgagtccatgaatttattgctagtctctatacgtcgagcatgtagggtgtgtgtgcgtgttgataacttcattgcgtaaaggtggtaattcaatacgacataacacatgccaccagtgaatggtgcataaaattaagactctttagtcaaagaaaacaaactaagacccattttatgaagggagaacaaaaataaagtggaaagtgcctttgtgtcgcattttgtgtagggagaacaaaagtaagctcatcttgcaatcactgaaaatatcaacacaaaatcaccttttaaaaaaaggcaaaatttgctacaggacaatcaaaaaatatgtaattggctaggagacaccacaaaaacgtgacacggctgatggacactaaaaaatggtgtaattggctataggacactgaaaacaatattttataatttccgggttaaaaggggtgagaaactttccgaaatggcgaggttgcccctagcgcagctgctggcaaggttgtcgacggcgagctagctggcggcggcgcccacgcaccaggagcggcaaacgaacggaggcagacgcggtcagggagggacaagggtcggccacgcgcgaggcctacgacggcggcggcgcggagcgcgagcaggaggtggccgcgcgccaggccggcgatggcggcggcgcggagcacgagcggcggcgaggtttccgttgagcacgctgcgagcagcggggattctggttctcaaattcctgatctgcggcgccccggacccggcgaacatcacggcgatgcacagggccacgacgacgacaggtagagcaatcttgaggaaaagatgagctcgtcgggtggagttgcccggggctggacatggcggcaacctgcagctgcgccgtgcccgccgcaccggcgagccgtgggaggtagatggcgccaggggcaatctcgccatttcaaaaaatttcttacctcttttgacccgaaaattataaaatattgtctacagtgtcctatagccaattacacaatttttgtagtgtccatcaaccgtctcacgttttttcggtgtcttccagccaattacacattttctgagtgtcctgtagtaaattttgccttaaaaaaatcccatgttttctctactcaaggataaatattcctttatggttcctccttctactaatacatccaaaagcaccaagctaataaaatccacgtacggatgcatgatatactagactcaattctctgttactatgagaatttagatggttcatttgcaaatattatgaggtctaaggtttgaaagcaaaccatcacctttattgtaaaaaacatttggtttatgttcattccactgtaatgttccactagaatccacatgacataagtcatgtccatcccactgttggaattaatagatgggctaaggcccattcgaagattaattctttggaaaatcataaaaacccacctcatgggatggcatgcatgtagagtttagtaccaccttgcttattctaggagagagggacctccttaaaagggaggatgccctcctagccaattgaagcatgtgtggtggagagaagaggggaaacaagcgcgcgctcgctcgcctcgcctggcaggcgacgcgcatgcacggcgtacgcgtcgaatggtccgcaaaattggctcctcacctttgcgcagatgcagtctccttttgcagttttgttttgctgcaggaaattcggatttgttttgttttggaaacattccgaaaaatccggtgcgtgaaaacggcatggagccaggataggttacgcgcgacttatccggttcggtttacgcggcgccctgatcaggcgatctatctctatataaaccgagccgccgccttcacgcaacacacgcgaaatcaatctagggtttgcctcctactctgtaatgcgccgtcactcgtagactactccatcccgctcgccggcgtgcaccggcgatcaggagagcaggtctccggaacctctgccttcgacgtcctgcaccgggagaaggcggcaataaggtttttgggaagcgcttcgcgcgactgctccctgttcgtccgtgacggctcgccttcttctccgctcgcgtgcttcgcgccttcatcgacgctcgcaaccgcgagtagttcctgccgagcaaccggtctttccgccacctcggtacgtgttcgatatgttgtgcatatttgatttatttatgttttactgcttagtttacatgtgtagatctaatgatgtgttcaatctagtttacatctgcaatgtcatgatttatttatggaataaattaaatcactatgtgcttataatttcaacaatccaaaaccttattgtaggcactgtgattttacaatggctagttttgccgatgcactgaggccggataaattcaccggtgtgcactttaagagatggcagatcaggggcactctgtgtctgacggctatgaaatgcttctgggtgagtactggcaaacctgaaggaaattcttactgctgatcagcagaagcaattcgaggaagccactactctctttgtgggatgcattcttagcgttcttggcgatcgtctggccgaggtgtatatgcatatgaccgacgctaaggagttgtgggatgcactgaatactaaattcggtgctactgatgctagatgatctgtatatcatggagcagtttcatgactacaagatggctgacaaccgttttgtagtcgaacaggctcatgagatacaaaccatggttaaggaactcgaactccttaagtgtgtcttacccgacaaatttgtggccgggtgcattattgcgaaactacctccatcatggagaagttttggtactgcactcaaacacaagagacaagaatactccgttgaggggttgatagcgtctcttgatgttgaggagaaagctcgggaaaaagacgccgcatctaagggcgatggtgggcagtccagtgccaatgttgtgcacaaggcccagaacaagagcaaggggaaatacaaagctcaacagaccaccaacttcaagaagcagaagaagaacaacatcaatcctaaccaggatgagaggacttgctttgtgtgtaggcaacctggtcatctggctaggaagtgtccacaacgcaaggggatgaaggcacctgcagggcaaacttctaagtctgctaatgtgacaattggcaatactggagatggaagcaggtatggtaatttacctactgttttttcagttaatcagtctactaattggtgggttgatactggggccaatgtacatgtttgtgctgacatctcattgttttcttcttattaggtcgcacggggttccactgtcctaatggggactgggtcacatgcttctgttcatggtgttggcacagtagatctgaagtttacttcgggaaagatcgtgcagctgaagaacatgcagcatgtcccttctatcgacaggaatcttgttagtggctcccgtctgactagagacggatttaagttggtttttgtgtctaataaagtagtcgtgtctaaacatggatattttattggtaaaggttatgagtgcggaggcctattccgcttttccttttctgatttctgcaataagtctgtgaaccatatttgtggcagtgtggatgataagactaatgtttggcactcacgtttatgtcatattaattttggcttgatgtttcggctttccagcatgtgtttaattcctaagttttccattgtcaaaggttctaagtgccatagttgtgtgcaatcgaagcaacctcgcaagcctcacaaggctgccgaggagagaaacttggcacctctagaactcctacattcagatctttgtgaaataaatagggtgttgacgaagggtggaaaacgatatttcatgacgttgattgatgatgctactagattttgctatgtatacttgttaaaaacgaaagacgaggctctagactattttaaaatttataagacagaagttgaaaatcaacttgacagaaagataaaaaggcttaggtctgatcgtggtggagagtttttctcaaacgagtttaacttattctgtgaggaacatggcatcatacatgagaggacgcctccctattctctcgagtctaatgggattgctgaaaggaagaaccgcacactgactgacttggtgaatgccatattggacaccgcgggactacctaaggcatggtggggggaggcattgttgacctcgaatcatgtgttaaatagagttcctaacagaaataaggacaaaacaccatatgagatatggattgggagaaaatcatcactttcttatttgcgcacattggggtgcttggcgaaagtcaatgtaccaataacaaagaagcgcaaacttagacctaagactgtggactgtgtctttctgggatatgctcatcataggattgcctatagatttttaatagttaaatccgaggtacctgacatgcatgttggtacaattatggagtctcgtgatgctaccttctttgagagctttttcccaatgaaggatacacatagtagttcgagtcaaccctctgaagtaatttccagtttaatcacaccaccagaacaaactgaacatacacatgaacatgtcactgaggaggatgtcagtgaagctcctcgaaggagtaagagacaaaggacggctaagtcctttggtgatgatttcactgtgtacttcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaatctgcggggtgcaagtgtgtgttcaagaagaagcttaggtctgacggtactattgaaaagtacaaggctcggcttgttgctaagggctatattcagaaagaaggcgaagatttctttgacacttactcacctattgctagattgaccacaattcgtgtgctactttccttaccagcctcacatggtcttctcgttcatcaaatggacgttaagacaatttttcttaatggagagctggatgaggagatctatatggatcaacttgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaaaagaattgctaagaatcaactggaatactcccaaatcattggctcgctgatgtacctggctagtgcaataaggcctaatatctcctttgttgtgagcaagttgagccggtttacctctaatccgggagatgatcactggcgtgcacttgagcgagtaatgcgctatctgaaaggtactatggaattggggcttcactatactgggtatcctgcggtattggagggttatagtgattctaactggatctctgatgtggatgagatcaaagccactagtggatatgtcttgacattgggtggtggtgctgtttcgtggaggtcttgcaaacagaccattttgacgaggtcaaccatggaagcagaactgacggcactggatactgctactgttgaggcagaatggctgcgtgatctattaatggatctgcctattgttgaaaaaccgatgccggctatcctaatgaactgtgacaatcaaacggtaattgtcaaagtgaatagttctaaggataatatgaaatcatctagacatgtgaaaagacgattgaagtctgtcaggaaattgagaaactccggagttataacgttggattacatccaaacagctagaaacctggcagatcccttcacgaagggactatcacgaaatgtgatagataatgcatcgaaggagatgggtttgagacccatgtgagttatactatggtggtaacccaatctatgtgatcggagatcccatgaattagaacctgggaagaacaaaccattagtaaactagaggagagtaccaatttataccctctctaagtgaagatgcatgtactctcgtgagctgcaaggcaggttggctatgtcttaatgagttctgttggctttaattagcgaagatgctgtcctgcagagcattcttgaaagaactcacctttgtaagcttgactgttggtcgcagtctatggagattttgggtgaatcttctaggaagtttactaaagacctaggagtatgacttatacgctccacccgaggggtagtctacagacggtctagtaccagataagactctgagtgaaacttgcttacacaagacttgcaattcaaggcgtagtccattgttcaagttgtgagtaagtgtagcttggagttctaggtggatgttcaaccttaatcgctctccattgaaccgctggtatataaacagtacgttggaaaaggcaaatctcagtgggattttgagatttggtgggggattgttggaattaatagatgggctaaggtccattcgaagattaattctttggaaaatcacaaaagcccacctcatgggatgacatgcatgtggagtttagtaccaccttgcttattctaggagagggggacctccttaaaagggaggataccctcctagctacttgaagcatgtgtggtggagagaagaggggaaacacatgcgcgcgctcgctcgcctggcctggcagggcagggcaggctgcgcgcgtgcacgacatacgcgtcgaatggtccgcaaaattagctcctcacccttgcgcagatgcagcctccttttgcaggctgcgtgcgtgcacgacatacgcgtcgaatggtccgcaaaatcacccttgcgcagatgcagcctccttttgcaggctgcgtgcgtgcacgacatacgcgtcgaatggtccgcaaaattggctcctcacccttgcgcagatgcagcctccttttgcagttttgttttgctgcaggaaattcggatttgttttgttttggaaaaattccgaaaaatccggtgcgtgaaaacggcatggagtccggataggttacgcgcgacttatccggttcggtttacgcgggcaccctgatcaggcgatctatctctatataaaccgagccgccgccttcacgcaacacacgcgaaatcaatctagggtttgcctcctactctgtactgcgccgtcgctcgtagactactccatcccgctcgccagcatgcatcggcgatcgggagagcaggtctccggaacctctgccttcgacgtcctgcaccgggagaaggcggcaataaggtttttgggaagcgcttcgtgcgactgctccctgttcgtccgcgacggctcgccttctctccgctcgcgtgcttcgcgccttcgtcgacgctcgcaaccgcgagtagttcctgccgagcaaccggtctttccgtccctcggtacgcgttcgat

SEQ ID NO: 60986 - DNA, 9060 bp, Oryza sativa
ccaccatcaaagacttccccctcatcttgaaggagaagaaagaaactagtcacctaataaagagattagtgttaacacatcttttattactttaaatcatatactattactaaatcttttaccttggaccagtagtctacatgtcagcgagaaagtctctctctgctgcttcatgaactcctcaatcccatcttcatctcgataacagttccatctctctctgctacttcatgagctcctcaattccatcttcatctagatagcaactctagtgacatgggttggctgatggtgattgggagaaggtgggcttgaaagctcgagtggcatgccagctcaaggggagatcgagctcaagcttgtgagtgaggatggcccatgcccacatgcttgtgctacagatgacaacaccgtttcatcacccaaccctgtgccacggtgtctcatcttttgcagtttgcacctatgcaaccacgcttgtgtccttctagcacgtgaaatggtggcagattgcatccctccatgcatggtcgacacaacatcctcctgcccgatgaggtcgtcatccttgagggagtgagaaggtagggagaacaaagaatggtccgacggtttctttgcaatcccttgcctcacttcctgcttgtgcatggaagaggggctcatgcaaaaaaagtggagttgttcatagggagtcatccattgttggttctgttgtctgtcgagagattgatgatattatcaacgtgaattgtagacaatctcgcttgtctaaccaatcatgcatcagatagagggaagaggagggagactaactagcatgtgggatactactccaaggtgcaaatttagtccaaaatgaagagagttgctaatagtccaatatgtaatttatgtaataaaaaccggtacaaggtgtaattcattcactctcaaataatctactactatcattcttcttgattatagtctaacatagtatgcgtgcgcttaccataattgactattaacattttacgatacttgttggaaaaactatcccaaaagtcacttaatgcttgatattccacccaataagtcatttattgcaaatgcctacccctacttggttttattgcaaaaccaccccagcgcgcacatacctaaccgaatccgtatgttatcactgatgtagagccccacatgctaaactagctagatcaatcttgtccaagtgcttgcattaaacttattctttatgtttcattgattttttttctgcatacagagaaactcaattaaaaacgtttaagctctcattactaattctatttgtggaacttccaaaacaatatcaagacaatacttctagaaatatttaattttcgtatagaccacattgactcatcatcataaattataaaaacatattgatttggttaagcacatatgcgctaggttgatttttgcaacaaaatcgagtagaggggtggacatttacaacaaaatgacttttgagatagaatataaaactttatgtgacttatgcgatggtttttataatttttcatactttttttaagataatgaactttgtataatagttagtgatagggtatgactaatcttttgcaccctgataagctaggattgatgtggagatacgtattgtcgtattgatattcgtaaaatctaattcgagagccttctcgatttagcgctatcgcgcgacgctggtagagtcgtccgatcgctcgcgtcaccattgagtccatctgcgtgggcctttctagataagaatcgagatgaaaccactccaaccacacgcacatgtaattcttgtttgagaaagaagtcacaaagagaaaggttacagattctcccccatgtcatttttctcttcaaacaaaattttctctcaaattacttatccgatctacaatccgattacaccattgtgttcattacaattaaatctttacaacaagatcttacatgattatattacgatgaaaaaatatttatatttgtaaattacttttattatatatttaagttacttttatcatatatataagttacttttagatttgactaaattacttcttagacatataaaagtaaattcaataaagtctgaaagtagtaacattgtcacgacattaaaagtaaattcgttgtagggataaaaatatgactttatctagaaattaaatttaatcaacaaagatcaacacatgtaagtttaacaatttttaaaagtaacttcaatgttaattggaagtaacttttgcatggttcaagttgaaaagagatactagatggagtacaaactagctaccactagctgtgtagtcacgtctaatgaaaaatgtattagttaaagttactttcctttgttataagttacttctataatatatgtaaattacttttagggtttattgaattatttttatatgtctaagaagtaatttagtgaaatctaaaagtaatttaaatatattataaaagtaatttattatttttcatcaaaatataatcatgtgagatcttgttataaagatttaattgttacgaacataatggtgtaatcggatcatagatcggatgagtagtttaacagaaaaactgtatttgaagtataggtggatagtgccttttatagatagagtggtagctagtttagacaaaccagctaccactagcttcacgtccattgatactgtgatcatatgttttcgatctacctgatactactggctatattctaaactccacgaaatcatatcggaactaaaatccctatttgtcccattaaaattcatacgctcgttttggtcggtcttccctatttcagctatttggtgctctactgaccgacatgccaaaaacacagtatgaaaacagtaagaaacttactatttattattattttctatgtaaaaggggacattttcatatttatgaatctaattatttagtgccaactataatgaggcgatgataaaaattagaaaatctaaatatttagaatcgataatcatgacaaagatactattattatattagtttgacgagaatatcagcatgatcgggaaatttccgtttcacataaaaatcacccacctaaataatactaataaaatagcgtggtccacctacaccgagtccacagttccacacaggcgcacatcccgtacccaccccggcgtggaaaggaacccctgctgcgtcaccgctggcgctacccaccagcagcgtcttccgttgcctcctccttcccagttcccactcccacaggtagaggaactcaactcatcacaacaccccccaccccagtcgccctcccggtcgtcgacgtcgtcgtcgtcgtcgtcgtcttggaggcgaagaaagaatccggccacctataaatatactccccccccacccccacgccgacctcaccgccgctgccctcccctcctcctcccccctcgcaacctctccccgattaaaccccccaaaacctaccgttccatcgcggcggcgcggctcggcacggtggtggtgggggagatgcacctctacaacgagtggctgccgccggcggtggcggatgcggcggcacgggagcccgcggcgttctccggcgcggtgggggaggcgcgggcggcgtggcgacccgacgacccggactccgcctacgccacgctcaagtggatctccgtcttcgacctgtaaaaatttgtccctctccctcccaagcccctccccccccccttctgttctgttcgtgttttctaggttacggcggtggaggaggcgggtgtttttaggtccgggtggggttgcgatttcgtgtttcctgattggggcgcgacgagatgaggagtagctcggaatggtgcgaattgaatttggatagttcggacttctgatcggggggcgatcgcgtctggaatggggaacaattctatcctgtaatcgtcgtgcaaaaatttccgtagcttgtttagtgcttttggtgctatctagttgcaggctatctcatgaatttgaggtatggtgcgcagtaatgttgcttttggggtttagagcatgtgttcccagctaatggcggggataggtctaactgctggtggcactgcgctcttaagtcaaaacatgcgccgttatcacttatatattgatcactgcatggcatcgtttggtttcatcactggatgacaccgttatcaccctctgattcttacaaggagaccctgctggaattagaaattactgtgctggttcgagctatggatcatgctgacaaggtttctaaaagtacttttgacaattaatggtctctgagttgcgttttgaactttctagaagcatgtttgcttattcttgagctggtatatacaaatagtatgtggattttaacatttgcttttgagggctaacatttctcggattattcgatccaatttggggatttgaacagcagagtaattggcagaagcatgttgaattaaccttgtactggtgtacacaattaccgtagctgcaagcaatttgctcaactcccctgttttttttcatgaacttaatttaaaatattgaacgaccacaaagtgccactggaaagaacttttctcaataaaatgaaaagtatttttgttgtgggtgtgcctccatgatccaagtgctgtgataataacaatggcatctctgctctctactactggacatttcatgtgaccctataatccatcttgtctaccttttctaccagcactgaagtgataactgcatggacatgtaaccctaaaccctataaacctattcaaatctcacatactgtcttgtggcccacaaagttggcctgctagtaccaaatagtctccaccagaatgaaaattacctgttatctaaaaaaaaagggtctccactaccactaggttcatccccgttgtttgtgaatttgattttttatatgttagatagtaaactgtagttagtgtcaacatcctggttacattgtttacaactagagcaatgatattctttttgtaggaaagatacatagataacaacataattgaaaacgcttgatacaaacaaattgtttaaggcctcctgtgagttaatttggttggtttctgggtttacaaatgcaattaatatagatattttgtttctctatgcatttagttttatcaacgcaaagagtgatatttctcctgaggatgtacacgctcttgtagagctcgggttggagatatttcatgcatcacagaacaagttcgttgttcaggtaatgctagctatttacgatttctatatggctggttttgaccagtttgacttcagatgatcaatttttccctggtaaatgaatgcaaccagattaagtggggaggcctgctcgtcaggtttttgaaaaagcatgccaagaggatttcacttggtgtgcaatggaggccactgtatgatacgttgataaggactcatttcaagaggtatatttcgaatcaaacacactttttaagtgacgaagaatgacaaaaatagcagagttaatttcatgtctgttacagaaatatgggacctgagggctggaaagtaaggcagcagcactttgagactgttacctcattggtgcgtgcatctaggagtttgtttcctgaaggtgcagctgcagagatttggtcagaattcaggtttgactgcttattctgacttaagcatgggttcttttacttgtttcatgctcactcctattctcttgctgcgttgttaattttgttatttataactctgtgttgttgatacacctctataaacctgtacggtatagtgtttagcttgacaagatcttactgtaatcaaccaagcatctaccaagattagaggctttaccaggattctacatgcctagagacctctagtgcaggtctactacttttattttggtagctacacacaataagaaatgtccaaagcatcaactgagtactgtggtgttatgtttgcatgatcctctaattcttgtaccattatttctaatgttattgcttttctatactaccattgctgttaaaatttggaaaaatacaatatgtgattgatttttgtgagtgactatggtagcagttgtatttaccaatgacatcccattgcaccatagcagtttgcaatttgtgcttgacaatatgctaccaacattgaactgccttacctgatactatattgaactacagccccttgctgaaaaatccatggcataactcagcatttgaaggcattggatttcttaggctgtttcttcctgcaaactcaaggaatcaggatcatttcacgacgtaagtgaaacaggaagatatttgatcaataagcttttccttatatagctagaaaatcttcacttattgtttttctatcttctggtatctttttatgtagtgattggattgcagaatgtcttgacatatggggttctgtcacaaattgtaacttctgggatattcaatgggctgccattgtagcacgctgtataaaaggttccatatctgttgactgggaaaaatttatacccttattgtttacaagatacttgaacatgtttgaggtatgttgtcatcttaattcattctatggtactagccagctctaatgtttggaaggtggcgtggatactagctggttaacgttttgcatatgctgcaaaactgcattttctatgaatcaagtgttgcaagtttaattaattgacaagcatattagaatagcaatctattttgctgtaacaaaaaataattaactaaataaaggttattggaatacttgtatttttaaaaactgaatcagtttctgtaatcttctgtccttcatctcttgtatataaactgtctgtgtaaattatgttatattgcagtgggagactctaccgctgtttcattaagaaaaaaaggaagcagctattattttcatgtgccctgtaacttgctcgttaagtgtatcaaacattttatcatttcttttgtgaaggtgaaccaatgttttaaataatgcagtggaatcatagtgctggagtgtttctgttgtagataattgcattatagacaatgaaacatgcatgatcttgtttgccaaatgcatagtttgatcatttgtgcagtagagacgcatgtcttgtgctatttaactgtcataaaagcaccattatatgtaaaatattttgatccacgcaaaaagttgcttgataaaatactctcaatttattttgatactgttactttctctatgcttaggttcctatatcaagtgggagtgggtcatacccctttccattgaacgtgcctaggaacacaagatttttattttccagtaagactagaactccttccaaggcaattgcaaagtccatcgtaagttattcgaatgctgttttctttaatttttgtacaaagggaacatagagatgcaatttttatgatactttgtaaaattcatcttgttcctttgtttgactagtgcaaaacacatatattcgttttgaagaatataaagttcaggtgggctggattacggccttctgtggagtcctaagaaaataggaaaactaatttcaataaggagccatacctattttatttttaaaaataagttcttttgcaggtataccttttgaagcctaaaagtctggcattggatcattttgagaagctcgtaaattttctagaacagtctgtcttctgacctctggacccttttgtggttgctgcactggccttcttttttaattttaactagatttgtttaaacttgtaggttctatcatccatcaaatgggggtcggtggacctactcattggagcgtttcttacgatatcttgttctttactttgaaagacgccttcagcatgaacaattgtaagagaatctttgacttgcgtgacaacttgcaagatgtttttcttatcgattgcatcatcatctgatgttatatttgcactacagtgaagcactggatgacaaacacaatcaattttgtttgggaaaagaagaaagatgtggttttgtcaaagtagtcctgaaatttctggatcgtggtcagtacagcaaggatgattctcttgctgacactgtgtctattgcaacttcaatcctatcttatgttgaaccatcccttgtgcttccatttgttgcaactaatttccagctagccttagagacagtaagttgaatttatgctgtatatttcatattttttccatagagattttgttgcaactaatttgcacccccttctcaagttcatatttttgttggaaaaacgaacttactgttttaatttattcgaacagactacagctacccaccagttaaagaatgctgtcacatctgttgcattttctggacgtgcacttattctaagttctctatgttcgtctcaatctgatgatagtagcactgctgatacattaaatgatcttatcgttacttctctttcaaatgcgttacttggtatggatgccaatgatcctcctaaaactatagctacgatgcagctaattggttccatattttcaaacgtaagtgtatttatctttctcaccttttcttgcactgttgaacttacaattgctatactgagcatcctttggtgtttatagctagccacagctggtttcagtgatgatgtgcctgctttcctccaaacctcctatctgtcagagtggcttgatgaattcttttgtcggttgttttctgtccttcagaatttggaatcaagtagtcctatgtaagcggcaaaactaaattcctgtatttaacttattgttacccgatatctttcagaacatggcagttgacatcttgtttcatctggatattgcagtaatgagggttaccaaagctcaatcatgtcaggaacttttcttgttgaggacagcccatactatttttgcatgctagaaattgttctggggaagttatcaaaacctttatttaatcaggtattgcactagttagaagttgatccactttgctgtccttaaacctatgaatttcctgtcatgcacatgtttcctcatatttttttttgca

SEQ ID NO: 60987 - DNA, 23079 bp, Oryza sativa
tcaacccggagggagtagaagacataagcgtttgagaatctttggattatcatctttgtttggatatttgtctgaatttagtgactctaatagattaataacaataggagttttaacactttggctgaactatcatgtatctgtaggaaacatcaaacaaagatttgtcattgcttgcgaagtcagcttttgagttgctgaagtggcgtattttacaacggccttttcttgaaactgctattatgactattctttcttcagccaatgatccaaactggcggaccagatctgcattgttatcatatctcaggacatttacgtacaggttgaatttcagatcttctcttgatttgctagtgtatcaattattatgataaatgtgttgtccgtaatttattttgttcttccctagtattccctagtattgtgctcagttataggaagatgccttgattgaatcttaccatgatttgtgagttgttatttactagagtaaatttattgataatcaaacttgccttcctggatctatgtcgccgtaatgagaaactagttatttagtcatcaaaattgtgtacgtcactatgttgttcaagtgaggtaggtcactttgtggttgctgagcatggtgctgatctgggactaggaactgcacggccaacatgtggctgccccattccatgtaaatccatttattacaagatcccccaatcaccttctcgtcctcctatcccatccctttctttccagtccactgagcaaagcaccccaaagccctagttaccaaatgccacaacctgcaaaatgcccatatgctgcttcagtagggagattgatccaggagggtaaatcttattcttttttttttttttaatctaaaggcaagatatataatcagatttcacgctttagtatccttaggaagggatgggaaggaggggagagggtttgattgagtaacaaagtcaattgcagagcagtgtgacgtccatatgaaacatggtatcacagattacaagggttaaggatggatatttcaacaactacataaacaaacacaaaagaagatttgcattggacaatgccattccagtttgccagctacagctacatcgcatttgctaaaatgataggtgggtgagaaagggcattgtgaaggacccttcactagcaacatcgcatatttggaagtttttttcccccactaaggttgcccctaggatatccatcttgtcccttggatttagattctacatctcatagtggatgggtatcaaacctcgtagctaagaaatagggcatgtccatgctgcatatactagaaaaaccacctaatcatgtcactcgaattacttgtaccagttccatgactaagtttcttagtttctgagttcgctgacctctatttgaaccactgacaaatttgatgtctcactgctgtcttttgctcttgacactatatcctcatcaagggcagtaggatgtagaaacacatttgcgctcctgtattgcagatctgtaatatttctttattaagtcagctggctttttgagacttatagctgatggaaaataaatgcattatctttgtcgcaggcatacattcattctttccagctcagagaaatcacaaatttggcaaacaattgagaagttacttgtggatagtcaagttgaggcaagtatatatgtttatttggcctgtaccgtacatacttgtttttctcttgtaatattccttctaaaaaaattgtctcagccttctaatttctagcctttaactttgcattagcacccatatgaaagcaatactgttcttattaaagatgctgtcagtgaagacttatgctgtcaactgtatgaattttgttgctgtatttccaggttagggaacatgctgctggtgtccttgcaagcttaatgaagggcatagataaagacctctctaaggactttcgagatcggtcatatgcacaagctcagcgtatccttcatacacggcaaaggttaattttttgctgatttttatattactctctagtctcttcatatcactgatttgttaaaaagatactacatactagtatgttttatacctgctgcttcttgcagaggtgcaaagtcaggccactctgttgctactatccatggtgcagttcttgctttgacggcttcagtgctttctgttccatacgacatgccaaggtaccttcgtgacttcaatccttgtctttttcgtctaaagaggacgatgtagttagattcttcgtcaaatcacatcctagtggcctacttccaaatatggtggctactttactgttctgtttgtttttaaacggacttttcgttgtctttgcagctggcttcctagtcatgtaactctgctggcacgctttattcgtgagccctctcccataaaatcaacggtcacaaaagccgtcgccgaattcaagcggacgcatgctgacacatggagcatccagaaggaggccttcacggaagacgaattggaggcaagctcaaagcggttccctttcaaccatcctttctgatcacaacacaagttgacgctcgctcacatatttgatccttttgtgaatgcaggtcctccgtgatacatcgtcctcatcgtcatactttgcttagatataaggaccacaagattaattttcaagtaaattcatatagaatattttgtatggctgatgagattgcctccatacttggtggatcatatacatatagttacatcctgtagcttcggttttatttccacagataaaggtttttcgtcgtacaaagtcaggcacgtagtatatgtcgaatatgagctgagattatgagatacagtatgttacagtcaggcacattgcttctgcagtttctttcagcagcgggttcgagtagttcacaattaactgcggctcgatggatgcatacattttactcacccagccgggtgcccgggtgctgctgattgcagttgcagtaagtaattccgataagagtacatgcgtcttcttcgtaacaaaattttcaatctctgccactggcaacccttatccagtacacgcacagcatctgatttcctttgatccggtacacggccggcacatggtatcagttgagcagccaaagtaaaatacattgcttttatatagtacaagtacacacatggtagtgactgcaagtacgctgtgtgctaaacatacaggcttgtttattaaggcctgtttagttcccgaagaacttttcacacgtattaaatatatataaaaaactaattacacaaattacgtgtaaattgcgagacgaatcttttaagcctaatcgcgtcatgatttgataatgtagtgctacagtaaacatttgctaatgatggattaattaagcttaataaatttgtctcgtagtttacagacgaaatatgtaatttgttttattattagactacgtttaatactataaatgtgtgtccgtatatctgatgtgacacgccaaagtttttaatccctgaaactaaacagggccaacactgcgtggtagagtatatacaacaagtagtacatgcatgttagagcctgcaagtacactgcttgttaagcatacaagcttgttgtatatagtgtatcatgaaacacctggtataccatggtcctcgaggtatcatgatacacctggtatctcaaggtatcatttggtacctcgagacatcattcggtatcctcaaattatcacctacggtacccttgaggtatcatttggtaccctcaagatatcgcccgtggtcctcgaggtatcatgagatacactcggtacctcacggtatcatttggtacgctcgaggtaccatgatacatatgataccctcgaggtatcatctagtacgctcaaagtatcacctacagtatcctcaaggtagtgcccgtggtcctcgaggtatcatgatacatatgggttatacatggggatttttttaggtatcaggtatgttatagtgatacatttagtctctatgctctagaaagagatatcaagtgattcaaataaaaaaacacaaagaaaggaaaagaatagtgaaaagaaaaaaaaaggaaaaaaaatgtatggttgggccgtggcccaatacacaggagcgcaacagccctaccgggccagctggcctatccatgtactcactctatcctataatataagacatgtacacattccaagattcaactttaaaaacatttaaccaacaattattataatataaattaaattttatttgttaaaattattatcattggattgacatttaaatttactttaagatggttataaatttgttgcaataaaccttatagtatatgagaaatttaaagtcaaagattagttttgaagactgtgccaatggttgaccatgtgttatattatggaatggagggagtacatatgtgcaagtgtaggagtccttgtggtctagctagccacgtaccgacgtatgtatgtataggagtcctcgctaaacgtggtggcttgtgtggatggaagcgtgccatgctagactgtcccgttgaagaatggtacaccgttctttaatatttctatctcagcaaaccattaattcatcaacagtgtgccaacatgatggtactagttttgcagtttttattaaattaataatacttcacaaaaaaggtcgttcattttctgggttactaaagatgtaacgagcaaatttcttgttaactagatctggcttatgccttttgttaatctcctttagtccactgtaatagtaccaatttgagttccctttccttagcttcacggcttgtttgttgaatactatgtgattgtcataaccaccatgatgattggcatgctcatgcccatcttctggattgccaaaggtgtaataatatgaaaatttcttcttagctaggtgaacatgatcatgtccatgtgcgaggttgccatagattgaacgtgaaaatttgttcttagctagcttcagcttaggctttttgtcaatcccattcacttcgctgtgttggtataaatctgaagttttcttctttagcttcatggcttcatagttgagtaccatgtatttgtcattgtgaccatcatagtaaacatgacggctaactgctgggttgtcataaatgtaacgtggaaatttcttcgtaactaggcaaacatgatgatgtccatctgctaggttgccatagatgtagcgtgaaagtttcttcttagccatgttcagcttagattctttgtcaatcccatttgcttcactgtgttggtacaaatctgagtttttcttttttagcttcttggctttgtggttgagtaccatgtatttgtcattgcgaccatcatagtgaacaaggtggtcatttgctgggttgccatagacgtaacgtgaagatttcttcttcactagattaagctcaggcttttggtcaatccccttcactgcactgaactggtacaaatatgagaattctttctttagcttcatggattcagtattgaataccatgtgattatcattgtggccatcatagtcaacacgaacatgcctgtctgctgggttgctatagatgtaacgcaacaatttcatcttatctagtagaatatgatcatgaccatgtgatgggttgttattgttgtgacgcgaaagtttcttgttggctaggtctagctcaggtttcttgttaatctgatttgttccactgtaccagtacatatccaagtttttcatctttatcttcagagcttcatactcgaataacatgtgcttatcactatcgccatcatagtaaacacgatcatacccgtctgctgggttattatagttgtatggtgaaaatttcttcttagcttggttgtctagcttgggattcaatttgagtattgagctcttctcatcagcccccttggctccactacctgatgtaagaaggagattcttcttctggttgcctgtagatacatgcacacgatgtcacagttcttgcattcgttgatcattataaactgaactaggagttggttattttcaccactgattttaactgtaaatgaaatctttattcttatgcgacatataatcttccccaaaggttgctcattcatgtactgttcttgtcaaaacatatctgacatttgtcagaatttacatgggaatcttccttattctaattctactacctccaccccaaaatataggggtagtgtggtgtaatcagcctcacatttgttacaaatttataaatagtgccattttacagttcgcaaattaatatacaaagtgcagtaccatggcacctttcaattaaatactatcacaaataaatgatgttttgggaaacaatatgatcatgcaccaaggtattagtttgattatgaataaattaataactagtataaaacgtataaaaatgaaccaaagtattttgaaattttttgaagataaaactagccataccattttcaagttgaattgaaatattcaaagagatattgatggtcaaagtatattgattgcatgcattacaaacattacccaactagtaggtatttaaattctatctttttttctagggacgcaatttgaagatcggatatataatttaaaatgcatatgcaggcagaggcctggattttattttcaattattaaaacaacagtttcaaatgttatgctacatttgcacaatcaactataaggcagtaaatttatctgcatcttcatatactgttgatgaaattggcaaaattcaacacttgcaacccctgtacatacgtacttgaaacattagtattttgtacgggattatatatagacacttaattttagtggacattttggactgtcaatgtccaaggcatatgttttggttacaggagagattacttactaaaacctcatcaactttgtttgatttgagttatcaccttataaaaaatttaataaaacttgagcaagtgaacggtattattatattgatcaagtataactatatattgttaactttccatgtttatagcattaacttcaaataaaatatgcatttggtcatgctggttttgagtgtgattttggctgtgttgtaccaccttgtaattaaatttgtactccctctgttccaaaaagaatctaatcctagagtgaacatgtgtctagattcattattaggattgttttttttaacaaagctaggggcccagcttttcaattacactagaaaatggcgcaccagttggcgcgcttattaattataacctgtatataatacttataacttatttagaatatatatttgttagtttttgagtttttctacaattttcaattttatcaattttatctgtttttaaaactcatggaaaatagactgtatatattttctggtttatttagaacacaataatttcgcacaattgtcagaacggctagttcaatgctcgtaaaatttatttaggatagagagtttagttttctactaacttatcgaaggttaaaatatttccaaatatcataaggaaatttgatgtattttggtaaagaaaatcacaaatctgaatatttttttctatctctaggggggtatgtgtaaacatcataatttacccaatagagtttcatatgcacacaccatagcaaaatttagtttgatatatgcacatgaattacatagcaaaattacttgtccaacttataaaaaaaatagcctacttgataataagttttatcttagggccatttataaacactccaaaccgagggcctatttgtaaatttaaattttttagaggaaaaagttcagaaaattgttttggtagaaccggacatgttttttttatcctctgcataatttttacctggggtgtgtaaaaatcataatttgcccattagaggtgcgtatgcatatcatttagcacaattttagtttgatatatgcacatgaattatatagaaaattttaatttgatgcccattgcctcatgccagagcaaaatttaaacttgataaaattagttgcgagctacctatcaagcaaaaggcacccctcttgctattttattttctatccacatttcattttatttctcgtttcaacgggtgaaaacaatctatctattatattataaagatagcttgaaaatgatacggtatttgctttgatcgcatagaaattgttacattaattaatataaaaagataatagttgtatatacataatataatgattgtatttatattaaatgtcacaaaactacaattatttggttaaatctaatcatgtttttaaaatatgttacaaaatatattgaacaaaagctaagaattgcaaatttaattctataattaaaatatgttgcacaaaacaataattgcaaaaatgaagtacatgtaatcctagtgatatttgcgtgggactttcgtcgagtttgggtagaatcatagtcggtgatattcggtgcaccgtactaccgtactatgtaggttatttgctcagtgaatcatagtcgaaaatactcattatttctcatagttcttgttctatgagtggtagggtgcaccataatattcaaaaaatgctatccacttagtatactcattcgtcagagtagcttggacgtaccgtcaagagatagaagtgcttgctcaatcacattgagttagtgaaaagaccacttggtttgatggtatgattgatcttctacgtccattataattaccacattgaatgtatatgtcagatatacttatagattcaacaaacttctagttcacgataagtcatctttagttaaaattcgcacaaataattccaatatattttatgcaattctatatattttaccgcaatattaattaaaaataataaaagcattacaaataatcaataatcataaatgccataaataaattttataatcatgaatatatgaaatataatttcagtgtattttgcaaatttacaatgccattcaaacaaatattccaaatacagagggccatttatgtattttctagaaatttcagggtttaaaacgcaaagtttccaatgcagaggaatatgcgattaatttttggaaaccacaagggcctttttgcaaaatctatggagattttttccttcttctctactttctttcctccttccttatctttccttccttcttctatttacttttctttccccttcctccactgatggcgccagcgggtgcagaggctggacggacggcaacggcgcggtgggtgcagaggccggtgaggcgctgcggccggccgttggcgtcgtggccgggtgacggagaggaggaggccgtgtggcggctccgtgcgatttggaggccgggacggcgtggtggggctggctgcggcctcggatggaggaggcggtggcgacagctgcggccgctcgcgcgcgcggatcatgcagcggcggcttaggcgcgtggatccggtggcggcggctgctcgggcgcgcggatccgggtattcccccacacggatcctgagtcggcggcggcagcgtagtctcacctccccacggtggcggcgtgccctctcactccctctccttcccgtccctttcccctctcttctctatcgccggcaactcccacaggccggatccggcgtaggcgtcggtggcccggttgcggtgccttcccctccaccagatccggcggcgagaggggaggcggtggctgcccggtggcgggatgattatttagatgttcttgtgtgatgttttagtgaaaaatttctgtgatgtttttcaatgtttcctatgatgttttttggtttgggattgggattgattgatgcggggtggataaggtcgatgcatcagctcgattaggagaggggaatctgttgttcttgaggatttttattcaatgtgatttctttatctactactgagtcctgactgttctagatgaggtccattggatatttttttttcaccgttgatatgacatcagacggccacgggaggggtgcgcatacgtggccgcttctccagccgagaatcccgctggggctcgaagcgtggtgccacgtggcccaatcactgggcagggttagaaccgtgcaatcgtatatagagatatgtaggggcagacctaggtccaaggcaacatgggtcatggcctggcgcgggttcataatccaatgggtctagctagggacagaatagtatgggccagcttgggccttaattagcctatgccttgtccgcccctataactatgatgagatcatatggcggtataataattgtgtgtgaaataatggtatatatatagagggagtgaaacttggaacacatacatcattacaatcaacaggtgacgatgtcgttgctgtaaaatttactctacaaattatgtgaagtaattgttatataaattgaccaacatcggtcgaggagcagagtgatctaatatactccatgcatttatttttgtaaggtttattttgattctataagaaatcaaattttgtagattttgaccaatgtaaagttaggaaactcaaaagtatatttaattaatgcataaaattaaactaaaccatacgctttattcatacaattaatattggctttatgagaaattgatggctaaagtttgatcatgaagacattttataattactatatgtacatttaaagtagtaagtactacttcaacaaagcataggagttaaacaaacatttataatatgagtgaggattgagtaaagtaaagtaaagtatttcttgtattgtacaccatccccgcaatccaaactacaaattgctataagttgtatagtaccacctacacattcgatgattaattatgcatctcctctactatttttataaaaatagtagaattttcttacgccacatgtgtccgatttggccaacattgtctccactcgaagcaatgagagtctgcgtccgattcctgcgtacatcgtgcaacgccgcacgtttgttaccaatttgcgttgccggcatccgattggcattgatgtcttctctgcgtagcccactatatttccttccatatctcgcatgatctacgttgccgagggaggcgacttgacatgagacgggctgggccttcctgcatcgaccgtgccatgcatatagatcgaatccgtttcagtccgaagcaagagactacgatggaatatattgacgtgcaatcctttcgcgcattggcaaataaaaagggacgatgatgggataataaacaacaagacttaactgtctatctgtataggttttgcatggatgcaaaaatcatagcaagggctcctattttcatcaagcaaataatggccaactcgtcgaccgacctcgagcttcctttctagagtaggatatactgcatatacttaatatgtgatattaacattgcttcaacccattacaacgcatgagtattttctctagttactatataattgtatcccactaattagcttaaatattttatatgtctttccacaggcttcgtaatgatcactaaatcatacccgtacaattagattcattagtaaaatcatagctgtttgattagatctatatgtcaatctctatctatatactattataaaattggagatgtttctgttggaattttggtacgttatccttgtttgagttggttgtatgtcgtccgtatccaattcgatgcgaatctagaataactattatacacccatatcccatcccaacccaaccctaccggccaactctatcccgcgtgcctccaatcggcgccacacacgaccctcccttgatcggcatctttttttctctcccttttatttttatttttctcattttttctcccgataatcctaatactctccttctccttctaatctcgtctcatttatctttttctcttccaaatttccctcctcataaatagtttccttttgaatttatcattgtttaaggtgtgcatacgacaagtttgttactctgcaaatgctttccaactatagtaaaaaaattattaattgaataatcaaaatttcagtctttgatcgatgagtatagcaaaatgcacatgcgtcaacttatggaatggccacccgattgatttgtgaagctatggaaagacgtacataagtgattcttcgtgtgatgacacatgaagcacgcacaacccggttgaatgctatatatggtttctgactttgttttgctattgatttgtttgtttaatttcggtttgttgtttaaattgatcgagttttattaatcgtgaaaattattttcacctgttgcaatgcacatgtatttttgctagttatttaaatgccagaccagcccggaccaacttctacaaacaaatgagtccatccagaccaacaaagtaaaatcagctattggcatgtggcacaatatactagtatgcagggacttagaccatgtgcactttttccatatgaagatgctagggggatgtgtttggttgaaaggaaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattccttgcaaaaaggaaaagaagaaaaaatatatcgtgagtgggtgaaaaagcatggatgtaagagctcaacttaatggagacaacacttacaagaataaatgagaggagtgacaaaagagtactcattgcttagtctcagataattttagcattggctgcttatagttcttgctcaatttggtcaggactagcacaagaggtatttataggctagcatcgctatcacgatcacgtacaatcatctgctaaaaaacaaagaaattgagaaatggtggcaggatctaaaaattaattctgaattaattttccatgctggggcgcacatgctttttttacactgtatatgtattaaattcaaataaaggaataccctgtgaaaacagtgtaaatccactgcaaactttaaaaggtattaccaaagtaacttttcataacgtctatgtatcttattatataaaattttacaatggcgaaagatataaaatcatcaatttaaagtagtatggctagaaaactacatgaaatttagtaaatttacactgtataaatgtaatacatacattgtaaaaaagatggaaatccaaaaatgatcaatcaattgaacatctaatctataccttctataaaactacaatccactaatcacataaagctcaaaatgcaagcataacagttattagttaacatacaagtagatcacacatcaacccactaagcactaaaagatcaacatgcatagtaaatactaaaacttaaatgtaactacatacattacctataaattattattttttaaagctcaacatataaaaatgttaattcattattactcatatcatttccacaatatttatatctaaattcattcatcatttcaacatcatttaatacatattcattcatatatcctgtagcaaagcgcggggtgtcacctagtaactgctatacaacaatcactagtattctcgattgacaacctcctcaatccaagcttccatctcgtggtgcttggtcacgcagttcatacgagtgaacgaaagtgagttttactatgaacttaaggatactgtgaacgatctcctttcagaaatcactcctgttgagaggccctcctcctcccttttttctcaatatggaagagaggcagaagagaaatccagagatagctcaactttttcatggaaaagttggggatcgaatgcaagattgagtccctgctggatggaatggaaacactagaaagatcataagaaaccgagctcaaagtgaatcgcaagagaaccccccatcccttagaaggatttgaagctgtttagacactcatagacaagtaaaatccaactcaggttcctcgagaagtgaagtgaacgagcaaggtaaaacacaatcaagttaggaaaagagtctttcatgccaaggtgaacatagataggtagagttagtttattttccttaattaccagagagaagacttacatgcctgtttgactccgcatatatacccccattaaaaagagctctgcatatagatattcgatgacatgtaaatcaaccattttttcctttttgataatcctacggtctgctcttttccctggggtgctggatatgttcttcattgcttccgacagcaatatttcaacctgagcggcttttcctttatatatgtaggtattgcaatgaaacatttgttcctagtaaaatccctaatctaatcttgctagttagatctagagacaatgatgaaattcgtaccacttaatgtgttgctatgaagaccagaggagctgttaagttactctagttaatttggccacagcctaatttgccattagtgtcacattcacaaactgctgatcacaactgtactaaattttggcgactgtctgggcatataacatacagacaagtggtgtaataaaatgtttggcttgattcagttgtaaaattgaaccaaacagttcctgaataaattgtgcagctaaccaacaaacaagcccctcaagcttcaacatcattttgttaggtagcagttatgtttcgtttggatggtctcttgtgtgttctgtttggaggagtttttggcagctgtagttttcttgaagtcaaaagcttgtctaaacaatatagcttttcatccagattcttagaagatgtagttatagaatccagaaaataaactagattctcaccagctgaatttctactaatagcttcatagaatctaaagctacctaaacatgcccttagatgatgccaccagtgggagctattctattatcctttttagctagatgtgccatgactatgggtttgtttagccaatcttaaggttttagctagacgatgaaatctgtttgttgaataattttctatgtagtatgtttgtttcttattttgaaagaaatgtatggcatggttcctataactttaaatttttaatgtataatgtcattgacttttggagatatgtttgactattcatcttatattaaaaaataactaattagcaagtgtgaagaaaatataagttgtgcttaaagtagctttagtaataaacaaaccacagtaaattaaatgatagctacgcaatccttttagtaagaagaatttgatcaaatgttttctcaagtatagcagcatcatatattaaaaacgtacaggaggaattatagcacccgagggagaaaaagagggagcgaagggcttccagcagttcaatgggattgtaaatacttttggttttttcctcctttcaattaaattcccgcagttcttctgccgtcgtttctgcttaaaaaaaaaagggcttccagctgagtttcatgacagcgccattaattgattgttagcccgatagaggctccacgacaactcccaactaatatcatgaacatttatgcatacatgatctgacgatcggtatgtgctactgacttggaaggtatagaaggtttggtatggatcgaccattaataacacgttggccatattattaattagttgatgacctcaacggtatctaaaatttaaagtgtgactttcaaatacaggaagttagctagatggcatgtatgccattaaaattctgtttgtcactcccctttaaaagaaattgtttgtcacaaatagacagttcctatttcgaactaacacacaaatatgcaactgggtgacaaatgtgcccctactttcgtctgttcaaatgatctgggtttgaacaatgatttttgtttgtgtacttaaccaggaaaacatcctctcaaaataagaaaaatattgttgggaggaaggtgtagtatagtctattcatgatattttactagaattaattttacgatccatctattttactagaaattaatttactcacattgtttaattgaaaagacattatccaatataatgttttggaatagcttaaaatttatccaagcaaatatatatggacaaaagggtccagtttgagttttagcaaatgtattttgaagcgtattttgacttgtgtttagggtaggacacatgcctcgggagatttgtcatccaatggacaatgacacattctccctgggtttggaataataagcatgacatacttgtgccaagtgaatttttagaggcttatttaggatcgagagatgttcctttgaaatctttttttttcttataacctgaggagatccaaggtgacaagtcggccaccgaatactgtcgccacttccggagcatggatgatgcgatggccgacctcggcgaacctatcaccgagtgcacgctagtcctcgcactttcacgaggtttgaataaaaagtacaataatctgcaaactgtattgcccttatagcgtcgcttccccaccttcctcgaggcatgctctcagctgcttcttgcggaaatcaacaagggacaacagaccaccagaaccgccattgccttcgtcgcctccaccaacaacggttccggtggagctgggtctgtcgtcactgctgcatccagcaccaccaactccacctccgggaacggtggcaacaactgcaatcactgccatgggtgtggcaatggagatagcggcaacggtggcactgctcaggcctccgaacaaggtggcggcggcatccaagccacccactcaggccaacaggctgcgggagagtggcaactagtcccaacaccaagtcacgccgtagcacaccccttacaatccctgtgccgataccattcaaatatcaggccatgctctcagcatgctgggccaggtgttggcggtccttaaataccaaatgaaacactggacgtagtggtagggtttgttactaaccaattccacaagtgttggtaaatatttgtatgtagttgattatggatgaaagtacacctgctgtgtaacgaaattgtcctccaaacgtcagaacatcgtctcctactccagcactaaagccgagtatagagcatttgcaatgttgttgttggaacatgctggcttcaccaacttttgcacgagctgcattcacatcccactcgaaccactttggtctattgtgacaacatcactgcagttcagcaccagcacatcaagcacgtcgagattgatctccattttgtccatggttgtgtgactactcgcactattcaagttctacatgtgtgaactacatcccagtatgctgatatattcacaaaagggttgccgactgatgtcttctttgagtttcggtctagtctcaatgtccagcctgttgacgttgcgattgccgggggtgttagcatatctcatgtatatcgcatgttttctttcttttggccagtcctcccaatatccctcccaggcatgtttctataaactggttgagtaggatactaggataaggatgattatgtgcctatatgtactcggcgttgtgatcaatcgatattgtgttgagtccatcaatctaagagtctgttgggccactcctctcaggctctcacgatgcctgcgcctgcacacgctcttgcacttgacgtggccgatctcacatcagtcatggaacaccaatctatggagcttgcatgattgtgacgacacctgatctctatctgcaactctgtgtctccattttctcatcctggatccaatgggtggcggtgagaacattggggatattatggaataagttcaccggaggtccctcaatttaacaccaagattttttgagatcccttaaccacaaaacaagaaatgtgcacccctaaacttatataaaccgtgcacataaggtcctatggcagtatatgtgggtggtttcgctgacgtggcatcctagtaagcaaaaataaataaataaagtacgtggggcccacatgtaagagagaaaacgatatgggcccacatcccttgtttcttcccctttcttctcttctctcgtcttcttcgatgggccgagacgcgcggggcgacggctggcgagagcggccgcggcggcggcggcggcaggcgaagaagtcaggcgcggtggtggcaggcgaacgcggtggcggtgggcgagagcggcggcagcggcgggctaagcaggcaggggcggccggcgaagcaggcaagggcggcagggttgagcgccggcggccgcgcgtgcccaccgtggtcctccgtgtccgcctcgtcgtcctctgtggttgcgccgccggccgcgtcgttgaggcggctgctcgtcgcggtggtcttgttcacgtggccgagcagagcggacggcgggcggaggagggggccgcaacggcggaggtggccgaaggaggagcgtggcggcggtgggcgagctccgcgggcctacaccgccagccgagccgtcatcgtcctcgtcgtcggccgagccatcctcatccgcgccgagcgccgcgcaccgctggttccccctgccaactacaccctctccgcgtccccgtccgcatcctcgcgctctccgtctccgaccccgacgtcccgctcagccccgccgtcgacgagtcctacacgctctccgtcgacaagtcctacacgctctccccgccgtgctcgtccgctcgcccaccgtcgtgctcgttcgctctgcccgccgccgtgctcgtccgctcgctcgcaggccgcgctcgcctgctgccgctcggctgccgcgcggacccgccgccgcgctcgctcgctgcccgcccatcgctgctccgccctctccgccgccagcgtctacgcggccgcttcttgccgctgccggcggcaacggcactcccggagtccatggagctcggcgacgacgcgttgagcgagctgcaggcggccgagctcgcgtctttgctgctgctgctgcaggtgcaactattgctctcctgggttagcacttgctcttgctccatctgtgtgacgagctagcgcgcgacgaccaccaagattgcttgctagtggaccgccggcctcactcagtgaagaagaagagaaagaggagagataaaagagaagagaaggagaagaaaagcaaagaaaaaaaaagtactattgatatgtgggccccacgtacttttttaattttttttttactagaatgccacgtcagcgaaaccacccacatatactgccatgggacttcctttgaacggtttgtgtgagtttatgggtacacatttctggttttgtggttaagggacttcagaaaatctcgctgttaagttgagggacctccggtgaacttattccggatattattgacaggagcagtgtggagccaaatccgccgctgttgctgattgctactccatcaagggctcgagctgtgtggatcaggccgcttccgccgcttggcccactccactagcttgcctacaccctaacacagcaaggggtgggcacatggctacggtgtaggtgcccccacctaggtgaaccctcactttacagtgtagattgcaacaacaacatgtaaattacaacaacgattcttctgttaactatttcgacgaacctgcagtttaatctgaaaatttaggcaaaatgtgaccattgcagtctttttcttctttctcaaacacactattccagtcttttggaatgaccctaaagctgatcagttaattgtgaaggaaccctctacttcgcagaagcagaaatgatatttggcatatactttgcagaaacagaaacacaacttggcggtggctggtttatttagaaatctctgcttggttttgatggcaagcatggtaatttcagaattctccaattcttgttgacaaaaaaattctgctggttgaacatggtgtgatagtgatttgagacattaatcaatgatggattatctgcttgcctgttctttctgttacatgagttgtggggtgtttttctgttaaattaatctaggttgctctcttgatctgatctagacagatcctgagcaaaggttgcaattaggaaaacaaaaagaaaaggtgagagagggtgctagttgaagttattgaatggcttagtatacctgttgactgtagatcagtcaattttagttcaaatgtttattgattttgtcatgtatactgtactatggtttgtgaagaacaagaagaatttgtatttggtctacttaattgatctaaattatgtagaacttcatgattttcttcagtgcaaaacatttctaaaaaactgccaattgtagctttttttcatttttctttgtatccccataaagaactaccataacttttttttttaccttgtgcgaaatgacatatgcaattttttaacaaagaagcagtcttatatcatgcgtgtgaggccatatatcaacattttcttcagtgcaacagtcttttctattctaatctgctactagaaaatcatgtgcctcacattttacaggatctttgatgatatgaatgcttaaggatgctattttgaattgctggttttctcagcaagcaaaagttgcatggttttgtctgatcattttttattacttcacaatgatgatagataggatattgcattgtgttgtctgatttggacattcttgaactgcagccctttaaacttatatttttcatattgtccttacaaataatgagatcttctcatcaaatgtttctagacaaacactgcttactacaggggaatctctgtgctctttatccaatctgcagagatgagggtaccagggagttgtacaaggttcttggtgccacttacatattgttatatgttatactatttaatgaatgtctaaaacacaaggaataggtcccccatcatagcaataagcttctgctttatgttaaaaaaaaaacgattctatgtgtgaagctttgtgatctcataggcaactagagaggtaaaagcacatggtaaacctaggttccactggtggagaaatgctctttactcccggtttagaaccctttgtagtcccaatttttcaaccgggactacgaatccgggactaaagatcgctatctttagttccggttcaaataaccaggactaaagatcaatctttagtctcggttaataacaccaaccgggagtaaagaggggaatctttagtcccggggatagcggcagtccctcgaggtcccttttctttcttttttttttcattgttaatttgctaatggctagagttaatccctgtattttctcccaaatcgagtgggatacacatccccaaatcaacatcctaaatattaagttacttatacacacagaacaaatacatcacaaatcctatacacagatcaaatacatcacaaatcctaaaaaactacacacaaattaaatacatcacatattatacaagattatacatctcagatccatgcgatgtaatgaatcacaaattctaaaaaaaaaaatacatccagtgaaacacaaattataaaaaaaaagcaaatgagccggccgccgctcgcctgcccgcgcgcggccgtgccgccgcccgccgccccacgcctggccgcgctaccgccgcccaccgcccgcctccccaccgccgccggccggctgatgggagggagtagaagggaggaggaggaagggccgactgatgggagggagtagaggggaggaggagggaggggaggaggaggg

SEQ ID NO: 60988 - DNA, 28213 bp, Oryza sativa
tataaactttggatgtataaactttagatgtatagaaatactatatatagaaaatatttgaattcaaattcaaattcaaattcaaatttgaatcggatataattcaaattcaaatttgaaacgggtatataaacttttgacttataaactttaggtgtatagaaatcctatatatagaaaatatttaaatttaaatttgaatcggatataattcaaattcaaatttgaaacgggtatataaactttaggtctataaactttaggtgtataaactttagatgtatagaaatactatatataaaaaaatatttgaattcaaattcaaatttgaatcggatatataaacttttgacttataaacttttagtatctaaactttagatgtgtaaacttgaggtgtataaactttaggtgtataaatttactaaaataggaaagtaatacggtgccaaaaaaggaaaccaggtagagggagggaggggggagggtcgctacccccattggcagggcgatcgatcgcccattagggctgcccgtataacgcgccctataaaaatttgaaataaatcagaaccacaagttttccctcccactttatcactgcaaaactacctccattaatcaatcatagatttagatctaaatatgccactattgtctcaatgattagcttggaggtgaagataaatctcagtgttcctattgtacttgaaagagataattcaagaaataccattaacaagtgtttagatccaagaaataccatcgacaagtatgagttctaagaaatgtcattgtacaaacgactttgtcccaaaaataccatcgatgttagggttccgtccattccgcgccgttaagtactataggatgaacggtgtatttaatggcgcggaatggacgaaacctaacggcgatggcatttttgggacaaaattgtttgtacgatagcattttttagaactcacacttgtcggtgtcttttcttggatttggacgattgtcattggtatttctcgaattatctcttcttgaaattagcaaccgtaaacatactatccaagcagacttatcaattattatatactaaagtttattaaatttcctacaaacgctctcaaacgctctcaagccgccacacgggactcctaaaaacactcgtatgctgccacgtggcattttaatatatgaaaaacatctagccatcgatttttacttaaaccagtgggtctattattttagacgattagattagtattagattagaaaacgttagttccccctctcatctacccgcatgtacgtacgtacgcctccctcatcttgttagttcgcaagttacgtgcatacccatctttttatacttcctactttttccttttatatttatatatttccatctgtaataccctagcacggtagatataagttgctaatagcacgccgcagaagcaagcaagcaggaaacgcgcgcaaaccatggccaaatacaaaggggctcacgttggagaagaaaggtagcagctatgactttctccccatagtattcgatatataagctacaaagggagtagtgtgtagttggtttaaaatttatatctgtattagtaaaaaaaattatgcaattataatatgctattagcacataattaattaagttttaattattacaaatttgacaaattgaaatatttgatattttaaagcaagttttatatagaaggtttttacacggaatacaccgtttagtagtttgaaaaatgtgctaacgaaaaccaaggtaaaatttgtatcttcgtgagaaagaacagggccgagtgaaaagtttgctccaataaaaaacattccaaggaactcatatagaaagtttttttttcaaaaattgtactccatccatcccaaaacataacattttttggtggttggaacatattcttaatactatgaagctgcacaggttttctgtccagattcatagtactaacatatatcacaacctacctaaaattattatattttgggacagagatactactgtttaggagatcaggaatcgtccccatgaaaatccataatttgtaagaggaaaaaaaagggcagcgaaagttaaggaaaaaattgtagtaaaaattatgaatatgtgataaaaccttacttgttatagcatctccaaactatacaaaaccatcttaggaggtatataaacggtattctagagttagagggtgctagatagaattttatccaaagtttaaaactttagggtgctagatagaattttatccaaagtttaattggttacttggacttttttcttaaaaaaatatggaaaaaggttgaattgtgagatgctcttttcgtcctagaatatatgacatagtactgaattggacatacatattcagatccgtagaactacaatttattccatatgatcatagttattgtattttgggacacaaatagcattaagtactccatctgttttaaaatatagtaatctagtattagattgtgtctaatccagtattaagttgctataatttacaagagggagtagtacgatgagtaaatgtaatggtttttctttgaccgaaatactatgggtattgttagaaaggattacaccgtgaaataaattttaatgctataaatccttgacgaagggagagtatcctataaatctataaagttcatctccactaagtacaattaatgctaattctctcttctctcatgaagtcacatcacctcaattttttttagcccttggatgattcatcaagggtgtaaattatatctcttcacatcaccttaattttttttagcctttggatgattcatcaagcatatattgcatctcttccctctcaaaagacacaccatacaacccaatcatttataacctttgaataaactgataaaggtaaaaaaaatatgaacacatgaaaaaaatcgtatagtaggtaagaaagaaaattttagaactcatatctactatattatcctacaattctcccatagcaatgtgcggggtacccatctagtttaacagacgacgcaatacgagcgattaaataagcaaaaattgcaaaaaccaccccaaatgccactttgagtttgagatgcccccataagaagatttgatgcaaatccctacctcctaattcactttggtttgatttaggcaccttctctccacacgtgcatgattcctgaagaatctcgtggcgaaatcaactgagtcccactcgacgggagcaagagattatgttgtttgttctgtataagacgatcatttcgttgtgttatcatgggcatttcactgtgtttttcatggtatagtagctatatattccaaactgatatcatgtgtactgaacaacatattcctttttttaagggacgtaatgagcatataaaaacatttgaacatgaagcagtaatcatatagctatattagaactgcatgacttcatccgttgcaattggtcagatgacccaaaatagcaggtttcaatacagtttaatcagaaattaaaaccacttaatcaaatgcaaaagggacctattgacaaatcatcacgatgagcggaactcggctaatttcgcacgagatgctccaggaatcaagtatgtgtagagagaagtggctaaatcaaaccaaggtgaattaggaggtaggaatttgcaacaaatcttcttaaggggacatttcaaatttagagtgatatttggggtgctttttggaattttcccattaaataatggaaggacgtgtgcattgtatcgctgaattgtgggacccgtttgtcagttggccatctcttatcgttttgcgtttgcattttcctgtttctttcattctttctttccccgtcgctttcatcggattcctcgtgagtgagatgcccctggcgccggcgcgccgccggtgtaggccggtggtgggggaggcaggctcaccggagcatttaccaccaccatagaagcggggcccccgccgcggaggaggagcgcaggaggcgaggcggccgccgacgcagagttgggcggggcaaccggcaacgtcctgacggacgctgtccggcgagagcgcggcgccctgaacctgaagtgaaatctccaatgctatgggctccgaagaaatcctaggtgcgttcttgagaccgatctagaagccccaaacatttcaactgcaacaatttgtccttttcatttgtcttgcagttcttgcggctgggctcaaagttttagacctgtatagaaatttatattttgttttctttcgattgcctttgcaaatcgcaattcttggctactcagaaagtcttaccacgcaaaagattaatcatatagtagtatattgtgtgctgagttttaggtgatcttggtagtaataggaggagaggctgcatgaaatccgggcacagccgtgtggaattggtgaagaacctagtcagtagtcaccatcgattattgtctgattgtctggagataggcttgctggtcatggtaagtagggatgcaagcgggacgggcaagcgggcttgtttatcccgcttatcccacttctaattcattttttcttttaaattttgtactaccatgcgaaaaatagactagcaagcaggtttttatgtgggtagcgggactacccacttgcatccctaatggtaaggtgtatgatgtatccgtgtatgcaacttgcaaggcatgtccatattctggatggatggaccctgataaaggtactagtttgtgcgaaagagtgcagctggattccatgtgccaagatgaacatttcttttccatgtggaacgaacctctcagctaccaccatgtgcattcccacccccaaattcttagaaattagcttgcatataagttggaacggtatgaagaatgaactttccatctagccacagtcgtcatggcgcgggcaatgatgttgttgctcttctgttcctatgctctggccttggtctctgctgggagcagcagcagcagcaatgccacagccgatgagctcgccctcctgtccttcaagtccatgctatcaagcccatccttgggtttgatggcatcatggaactcatccagccacttctgcagctggacaggagttagttgcagccgtcagcaacctgagaaggtcattgcgctgcaaatgaactcttgcggcctgtctgggcgcatatcgccgttcttgggcaacctatcctttctcaagacactggaccttggcaacaaccagcttgtcgggcagataccttcggagcttggtcacctcagcaagcttcggatgctgaatctgagcacaaatttgctccgaggaagcattcctgtggagatgagaggatgcaccaagctcatgacccttcacctaggcaataaccagcttcaaggtgagatcccagctgagataggttccagcttgaaaaatctcatcaatttatatcttaccagaaatcttttgtcgggagagatccctcaatctctggccgagttaccatcgctggaactgttatctttgtcgcacaataaattatctggagaggtaccatctgctttgagcaatctcacaaacctcttgaatattcgtttctccaataacatgctttcaggagtcatcccttcatctttaggcatgttgcccaatttatatgagctcagcttaggttttaacaatttatctggaccaatcccaacttctatttggaacatttcatctttgagggcgctttctgtccaaggaaatatgctaagtggaaccatacctgctaatgcatttgaaactcttccacatctcgaggaattatacatggaccacaaccacctccatggtaagattcctgtctcgctgggtaattcttccaatctgtcaatgattatccttggcgctaaccttttcaacggcattgttccccaagagattggaagactaagaaagttagaacaacttgtactgacacaaactttagttggagcgaaagaacaaaaagattgggagttcataacagcattagctaattgctcccagttacaggttttggtattgggtatgtgtgagtttggtggggttcttcctaattcactttccagtcttagcacgtcgctaaaatatctctctctttcatataacaatattttgggaagcatacctaaggatattggtaatctcttcaacctacaagtccttgacctcgcttggaactctttcatcggaactcttccttcatcccttggtaggcttaaaaacttgcactattttaacgtatacaacaatgatcttggtggaccaatcccatcgacaataggaaatctcacagagttaattacgttgtatttgatgtcaaacacctttagtggtaggttaacaaactcacttgcaaacctgacaaagttgacagaactggatctttctagtaataacttcataggcccaattcctagtggcttgttcaacatcaccacactttctatagctttggagctatcctataacaaatttgaggggtcaataccacaagaaatagggaatctcgtaaatcttgtaaaatttaatgcagagtcaaataaattatcaggtgagatccctagcacccttggacaatgccagaatctccaggatctcactctccaaaacaacatgttaaatggtaatatcccagaacaattgagtcaactaaaaagtctacaaactcttgatttctccagaaataatttgtcaggtgaaatccccatatttatagagaactttaccatgctctcttatctcaacctttcattcaatatatttaccggagaagtgccaactactggtatatttacaaattctactgcaatctcaatccaacacaatggaagactttgcgggggaataactactctacatttacctccatgttcttcccaattaccaaagaataaacataaacctgtagtaattcctattgttatttctcttgttgcaacactagccgtcctctcattgctatacatactttttgcttggcacaagaagatccaaacagaaatcccttcaactacatccatgcgaggccatcctctggtttcttattcccagttggtaaaagcaacagatgaattttccatagccaatttgttaggttctggttcatttggttctgtgtacaaaggagagctagttgctcaaattggtgaaagcccatattatgttgctgtgaaggtactaaaacttcagacttctggtgcgcttaagagttttgccgctgaatgcaatgcactgcgaaacctacggcaccgaaatctcgtgaagataattacagcctgctcaagcattgataacagcggcaatgacttcaaagcaattgttttcgactttatgcccaatggcagtttagaaggctggttacatcctgacaaagatgaccagattgatcacaaatacttgaatcttcttgagagagttggcatactacttgatgtggctaatgcgctggattatctacattgccatggaccaacacctgttgtacattgtgatctgaaaccaagcaacgtgcttttagatgctgagatggtagcacatcttggagactttggacttgcgaagattcttgttgagggcaactcattgctccaacagtctacaagctcaatgggatttagagggacaatcggctatgctcctccaggttagccttttatttttcctgtcctcctttcttatttagtcctgcctagtgcttttattaataaaatgtacagctagacaaactttttgggaagttgcaaaagaagtttgatttatgtgaagcagctatagttattatgaatctgttacattttggattacaagcgctataaaaatcgtaactttttttttggcaaactttgattaaacagagtatggtgctggaaatacggtatcaactttaggagatatttacagctatggaattcttgtgttagaaatggtaactgggaagaggcccatcgataacaaatccatacaaggattgagcctccgtgagtatgttgagctgggtctacatggtaaaatgatggatgttgttgacacccagctgttcttgggccttgagaatgaatttcaaaccgctgacgattcttcatgcaaaggaaggatcaattgcctggtcgcattactcaggcttggattgtattgctctcaggaaatgccgtcgaatagaatgttaactggagatattattaaggaattgagttcaatcaaacaatccttgtagggaacacataatatatcttcgagctgaatgacagtttggagttcattccttgggtgttcatctcttaccctttcataccttgttggtttatgcatagtacactgaagtatactgttatcacttgggatttggacatctgagcgcaaaaactgattgccatgcagttgtaatcatgcctgtaaacatatccgtgatttatgtcttttttgctaggaaaagcatttttccagtcatgtactttgtccagacataataaattactacgcaactttgtaatttgtgatcgttacaacgagtatactatgtcgtgcatctctctaacaataaatatttagtagtttataattttataatcgtgtttagctgctgtacattcctttgtaaacacggttttgaaacatcatctccgggcaacattgatgcaggcaggcgagcgtatcactgagactgaaccgtgggaccaacgtgtaagtccctccttacacgtagaccggaggcgtccggtgaccagggatgcatttgcccgggtttttttttcgcttattcgacttgtagtttatacttaacccacttttagtttattttttttctaaattttgtacaccatacgagaaataaactagcaagcggtttttatgcggataatgggaccacccacttgcatccgtaggtagtgctgccgtcgtccgccgcctgatcctgacgtcgtatatatttttttaaaaaaattactacagcttgaatgtctgtggatctactggtagaagagtattcggtgggttcataagacctcaacatttttgcttgcaattacaaaattgtgtatcaacgtcagcaacttggataacacacacgtcctgtgcatttctgcagagtacgtggttagaatttggctagatgtaagacgctcattcttggataatatactaccaaaggacctttgtactatatgaatctatgatgaatctaggagagcataactgttcaagttccatgcatatttgaggaccggtaacgtctgatttgcactttgtgtgtcgtcagctgtttttgctggggccatgtttttcacgttgcatcaagggtatcatcatccatgttatgcagctttttttgtctgtatgaagtgtggccaacttaattaattacatggcaggtctgttaacaaacaactactactccctccctccctccctattttaattttaatgtatgacgccattgatttgttgaacaacgtttgatcattcattttgttcaaattttttatacaaatacaaaaatatttatgtcatgcatgtttaaagaacatttaataataaataaagccacaataaaatagatgataatcacataatttctttaataaaatgaatggtcaagcgttgataaaaaagtcaacggcgtcatacattaaaaaacagagggcgtattatttatgtacaacattcatgattatggtatcaatatgacatttttctaattttaattcatgtgtccattttaagcttgacaccgtaccgtcacggaaatcaaagcttgtattattgcatgattaattaagtattagctaatttttttttaaaaaagaattaatataaatttttaaaataactttcatatagaaagtttttgcataaatcacaccgtttagcagtttgaaaagcgtgagcacggaaaacgagaagatgtgttggggaaatggggaaagaacacagcgtaagtgcctattatataatactacctcatgtactaaattttatactagaaagtatcttgaggtaaaaaaaattagtggtaccacgaggtataaaatgttaaacggtaaaattgctcgggataaccgtacgtgcaatgtgtccatatgcgtgtccaacacggtcagataagaaagaattacagggctagtagtcagtcgatcggtctcgcacgcaaagctatcagtcgatctgtctcgcacgcaaagtcatcagtgtcaagcaaaaaaagcatctctcattcaaagtactccgtttgatcgtcgtcagatcgtgtactgcgtgatcgttggtgcagaaccgttctcatctgcaaaaaggaatctgcgaaatttgaagggaacatattgagcaatgtactaaatttttcttactaaacttttactaacaatcatatcaactgtttgatttaagtagatggaagttaaaaaaaaatctagatacactcatagcatgacacatcagtgttagtaagaatttaataagaaaaagttagtacgtatagtattttccgaacatatatacgtttcgagttggcctcttatacttctcctgggaataacccaactgaatggacgtatggattatggattatctgactacaaagtgaaaagtttgctccaagaaaaatattccaagctaaggaactcatatatagaaagattttttttcaaaagttgtacttccaccgtcttaaaatatagcaatttttaggccgatgagatatatcctaagcctgtccagattatagaaataggatatatcgtattcaataaaaaaatattatattttagaacagagataagtattatttaggagacaggtctctttcccatgataattcatattttgtaagaggggaaaaaacagggcagcgaaagttaaggaaaaaataatagtaaaaaatatgaatatgtgataaaccgtacgtgttatagcatttccaaacttttatagtcaaatcaaataatataaaaggaatctcgctcaagaagtcaaggtcgaacatggcttcatcataactaatgagccgtatgacaagcgtatacatcaccatcttcttttcggactatcactatcaacggggatagaaatatcttaccacaaatttgagaaccaaaacttattttttaaaaatggattttagttaaatttgacaaaaattcaaatggcggttccacctctctctatatatgtaaatcacctcaaacttgattgaagttgatgaaaaaatataatttagtttctatggagaggaaaaatagagaaataaagatggccctctgaaatttcattttaagtttggttgcaattcattaaaataattttaaaatgttcccttgtagtttcttgtaaatgaagttttcacattcacaattttggttttacaaggattctgattgttagtggtgacggccggggtgtcatcttgctgctcccactcccagcacatccctcctggtggcaacgcgaactccacctttggagcgaaggagggaagaaccaaagaagatagatgggagggaaagttgaggggtaaattttgatccttgagaggatatccatcgtttgtttagaaacctcatttaaacggttatgaaaaatcctagaaaattttgataacactcatacaacatatctatacaactctataaaattttataggtccaaactcaactcacacgtcgagatataaaaaaggataaattcagcgtatgaatagtagcgtactatttacatctgaatttgtctttatttttgtttctcgatgtgtagatcgaattggagcttgattttttatgaaccgatatatatcactattctagcattgtcaaatttttaaagattttttataactatttatatcgaatttggaagaaaaagatacttgatgggatattcccttaagagattactatccactctcgggtactaaggttatttctcacccagattgctgagttgacagccaagaatggcaaaataaaaacaatccagtcggtccagatcgacctgaaaagaaaatttttggatgtcacatcggacgtttgaccggatgtcggaagagattttcggacacgaataaaaaaactaatttcataactcgcctgaaaaccgcgagacaaatttattaagcctaattaattcatcattagcacatgtgggttactgtagcacttatggctaatcatgaactaattaggctcaaaagattcgtctcgcgatttttatgcaaactgtgcaattagtctttctttttatctatatctaatgtttcatatatgtcttcaaagattcgatgtgacgtttttgggaaaaaattttttggaaagtaccgggcctaagtcacttagtaaaatggtatttgggaatatgctctcgaagaaaagagagtggcaaatagtaaaaaagaaaaatgccggaaagagatggagtgagaacatggcagcacacaggaactttcctcttaaacagatagtctaatttcctatatatcatttctccgatatgtccatgtactcccttgtacaattctgcatatatacatgctccctctatatttatcgacatagtttgatcatttgagagattatacaaagctagccttgcagcacaagctcgatcatggtcgacatggctggagaagtagcattcatctgcctcttgctggtgtgcctctgttcccactctctggctttgtctcctcctcctcctcctccttcttctccggtgagcagcaacgacgcaacaaaggccaccgtcgacgagctcgcgctgctctccattaagtccatgctctcgagcccatccagctcgccgctggcctcatggaatagtactagttccatccatcactgcagctggccgggcgtcgtctgcagccgccgccacccgggccgtgtcgccgcgctgcgcatggcctccttcaacctgtccggcgccatctcgccgttcttggccaacctgtccttcctcagggagctggacctcgccgggaaccagctcgccggcgagataccgccggagattggccgtctagggaggctcgagactgttaacctggccgccaatgctctccaaggcactctccctttgtccctgggtaactgcacgaatctcatggttcttaatctgaccagcaaccagctccaaggtgagatcccttctacaattggcgccagaatggtgaatctttacatattggacctcagacaaaatggcttttctggagagatccctctgtcgctcgccgagttgccatccttggagtttttgtttctgtacagtaacaagttatcaggagagatacccactgctctcagcaacctctccggcctcatgcatcttgatctcgacaccaacatgttgtctggagctatcccttcatctttgggcaagttatccagcttgatatggctgaatctagccaataacaacttgagtggaaccatcccttcatccatttggaacatttcttcatctctttggggccttaatattcagcaaaacaatttggttggagtggtaccaacagatgcattcaccgcacttcctgaactccggacgatatcaatggacaataaccgatttcatggccgtctccctacctctctggttaatgtctcacatgtgagaatgcttcaacttggttttaattttttcagtggcactgtcccttctgagcttggaatgttaaaaaatctggaacagttcctgctctttgccactttgcttgaagctaaagaacctagagactgggaattcatcactgcattaacaaattgctctcggctgaaaatcttggaactgggagctagtaagtttggtggggtccttcctgattcactctccaatctttccacttcattacaaactctctcccttcaatacaacacaatatcaggacgcatacctaaagatattggtaatctcattggcttacaatctcttacactagatgataactctttcataggaaccctaccttcatccttgggtaggcttcaaaatctgaatcttctatcagttcctaagaacaagattagtggatcagtcccactggccattggaaatcttacaaaacttagtagtttagaactccaagcaaacgcctttagcggtgaaataccaagcactgttgcaaaccttacaaagttgtcagcacttaaccttgctaggaataattttacaggtgcaattcctaggagattattcaacatactcagtctctccaaaattttggatatatcccacaacaatttggaggggtcaataccacaggaaattgggaatctaataaatcttgaagaattccacgcacagtcaaacatattatcaggtgaaatccctccttccttaggggaatgccaacttctccagaatgtctacctccaaaataacttcttaaatggtactatttcatcagccctgggccagctaaaaggtctagaaagtcttgacctctcaaataataagctgtcaggtcaaatacccagattcttagggaacatcagcatgcttagttatctgaatctttcattcaacaacttttccggtgaagtgccagatttcggtgttttcgcaaacatcacagcattcttaatccaaggcaatgataaactatgtggtggaatacctactctgcacttgcgtccatgttcttcaggtttaccagagaagaaacataaatttctagtaatttttatagtcaccatttctgctgttgcaatactaggcattcttctgttgctctacaagtatcttaatcggcggaagaaaaataacaccaaaaactcttcagaaacctcaatgcaagcgcatcgttcgatatctttttcgcagttggctaaagcaacagagggattctctgcaaccaatttgttgggttctgggacatttggctctgtgtacaaaggaaaaatagatggtcaaactgatgaaagtgcagaatatattgctgtgaaggtactgaaacttcaaactccaggagcacacaagagcttcgtcgcagaatgcgaagcactcaaaaatctgcgacaccggaacctagtcaaggttattacagcctgctcaagcattgataccagagggtatgacttcaaagcaatcgtttttgacttcatgcctaatggtagtttagaagattggctgcatcctaaaccagttgaccaaactgaaatgaaatacttgggtcttgtccagagagtgactattctactcgatgtggcttatgcactggattatcttcactgtcgtggtcctgctcctgttgtgcactgtgatattaaatcaagtaatgtgctcttggattctgacatggttgcccatgtgggagactttggcctagctaagattcttgctgagggaagctcatctctccaacactcaacaagctcaatgggattcagagggacaattggttatgctgctccaggtaattatctttgctttatgactttacatggagaccatctttgctcagataaagcttggctatagacaaattcatggtgaattttcagaagatatattattttactttcatgtgatttctctcctagtttttttctttatatcacttaattttaaatttcataacaagtagcaggcctgatgttctttcaatgttaaatggaacagagtatggagctggaaacatagtatccacaaatggggatatttatagctatggaatacttgtattagagacagtgactgggaagaggcctactgataacagattcagacaagggttgagccttcgtgaatatgtcgagcaagctctccatggcgagacgatggacattgttgatagccagttaactttggagctggaaaatgaatgcgcattgcaggattcttcatacaagagaaagatcgattgccttatttcacttcttaggcttggagtatcctgctctcatgaattgccattgagcagaatgcggacaacggatattgtcaatgaactgcatgccatgcgagaatctctcttgagagaatacaggattgaagatggaagttatgtcaatgtaacattggaatgatcatgtggagataccatgcagcggtaatttttaaaatattgcagacattgctgtactcccttttaaagtacacaaattttactatggtctctactagactgtaggtaaaagatacgacaaacatcttgttattttttcatctgagatggagggagtatttcagaccgactacatctgaaatactcatttctgactaaagtcctgataaaaataaaaaaaatttgcaccatatatagattaagcaccaaatactttctctgggttttacaagttgtgaaccagtaaaagtattcgaaaaaaaaacactctgttttcagtttcctccaaaattttataggattttcacatgaaaccgttcaataccttaaagttcgtgcgaaattcctccaaaccgaatagcacccttcaaggtttaaaagccaaacaaactctgccagaatgacgtgtctgattgttggcttgtcgtagtccgccaaaatttgaaatttaaacttcatttaataacttcagagtttattttggtttggcttttaaaacctgataacacggcatgaattgtttttcgttgcattatttataaaagtttagctcatgaattgtttttcgttgcattatttatatttatacggcatattggcctacctcaaccaatagaccatagctaattgagacaaacgaaacagagcaggctagagctcaagtattcaccctccatgccatttcagtgcgacaaaaacagcgaaaagaccactgtcaagttggtcccacatttcagtgcgcaatctttttctcttataattaattaaccaacgatgcctccaatctgtcatgaaatggttttgggcaacaagagttcattagtacaagttacaacctccaacagaagtactactacaactacaagtcacaagaaactaaatgataaatatagattggttagtgggtataaatataatttaaggctgaaaatgccataagcaaaaacttcagtctaaaatcatcgaaattatcatgcgaattaaagtatagctttgtttggtagtttggtatcatgcagactgtacccagaaatgaagggaatactcattttgcttagtactcttgtataaaattatcaaaggtatatgccagactgtagaagcatgactgcaactggccacactgtaaacaatttggatttgatccaaattaattgcatcaaaagaaacttaacagaaatatttattcagtggaccatcagtgatccagttatcataggatacaaatggttggaatgaccactacaggactcagctccagatacttaagagggagctcaagaatatccatgacagatttattagaacataaaagtatcccagcagaaaaataaaatgcagtgtcttcacttttctgtaccctctatttccagcaatagagattccttgattccatgcagttccttaatgatctctccagttgataatctactcgatggcatttcctggagcaagaaagtcctaatctaagtaatgaaatcaggcaatcgatcttttgcttgcttgaaaaatcataggtgtctcaggatcatgctgatcaatgcccagacacagtttgttgtcaacaatgtccatcattttaccatctaaacccagccttatagactcaacgccgacaatggggctgtctaagaagacagtgagtgccagcatcactttgctttttagccctaagaagcccgaggaatcaaagattccaattccaaaggaagtgatcgatcatttcataaagtgtgcacaaccttagccacccaagaaacctatatcggacttccgaagaactattacaaaaacaaggatctgcagactcagtctaaggagttgtaacttgcagagaaagcggacgagacagctgcattctgtaagtcaaccagtctaaacagccttgacgatctggataatcttgaggaggccgaattggtactgcagttccaacatggaaaactcatggtgcttgaatcggaacttggataattaggaactcaagcatggtggctgcataattggtatttggaggcggctgctcagggtcaacaaatgattggagcgtactacactgacatcgattttcaccacgcgcccaatacatgttatttggaatttaagcacaggtggagaaacgttttttacttccggttcgtaatccctttagtcccggttttccaaccagaactacgaatccgggactaaagatcactatctctagtcccgggtgaaataaccggaagtaaagatcgatctttagttaccaaccgagactaaagataggttacgaactcttcagcgtgtatgaaagaagagagctcgacatcagcgtcctccaaatgtggtcaatgtaagtccttcatatcctataattaggcttagtgattttgaaccgtgttcttcttttgcaggcattgctcttttgaatgtcaaagcaaaaaccttaagattgcttttctttacccagtggttgtgaacttcgataggcaattgtccaaagaagctgaaatcgagaactatcacttggacgccctcatcaagctcaattcctgtgaccacatcatccttccttaccttgctcaataagtgaatatcattaatttcaaatttgagttgctccccacgcgtataaagttattgatacattgtcctatgtgtagccattattgaaccctgatcgtaatcaatatcgacgatagtaagattttcatatatgacagtataagggcagtcccaaccctccacctaggatggtgtctatggcattaactacattgccatgtaggatttttacttatgtgtcactatattaattaagagagagagtgaagagaggaagaaactgggtctcatgtaagacacagcttcaacacaagaacttatgcactaaacactatcaagtttcgcattgggagagaatagtgtcttcataatagatgaagaataaatatgattggtagagaagagagatgatgtatttattaatggcccactttaagaaaccatgggttgtagagtatagtttctattatgatgtcttattgacatggcaccataaacactacttatggacactatgggttgggactgccctaaggaaggagagagcgcaccaccagtgtcttatcaatttattaaataggacatatatgagataccgttggtccggaagatcatatcgtagatcctaggtggatgcaataacattttggccgggtattcaaacatcaatggatccatagacagccacctgccaccaacctttgcggcttctacgtcatggggtccctgcacggctgcaccctaatgatgaggtatgctatttttcacaggaccatgccaccaacctttgcggcttctacgtcatggggtccctgtacggctgcaccctaataatgaggtatgctatttttcacaggaccaagtcataaagtaaacaatgtttttctaatactaagttttacgccttcctcccctgtgttgcggaaattgggtctcgacacatctttacaggtatcaccaaatgagctctgtgggttcattcataatcatattatagacccagctggcgaggacaacgtcaacaaagaaccaccagtatcacaatcactaggtgaaaccccgcgtgttgctgcaggagtttactataacactaagtaaaactaatgcgtaagatagctagacaatataaacttacataagttgatgtggtttacgataatttaaatttaaataatgtatagaatgataattcaaatgtaaaagtaaggtgatgcggctttaagagagaaaaaggagggagatagtttggaccatagattaatcatcttagacgacttaatgagagaggagagaaaaataacgctaagtgaggataaactatataggaatgtttagatttagtaacctttgacttaggatatactagaaaatgggcgcgtcgttggcacgccaactaatataacccgcggatattataatctatttatttagaatgtatgaataatatcatgttaagttatcatattactttttaagtatatatgaactggaataagaatgaatcaagcgacggtaattgtggtgttatttctcatatttatgttttgagaaatataggaatgtttatttactgataaacatatcacactaagattagcataatttggacaatgattttaatgtttatcttagttgtgcagatcaagcatcaggctagctattggagccgcatcttacatagccaccgcatcaggccatcacctcatgatggaatccactcaacctcatctgtgggcaggtgcgacaagatcaacatcaaacaacggcagaggcgcgccgggccaagagctcttccggcgttgttgcagtgcatcacccacagatatgacactgggttggcgggtagatcgagtgctttctctaggatttttcccttccttttttacatttttctactcacactgatttttttattagttttgatcgattgaagacgacaaatgggaacttcttctttcatgctttgatgtctatttttatttcaatttgaagagattgcaagggatagtaagtttggaatcctctagaatttaaatgaatgtttgcacgggagactacacaaggttctccaccttctctcaatatagacacgtggcagatttaggaggggttcaaacccaaatattagggcgccatgtggcccaatgggatgccagggattggaccttgaaatcggtattaaagatatgcaaattttagatttaggaatggctttggactttgttattttacacctaggaaggtttagacttataattgttgacttaggcatttactcttttttaacatttctatgtgttgatatatatgtgaatgtggatgtcgatgtagatgtggatggggttgtgggatgtaaatttggatatggctataatgtgaatgaatttgtgtgaatgtgaatgaatgtgattcgaggcaaattctgttatcgtatgatttgtatataaaattggaaggtcctgcccttttttttattgtcaacatataggtgccggtttttacatataagccggcacatatactaattgccacatgtccagttcagttaaaaaccagcacctatatgctacttataggtgccggttttggtaaagaaccggcaccaatatggtcagccacatggcaagttattttagaaccggcacctataattatacatatataggtgtcggttcttgggtgaaaaccggcacctatatctaggggtgaaaatggcacgggtattgcctgaccacccatcggacccaagactcacgggaggaatatatatgggagaaaaaaatgagatactcgatactatctgagttcgaatccaaattcgttagaaaatatgggttaggatacgagaagacgtgtatccgccccgtatgtcccatgttataaaacatgtatgaaaatctattataaatcaagctacaaacatgataaaagatagattaatcactattttacgagctcacatgtaatattgtataatttttctctttatgtatctcttttaatactttaattgccttattatatttaatatccatgaattagagatacaagcagatatccattcctgaatccaattcaaaggaaacaatatgggataggatacatgataagtccgtatcaggctccgaatttaaaggaaaatatggtttaggatatgggaatgtcatgattcaaccgtacccgtccgttttcacccctgcttatatctcttaaccgatgaccgaaattatcggccccacctactgggtgtcggttacctaaggggttcctaaccggtaccaatgagttttctgtagtagtaatatttggtaatttccaggagtatcgaagcagaaatcatacatagcaagcaaaagtcgttgagcaacatgacaccaattgttccacttgcaacaacacggtttcatcggttctattttctcctgcatgtacgaacactcttaataagtttaataagtgtccgtagtttctattaaagcaaaggctggattttaagtttgtatggaaatcgcgagacgaatattttgagcctaattagtccatgattagccataagtgctacagtaacccgcatgtgctaatgattgattaattaggcttgataattcgtctcatggtttccagacgagttattaaattagttttttcattcatataaaaaaacccattcatatccaagtgatattccgtcgaacgttcgatgtgacacctataaaaactaaacgcaccctaatttaaagaaccgagttgtgaggtctatactgatagtcaagtcaacgcccaactgcgacaatcgtatgtacgccaacttggacgtgccattcaattcggtgcaatgcatacgacggggcgacgccttcgttatcttatcagtcacacgctagctagggtcatctaattaaaccagccgacgacttggatctttcaaaaaaaaaaaccaaacagctgaccacatccgatcgactttgactatggtcataggttgcgttatttaaaattgatgaatgtaattacatactaaggccctatttggtagggctccaaaatctaactttgagctctaaactctaacttcagtgatagctagctcctattagagatgaaaatttgttgaaaaatgtttggctacgttttagctctagatctggaaaaaaaaaagaaaaaaaacagccgtcggccccaggcgcgccgccaacccgccggccgcttgccgtccccaggcacgccgcccgtcgtctccgcgcgtgctcgcgtcgatccgccggccgcgcgacatccccaggtgcacgccgcccgccgccgccgccacccccgcagctcggttgggatcaggaggaagatggggaggagagagaacaggagaggagtgaagggtagttgagtggtatttttgtgtaaatagacttaaaagattaaagggtagtgggtcttttgggatggagtgaagcaatggagcagcaaaactccaactccacccctgtagttcattttctaggggtagctctgctagatctactccaaaagacgaggatctgtaccgtttggcaattggcacagctctggctcgaagtaagttagagttgggagctcgaaacgggcaacggtggatacagtggtcccgggaccacctgaaaaaagggcgatcgactcactattaaaaaaaatagcgactattgaaaagaaaaaaaagcgatataatcccccttcccgactcccgacgccctaactatggctcacaggtcccacacgtgagtcgcgacgtgcgtgtatcgaatcgatcgacacaactctctctgtctctctcctcatcgccctagcccgtagccccgggccatagcccatagcgaggacgccgcgacgcgagcagccgatcacggaggcagagccacaccgccgccagccgcccagcccatgcgcgacccggagcccgcgcccccacgctcgcgccgccgcaaacggggcctatatgttataaaactaacaactagttcaaacacaagttacctaagaaacgttgatatccaaaatttttaaagaaatcatacttttgaaaacatggcataaataatccgcacaaaaatctacatatgtaatctaaaacgacagtgcttgattatttatatactacttcaaaaaagatagtgatgatgttagtaaatctgtctccccacttactataattgtagtttagaaaattatcccttaatttcttaatattaaaaaattcaaatctaaatagataatgacatataaaatcaaatcaaatcaaatcaaattaaatattccttataacaaaagatggctaacatatttaattaaaagtatatttttgtttatttctggtaatattataataatattttcttttattccaagcaaagtatgtaaggtcattcctaattaagctataaagagttgctaaggtcattctggtcattcgtaagtataaattgagctaagagggttggccgtgcacatacagaccgccgatgctgtcgtccactattagtctattactccacaagtagtatctctacgtgtgccccgatgaacatgaatcccaccagtaagccattgctcctcctcggcagccttctcctcctagctgccagcactttacccctgcaggcaacgaccgcctgcgtgccacgggaatgggatgccctgttggccttcaagcgaggcatcaccagcgaccccttaggcctcctcacctcatggaaggaagacgatcatgactgctgccggtggagaggcgtcacctgtagcaacctcaccggccacgtcctcaggcttcacctcaatggcggatatgaccttgaccgtttcgagttggttggtttggttggagagataagccctcagctgctccacttggaccatattgaacaccttgatctcagcatcaattccctggaagggccaagtggtcaaatccccaagttcttgggctctatgaacagcttgagatatctgaatctctcgagcataccattcaccggtacggtgcctcctcaactcggtaatctttcaaatttgcgatatcttgacctttccgatatgaagggaggtgtgcacttaacagatatatcatggttgccgcgtctaggatcgttaaaattcctcaatttaacttacatagatcttagcgctgcatctgattggccttacgtcatgaacatgatcccatccttaagagtcctcagtttatcattttgccgtctccagagggcaaaccaatcactcacacacttcaacctcacaaaacttgagaagctcgatctgtccatgaattactttgaccacccgtatgcatcttgttggttctggaacttaacaatcctcaagttcctcgatctttcacaaaaccgtttgtatgatcagctaccaattgcactaggagacatgacgtccctcagagtccttagaatttcaaataacgatttgggcagtatggcaccaaacttgctgaggaacctatgtaatttggaagttctagaccttgatgagagtctttcgggagggaacatgacagagttgtttgggagtctaccacaatgttcatcgagtaagttatcggaattgaaaatgtcatacaataacatcaatggatctctaccagcagggttgttccgacagtttcccaaccttgtcactctcgacatgtctatcaacctaatcactggacctctacccgttgagataggtatgctcgatagtttgacttatttgaacctacgtggcaataacctagaaggtgtcatcacagaagaacactttgttagcctaaagagtttaaaatacatagatttatctgacaatcaattattgaagattgtggtggatcctggatggttagcaccatttacattagaagaagcacgttttgcatcttgccagatgggtcctcgatttccctctttggctccagtgtcagttaatatttcgtacattgatatttcaaaagctggtataatcgataaacttccagtctggttttggacaacagtttcaaaagtaaaagacttggtcatgtctaacaaccaaatcagtggtgtctttccagcaaatatggaaaccatggctatggaatatcttgatatacgttcaaacaaactaagtggtcaaatacctctgttgccgagaaacctttcagcattggatattcacaataactccctatctggaccgctaccatcagaatttggagttaatatatacatgctaattctttcccacaaccatttgtcaggccatattccagggtctttctgcaaaatgcaatacctggacaccatagacttagcaaacaatctttttgaaggagacttccctcagcaatgttttagcatgaaaaacataaaagttcttcttttaagtaacaacagattcgctggcacattcccagcttttctagaaggctgcatacagctacaaatcatagatctatcaaggaacaatttctccagcaaattaccgaagtggataggagacaagaaggatttagtgttgttacgactaagctataatgctttttctggggttattccagacaatatcacaaatctccgaatcttcgccagttggacctagcagccaacagtttatcaggtaacttaccgcggagtttcacaaaattagaggggatgaagcgagaggacggctacaatgcttcaggttccgtacctgaagatggcttgtcatcaaactgcttaattggtggaattcccgaacaaatagcttctcttgctgctttgaaaaatctgaatttgtcaaggaataacttgaatggaaaaattccatacaagattggatcattgcagtcactggaatcgctcgagctctcaaggaacaatctttctggagagatcccatctaccctatcaaatttatcatatttgagcaatttggatctgtcgtacaacaatctatcaggaacaataccctccggatcacaacttggcaccctatacatggaacatcctgatatgtataatgggcaccattggtctatgtgggccctcctcttcgaaggaactgctcgggagatattgaaccaaggcaacatggctatggtgatgacaactattgttcaatttggggaatttttctagggttagcttactcagctcaccccttccctcatctattctattagcataacactttacagataggtccttagtacaacacatatttacaccaacactcctcctcaagatgggcaaagatatcaatcatacccatcttgttacatattgattgaatctcactaggacctaacccctttgttagacaatcagctagttgttcacatgacttaatatactccaacctaatcaccccgctatcaatcttctccttaatgaagaacctatcaatctccacatgtttagtgcgatcatgctgaacagggttgtttgcaatgctgatggctgatttattgtcacaatgaagcatcacagtgtcacttcttagcactcgcaattcagtcaacaagctcctcatccacaacatctcactcaagctcaaagccatagctctgtattctgcttctgcggtagaccgagccaccactgcctgcttcttgcttcgccaagaaacaagattaccaccaacaaacacacaataacctgatgtagatcttctatcatccatactactcgcccaatcagcatcacaatatccttccacatttagatgcccattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcacgacacccaagcattcctatatctgtcaacagatccaaaacatacttcctctgagagagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagatagtgtgatctccattacactgagaataccccatatcacacactgcatgcctgaacctatcaaaccatgcacgtggagactgcttcaacccatacaaggatttcttgagtttacatacttttccaactgtctggctattcccaaatcctggagggatctccatgtagacctcctcatgtaaatcaccatggagaaatgcatttttcacatcaagctgatgaaggggccacccaaagttcaccgcacaagataccaaacctctcactgtacccatttttgccactggtgcaaatatctcatcatagtcaattccatatgtttgactgtagccttttgcaactaaccttgctttatacctat

SEQ ID NO: 60989 - DNA, 740 bp, Oryza sativa
ctactgagcctagatgtatattcagtccatgagcttgttattcagttaaggtcatgtagtagctactctatttttgttattgaattagaatgtactagctcctccatcccaaaataatatcatctttgcctcctcttgtttgtcccaaaataagttaatctttcaagcaatcattgtattggagtttgtcatagtgaggaacaaatgcattgtgactaaacaaagtggaagacaattgcattgggatttgatgaagtggagggcattgcagttttttgcttttgtattgatatgtgtgggatgggtgaaaaacgaagttattttaggacgaagggaatagtagctttctttatttttgttattagtgtataacaacgttttgtgttgtcttattcagatggaaaacatacggccaaacatgttctcgaacatacctcagcggtatgtgggaactaaaagggcagattctttgtttttcatcaaggtgcaagtcgcatcaacagattataaggttcagataaaggaacatttggtgaataattgtggtatcagaagtaaagctgtcgacaaatggtttcaagcagttactgtggccacaggatttacagctgttgaggttgagaacttctactacattctaacatgtgcccatctatttgaatatttctattcagctgagatcaaagttgactgtgacaaattaaattcttggtttaacattttgatcatatgccaacact

SEQ ID NO: 60990 - DNA, 585 bp, Oryza sativa
aatggaaaagaaaagataaaagcaatggatttgtatataaaattagtgaacattataagattctattgggcaaaccccacctctatgatcttacaattctaagaggagggaaaataaatttgaaaagaaccaacatgtttaagaggaggagaaatgagaagattgaaaagatacctaaagcgaggcttgccattaattgagtattaattatttaaaaatccaaaaaatagatcaatgtaacttttaagcaatttaaatttaaattcatcgttaaattgtttggaaagcatgtacggaaaacgattgactattcctctaacctctttctcaaaacgcagcccaagacataaatttaagcccaataacgtgatgcacccggcccggtccattaaacgccaaaagtctatgacatatgggtccacatttgtctatgacatgtgagtccagtggcaaaaagttaattgccacatctaaatgtggcaaatgggtaaatatctcccaaaagtcggctacaatcctcgcgcgtcgccgccatagccctctcttcttcttcctttttgctattccattgtttttttttttttt

SEQ ID NO: 60991 - DNA, 21923 bp, Oryza sativa
gataagccttggcaaggtctgaacatcccaatctcacccaaggaacgcagcttcgtggcggcgtccacggtgtgtatcttgggcaatggtgaatctgcgctcttttgggaagacaactagctagaaggatactctgttcgctcctttgcaccagccgtctacaactgtgtccctgaggttcgagcatttcaaacgtcgcaaaacgatcgttgaggcacttcaaggtagaagatgggtcagagacatctatggagctctagggatccaagcgattctcgagtacctccacctttagaccactctaaactcgatggagctattgccggatcaaccggactccctctcttggaggtgggactgctcgggggaatacacctccagttcagcctatcgagcattgttcctaggaagagtctggtttcagtccaaaccaatctggaaattgatggcgccccgcgatgccgctacttcttatggttggttgctctcaacaggtgctggatcgtggacctcctccacaaccgtggcctcccacacctagaccgttgcgtcatttgtgatcaacacgaagagagcatagaacgtggctagaggttgcgaaggcaatgattgctgaagcggaactctggcgtttggccaacgcggcaattccggcgttgaatgtccagcccctagtcttctctaggtcgcacaatactcgtgcgagaataggtctagcttagtgtttttggttatcgcttgtatcccgtcccttattttttttttcaattttcccagtaaataacttttgttcctcataatacaaagatgcgctccttgcgtattctccaaaaaaaaaaaacgtaagcaataacttacccagtctaaaatcgtcgaaattatcatgcgaatcaatgtattactttgttatgtactttggtactccttccgtttcaggttataagacgttttgactttggtcaaagttaaactatttcaagtttgactaagtttatagataaatatagtaatatatataatactaaattagtttcatcaaatcaataattgaatatattttaataataaatttatcttgggttgaaaatattactacttttctctacaaacctggtgaaacttaaaacagtttgactttgattaaagtcaaaacgtcttataaccttaacggagggagtatcatgcagactgtaaccagaaatgaacaagggaatattcattttgcatagtactcttgtataaattatcaaaggtatcatgcagactgtagaagcatgactgcaaccggccacactgtaaacaatttggatttgatccaaagtaattgcatcaaaagaaacataacagatatttctgcagtgaacatcagtgatccagttatcataggatacaaatagttggaatgaccactacaggactcagctgcagatacttaagaggagctcaagaatatgcatgacagatttattagaacataaaagtaacccagcagaaaaaagaaatgcagtgtcttcatttttctgtatcctctatttccagcaagagagattccttgattgcatgcagttccttaatgatatctccagttgataatctactcgatggcatttcctgggagcaagaaagtcctagtctaagtaatgaaatcaggcaatcgatcttttgcttgcttgaaaaatcatcggttgtctcaggatcatgctgatcaatgcccagacacagcttgttgtcaacaatgtccatcactttaccatgtaaacccagacttacagactcgcagaggctcaatccttgtgtaaattcgctgtcactgggcctcttcccagttacagtttccaacacaagaatgccgtagctgtaaatatcaccttgcgtcgacacagtattcccagcaccatattctgttgcatcgaacattccccagaaatattagaattcttataacttgtatagctataaatttaccataagttgtactgatatacaattaggtaaaaataaaaattcaatgcttcccctaaaactaatttcatctgcaaatggcccataatattatgagcctcactccggtgctttctacttatagtagaaaataatccgagccgttgatcgtatataatcgtagggttgagatctaattctactaccaccactcatagtggtagtagaaacgtggaggggtatatttgtccatagataataattcatgtaagggtattatcgtaaattattattcagtaactctaaaccttcgccattctcaagcggctgaccccatccatcgttgacttcgtcgcttgtccatctccctctccgcctccatcatctccagcgcgatcgacatctcctccccctccagcgaccaagggtggcccttctcctcttcgccaagccgctgaaggtccttgcccacggcggacgactagtcctgccatgtagctttgaccaagacaggagatcgccgggcaattggacggcggacgaaattcaacgggttccggcgaacggcggcgaggtaggaggaatgggcaactgggaatgaacgagtgtagtatggggatgtggtggacggctcggattggccaagaaatgagctatggcagccggcgacgtgcagtggcggagctcgagtgaggcggtggcatttggtcgccgccggcgaccgtacgagcagctaagggacttgggaatgaggtgtttggatgctacatgaatagggactgtgcatgacttcacaagctgccgcggagctaatgcaaatgcttttgcataaacacgacagtagaccagggagtttgcagcaaagagtgaatcaagatgttctaagcccccattagtagacattgtcctatgactgaaaaaaaatcaatttagtggcaattgagggcttagctacccccatatgagcacaagaaaggaatcatgtagcgatgattcagagcgccagaatatgacagaatgcagttagatgtttcgatggtatgaaatataaaacaaatcctgaattacagctctgactgaaatgcaatttacatatgggcaaaactctgatagtgaaaaatctcatttaagcagtttatcagattttttcagtctcactctttcaggagcaaaacaacttgtttactgatccaggagcaggatgacatatttcagttcaaattgcttggattcatctcaccccatcacagttgcacacaaaaaaaatgcacaacacactaacatggtcaacacattgacattactagtagtccatcactattcaccttttcttttttacttaaaccattactgaacaatgaatatattgggacagtcacaagatccaataaacatcagtatctcaaagctcgtcaattagtcaatgaagtattcgacacaccatacaactgaatattacaagcagaatgaactgggcaggccttcttgttgtcacggagccacttcgcgatgttgcaatcctcgtggaagtcatgcccgcaggagagcgtgcggacagtcgccggccaccatcctgagctagcagatcgggcatgccgcatgcatcgttcagcgtccgatccagtgtcctgacgccgccgcgagcacggatgtgctgaaacctctgagcattgcggtctatcaggttcgccggcgacgccttccacggcaacacgcagcgagcgacactgttgcatattctgcatctcatgccgtgctcgcggtcgaggaggtgctcgccgatgcaagccacaagactcgggcacgcacggagggggaccggggatacggcgctggaatgtatcgcagctgcctcccaagtggccgcagcccacacaatcagagcaacacggaatggagatcactacccgccggcggaatggattgaatcctccaaagtgggcgctgccaagaatcttaggtcttgcgcaggggctccggcgaaatcggacgcgcgcggaaggccactcgcagcggacagaaggccacgatggcgaaccaggatgccgacgtggaatacaggagaggaggaggaacggatagacaggtgagaggtgggaggaggggacgcctgagggtttcaccgcaccgagccacggcgtgccgggaggagtagcgataagcaacgtgcgtcgggcgagatgcggtgcttttcgtcggacctgatgcgatcaagccaagaccgaccgagacagagaaaatagatcctgccaaaattgcccctaatatatattaggagattactaatctaccctttaaaatgaacggtcgagattaattttacttgtagtataatactccaagtagaaagcaccggagcattgctctaatattattgtataaatgtgggcttcatttgaagaacaagaaacagactaacctggggcagcatagccaatcgtccctctaaatagtattgagttcgtcgagggttggaaaactgagttttgctcatcaagaatccttgcaagtccaaagtctccaacacgagccaccatgtcagaatccaagagaacattacttgacttaatatcacaatgtatcacaggggcagggccatggcaatgaagataatccaatgcataagccacatcaaggagtatgctcactctttccaggatattcaagtacctttgctctgtatgatcattattgtcaggatgtagccaaccatctaaactgccattaggcatgaactcgaacacaattgctttgaagtcattgccactgttatcaatgcttgagcaagctgtaattattttgacaaggttccgatgccataggtttcgcagtgcttcgcattcggctatgaaacttttgagtgcgccaggggtttggagttttagcactttcacagctatatctttactttcaccagcttgattatttatttctcctttgtacacagacccaaatgatcctgatcccaacaaattggttgctgagaaattatctgttgctcttaccagctgggagtgagagatcaagggatggccttccatggatgtggtagatgggatgtttgtttttatattcttacgccaatagagaagcttgtagagcaataagaggagtagtaatgttacagcaagagaaacaacaataggaattaccagaagtttttgccttctgtgtggtgactgtgaagagcatctaggcaaatgtagatctggtatgccaccacaaagtttgccatttccatggatggaaattgcggaaggattcgaaaagacaccaaaagttggtacttcaccactaaagtcattgaatgaaaggttgagataactgagcatggtaaggtttgacaggaatgtgggtatttgacctgacaagttgttattggaaagatcaagaatttgtagacctttcaattgactcaggagtgatggaacgctaccgctcaagaaattattttggagagatatattctggagaagttggcattcaccaagggtgctagggatttcacctgataacttgttggaatctgcatagaattgaacaagatttttcaagcccccgatttcttgtggtattgatccttccaagttgttattggatatatccaaagttaacgacaacgtgtgaatcttaaatatttcaacaggaatagaacctgtgaaattattgcttgaaagacctagttccactaggtttgtcaggtttccaagtgcacttggtatcctaccagtgaaggcattcacatcaaggcggaaataatttagttctgtaagattccctatggctaatgggattgatccacttattttattattgtctatatataaaacttgcagatttttaagcctgcccaacgatgacggaagaattcccgtgaaagagttgttatggagtagaagagcttctaacctaacgaggttaccaatctcttcaggcaagcttccagatattgcattaaaatcaagatagaggtattcaagataaactgaaaggtttgagattgaaacaggaagtaccccttcaaacctattgttgcccaggaacaaagcttgcaacttggagcaattcgttaacgcagatatgaatccccatcctttctgatctttagcttcaaggaatgtgtgctcagcttctagcgaagtgaggtttcttaaccttccaacctccggaggaatgattccaccgaaagagttgaaaccaatctgtatccgcgacaaagcggacacgttacctattgatacagggatgttgccatgaaactggttgtcgttaatgtacaagtgctgcagatgaggaagagagttgaacacatcaggaggcatcgtcccatgcaacatgttttgctggagattaagctctgtcagagaggaaacattccagatggaagaggggatcagcccggttagattgttgaagcctagctcaagccatgacaatccagagagcatgccaagggatgatgggatggctcctgatagcatgttgtgtgcaagaagaagatgatagaggttggtgagattgcccaaaccaggcggtatctcaccgtgcagcctgttcttgaacaaagatagggcgcccaacgattgcaaatctgccagagaccgagggatctctcctgacaaagcattttcatgaaggcccaacctgacaagattcttcaacgcacctagctcggctgggatctcaccttggagctggttgttgcctaggtcaatcgacatgagctcggcacattctccaatggaagccgggatgcttccttggagatagttcgagcttaggttcagcatcctaagcctggtgagttgcccgatctctggaggtatgtccccggtgaactggttgtcaccaagttccagctccctgagcaaggacaggttgcccaatgacggagagatccttccagacaggttgaacgagctcatttgcaacgccacaaccctctcgggatgccggccgccgcacacaactcccggccagctgcagtagtggcttgaagcgttccatgatgccaggaagccatcagacagcagcatggacttgaacgagaggagcgcaggctcatccgccatggcagtacttctgctgctgctgctgctccctggagaaacctgggcgtagaaacaggacagcaacagcagtgaggagcagagcaatgctgttgctcttgccatgatgatcaagccagtggtgttgacaggaatcgcaccgcaaacggtgaggaatttggggaggattttgggagaaagagatagagcagagtaagaattgaggaagaagaagatagaacagagtaggttggaatgaaagcagggagagattggaattataggaaggaatagttgtttcattacaaatcagtccgccccttgtctctgacacctgcccaccttatatagcacaacgccattaggtctctctcccccttgctgatagtgggctagccaatagatactggctgactccactcgcttgtttagtttctagctttgatcgtctgtcttctttattttttttaaaaaaaaattaaaaacatatgtcatgcataaatactatttatgttttttcatctaataacaataatatattaattataaaaaaaatttaaataagtcgaacgatcaaagttagacacgaaaaaacttatagctatgcttaaaatggaacgaagtgagtagaatactttgtgttgggctgcctttctctagaagatttcctgtggggacctgaattgtcgacatgcaggcatgcaagccgactaccctgtcttcccaccttgctcttgtgctgatcgacttgaggatgacaagtggctgcaagaatgcatttgcatatattaaagggttctttatatatagaaaaaccttgagttattcttctgatccccagcaaacaaagaggatgtatttagttcataccaaaattggaagtttggttgaaattggaacgatgtgacagaaaaagttgaaagtttgtgtgtgtaagaaagtttcaatgtgataaaaaagttggaagtttgaagaaaaacttagaaactaaatacggcgagaatagaatgtatatatgtgctacttgtgtccacatcaggaatatgtcggcgaccggtcatttcattgctacttccagtccactggagggtcaatgcaatcagttgatctaacgtatggaactatggatgcatgcggtagtactgaaactgcccagttcctaccagacagcttttggcaaataatttcctgtctttttaatcaaagcaggccacttgcaaaatatataatcattttgtgttctccagtcagtcatgcacttttgttttcattcaacaagtagtcaaggggcatgcgctttggtgcacatcatttctcgacaaaacgtttggtgtgcttcgataaaaaaccttcttctaacctttttttccctctatctttataatatttggatgatcttcttcggtcatctcgacaaaaagtttgttcgaaataagattagtgactacaaaataatgcagtctgatgagcagcatgagtagtccttgctatttacattgccaattttctgcatattaaatcactataatcatcaacaaagctgtctcagtcgagtcgaggtagtcactggtttcaactcaatttaatatgatttctcctgaatttgcatacgacctctagatcaagttcaacaatacaacaacatgagcagtgttatcgccactcaatcccgacatcatatgtgttcccccaaaatttctacaagtctaaacttaatttctgagtcgcaagaatctctgtatgcaagacaatttttttttcaaaagaaaaataataataataatttttgaggttaaatgttggggattctagatcagtctcatgaacgcacctaagattcctccctctttgcccgtcgcccttggaaattccggcagcgagcgcctcaggccgccgcgctcccctctccatcccactcggcggccatctcctgcgcctcatccgccgccggtgggcctgcctctccgcgcactggactgcaccgacgccggcgccggtggcggcaatctcgtcggcttcagaggcatctcacgggggaatctcgacgaaaagcggtggagagagacagacaggaaaaaaatgatactcctacgtcccaatctaagtatagccataattttcggtgcaagttcgatcgtccgttttatttactttttatttaataaaattaaaaatagaagtcatgtataaagtaatatttatgtttatcatctaataatagaaaaatgctaatcataaaaatttttcaaataagacggaagatcatagttaagcatagaaactcatagttactaatgagacggagggagtaaacgacaagaaatggtcagtgacaagttggtcccataattgagcgatacgatagtaaaagaaaaggtcctgagaactcctatttatgatgaaaatagggttaatttgaaccatgcctttataaacatggcatattagaaaggataaatttgatccatgtcattgtaaatttgatatctctatctctatctctatctctattattataaaaattgaagatgtttttgccggtattttggtacgtcatccgtctatgagtcggcttttaagttagtttgattttggaaatacatatccgtatttgagtcgtttttaatatcgtttacttttgataatacaaaaggaatcacataagaaatttgtttaaaaaaactcgcatgctaacttgagacgatcgtactcctaactacacctcatgattttctaaaatatatatatcgtggcgaattcccatagtgaatttcatcttaactaagccatataacaataataaaattaaaatagacttcacccgttacaagcacggatatttttttctagtatttataaaagtatcactactatcatctatgtgaaaccaagtaattctttcagtgtcctccctccgtccctaaatacaagggattttgattggatgtgatatatggtaatatgatgaatctggaaaagcatcctgtctagattcgttgtacttcatgtatgtcaaattcgttatattagcatgtgttatatccaatcataatccctaagtataattagagatggagggagtatgagatatgccattttctacacctagactctagtggacccacgtgcaggccatggcatttcgtattgcccaaaatacccctgttacatgtcttctttccacatcgttgacacatgggtcccagacgtcattcccttccaaatccccactgaactcccaccacgaggagttgccgttcacctcttgcggcagtggtagcgcactcgtcggcgaggttatccattctcctctccgctcggctttgcctgcacctggctactgtggggacttggcggccggagcactcgtacgtcgacgaggtccatgttgattgacatgcttcgctggtcaaaatggggtccgctttggttgctggagagattttaatcgctgttttagaaactcctcgttttgttgggtttcgttgagaaatcaagagcgtttagtggcaacatcgttttgatctcggatttttagttactgatctcgcggtagggtttgaaatttcggttcataatttccgaaatttcggtaatttcgtcccccaccggtgtgctcaaatctcgcccgaaattttaggttttttacaatttttttgtgaatttggtcaaattttatttaaattcagtcaaattttcaaataatttcggccagaaatttccaaaattttggtcacccccagcataaaatccaatttcgaaattgaaaaccctgtctcgcggtcgctagtttcggcgttggtcagtccaccgcctccaattaattgctgtgggccgccggcgacgccaagaccgaccccaatcgccatcttcctcgacaccagcttgctcgccactgcggacatggatatgtcgtcgtggccgtctcccttgacgccggctactgcaggtctaccctacacagccgtggccatctcccttgtcgctggctgctgcatgcagtgggaagggagggagggtgatgttgaagcggtgtgagtcgcaggcgacggcgaggaccagcagaaaggccgccggcaggagggggtcatcggcgtcgagagaaccgaacccactagctgctacagccaagtatgcaagggtaattacaaccatatacaaaaacacgttacgaagaaaatgagtcaaaccgagccatacggcatggcatcgaactaaatcttttacgtatttggtatggttgcgaatagacgaatagtagcaatatttagttgaaatgatactttttaatggcacggatcaaattaacccttttaataatagaatatatgggcaattgtattcttgcccctactttgaactggaattgtgattttaccctcgtttttagggtttgtattttgccttcatttcttcgaaatgatcactcagtgttacctttattatgttaaaatgatttaacagtgttaactactacctccacggttataaaactttttgctattgtccatattcatatatatgttaatgaatccaaacatatatgtgtgcctaaattcattaacatctgtatgaatgtggtcaatgctaaaaaatcttaagatctgaaacagaggaagtatgagataaaaagacgtgtatatcctttcatatttcgcccctttgttttgcatatatctttgctaagttctgtttctctaggcacagatgactaaacattagaggaaaaatcaagctgccgtctagagacattggcaatgaagttgtcgaacacagtggagatgtaatcctacgcatagacgaaccaaaccgaatcaaaatcgacccaaagaaaacaagataattaaccagcacgcggtgagatgcagaggcctgctcgcggccctgttcccagcatgctcgcacacggccgcctgctcacagcctcacactctgcgccgtcacgcgccctgcccgcgtaggctgctgctgcctgctccttgattcgcctccccccgccatctgcgatgcacctgctcgccgccaccccgttctccacctatccgcgccgcctgctcgcaacctgcgcaatctgcgccgcgccgccgcctgctcgccgccacgacgcaactgattctgccgggatgggaacgggctggtgttgaggtggctcgtaaggacatttggtccaagggtacgtatagtggtcctatcgtattttgtagatcagttttattttatttttcatttactcgctaagttttggtcccacctaatagccatctaaattctaaaataaggacaaacggtagtttcgattaaaaaagtgagggtaaattcacaaaccctaaaaaacaatgacaaaatcacaattgcaattcaaagcaggggcaagaacataattgcccctagaatatatatcctctgcacctaagctagagagcaaagtgccacattgttacaaacttacaatgttccgcgataagctgtattatacatatttataaaggaatcaataacaagctaatacaaaagaaacattaaaatgctgttattaaaaattaaaacgagtatacattctagtaactagctgggtggcccgcgcaattgcgcggctagcactacatatatatatattttatatgattttacttaaaatttattaaatggttatctcgttgtcttttaaaagaccaaaccttatcatccccgtgtttctaattttatagtttttaaaagtcacaccagttgctaccccttacttctgtcatatcattcttaatttgcttgcttgatctaccattcttaatttgcttgcttgatctaccattgtttctattcattctcattggagcctttacaaattagatcttatagcttttagagtttattgtccagttggatcctctatggtccgcccgctacctctcatctttattgctattgggattttaacaatcgaacaaaattattattggtgttctttttctttactttctagaagttcggtcaaacagtcatcagctccaccactgtaatcctctacggcccacccgctaaatcccctttttattatcattgagattttaaaaatcgaacataattatcactggggtttacttttttactttttaaaagtccagccaatcgtccctcatcttatttgtcattggatttctatttgagattttgtttatagtttttataggtctcatcatgcatcatcaccctactcctttattaacttattgtttttccctctttattatcatttatcattgttgcgttttatatggaccttttttttaaaaaaaaaaatcatatttttcattccgatgttttgttatttataaattttattcatacttgcactcttatataattattttatattttcaaaatttattttatttttatttcgatttttaatttatctcatgatgggttctagatgatattttctttcaacaatcttttctttaatttcgaatttttgttgtttataaattatattcctagactagatgtactcttctttttctttttttaattgtgaaatttattttttttctattaatctcatactgtgtctatatgaattattcttctaatacttcttattttttatttctaatttcagttgtttgcaaaatgtatttttacttgaactcttatatttgatttttctagtttctaaatttattttattttttattacggattttaattaatctttaattgtgttctacatgaactcttctatgaattttttattgtgttattatttcagaatcaaataaaaaatccgtgcacatgccatcatgcttttctggttgctgacgtgcatcacccaaatccggctcattgtgcagccgcacggcttgacccgctgccagcatctatctccgtatcaacaaaaacacatccaaattacggttgtacagtggttcgttgcctgctgcttcatttatatatgtgtattatagcctaattcaaattggtttaggaaatcggacaaaactcttttgagtccgtttgcatgtaaaggttctagctagagattgattctaattctacacgtgtacggtactccgtatcccttaattaacatgtcaagtttgtgttaaatctcagacattaaaatctatgcctcttataatccaatggtgtaaataattcatatttttttcgattaatgtaggaatttctagcctccacggtgaacgtggtgtcttcttttcgagctgtcttaataatataatagatagatgaaaaaagtaatacgccataatcttattaataaataacacgcaaagctaaataatcatgcatcacgcgcagaaaacattccaccacaccggcctgcggcaaatacgcacaccattctactcaagctttctaattagcttattgtgcagtcatcttttggaataaactggcccaagtaacaacagctaacacatatattttgtcgtaaaccttgtcaaaaatacggaaatatgcaatcctccatgtcttcttgaagagtatgatgcaaaacaccacccataggccagcaatgaatcctgacacaaggccaagataaaagaacattggctcaggtacatgtccagctttgttgttgttggtgtaaatatgtattgtactaaggacctatctgtaaagtgttatgctaatagaatagataaggaaggggtgagctgagtaggctaaccctagaaaaattccccaaattgaacaatatggtatcagagcgggtcaacggcgactggggaggttgaaccctagctggcgaggtcgcagcggcgcgggccgaggcgaggttggcgcggcgcgacgacgcacgcgcgaggccagcgtggccgcacgcggtggagacggttggtggccgcggcaggaagcggcgctgtgccggcgcaggacggcagcgctgctaaggcaggacgtggagtgaggaagcgacggtgtcgacggcagggagcaccaacggcgacgacgcgtgcggagggctagctggtgacggcgtgtggcagaggagcaggttgttgctgctgctggtgaggtgttggtgctgctgctacttgagaaggtgaagtgggcgcttggcttgctgttgctactgtatttgctgctgctgtgctgatttggggaagaaactgagtacttgctgctgtgctgaaaactgagaagtagtgctattgctgctgttctgttttggtgagaaactgaggagtagtgttgttgctcctattagttgatttggctaatatttgatctgccatgggggattgaagtctggtccttgttgtatctctgttaatgtggtaaagaagaagctaagggaagaaaaaaaaaatgtcttctggggagggaaaggaggttgtggatactttcttgcttgttactaaaggtgatatgaaaggtttgctagaagatttgctgaagatgggcatgataggtcctaggaatgcggctggagtgtctgaagtgaaactagaattgatgccaaatgagttgaggttggaggggagcaaaaattatttgagttggtgtaggagagcccaactgatgttgagagcaaaaggggtggatcattttttactagagagttgtgaagaaccttctgataaggagagccaagcatggaggacgtggaatactacaaattccactgtggtatcttggttgatgaaccggtggctccttctattggcaggatgatagaagctatccagaatgctgcagttgtatggaagacgctgagcaacatgtattcaggagagggaaatgtaatgatgatggttgaggctcagaacaaagtggagaatttgaagcaagagaggagaacagtcaaagagtacgctagcgagctgcaacagttatgggcaaatcttgaccactatgatcccttacaattgaaacatgaggatgacattgtgattggaaataaatggctgcagaggcgaagagtcattcatttcttgaaggggttgaacaaggagtttgaggataggagtgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcaagaagaaaactgcagcggaaaaataaaatctagcgaagctccggctccactcccacaggcagctcaactggggtataagccaaacgtcttctccttttggatcctttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaatcaggaattttaatcaacactgaacagcacacccatgctgcacaggcccaaccattctgaacaaccatacccggctgaacagatctaactccaaaccaggagctaagcaaattattaccagttatagcatcaataattattgtgagaggtgtgagactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttgacaagtaattaattaaccaatcacgattgaccatcgtgagctaccattaaatataaccataagtgatagtgaaacattagttatcccaattgtgtgctaatgtttctaagcatggctaagcaatcacatctaatatctagctgaaccaatatataaagctcaactagtcaagttataatcacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcggtcttcaattaatcttcttgaatacttccggcgcactcgcgaaccttcgcaacaacggaaacgacaagctaacacgcaaaacgaggaaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaatgaatttaattcaatttgtggacaattttaatatgtagatctttattttacacaacttttgcaacttgaaccacattaaactgagttaagatgaattagatatgaatttttaaagattaaatcggattaaaacacttatatggattttaattgaattatgacgcaataatgaattatttttgaaaaggaaaaggaggattattgcgccagcggctagggtttcggtggaccgggcgcacgggcgacggttcacgggaacggacggccgagatcgacttgatccaatgcggacggccgagatcgatcggtccacgaccggctcacggtgaacggctccgatgacgtcagcgatgacgtcagcaccagcggcgactcgggcggcttgggcgcgcatgctcgccggcgaacggcggcacggcgacgcgaacggagagcaccaggacgtagaggacgacgcggcgaactcaccggtgaccaaaacgtcggcggaagaccaacggacggcggcggcgacgaggaggaagcggcgaagctcttcgggtcgacgacggcgacggcgctccggcggtcttcggcggcggcgaagcggtggacggggacggcgacgacgttgcgaacccgatggcggtcttcccgagcgacggcgacgtctggaacggcggcggcgcacggctggagcgacggcggcgacggcggcgctagggcacacggcgctagggcgatacggacgacgagaggcgaaggcgagagaggcggcgggtagaggagagctcgggggtccttatataggtgcaaggaggcggcggcgaaggcccacgactgccggcgacggaaaggaaagatcgggttcgggagagagagaggaatccgattcaaactcgaatccaccggtttccaaagaaaattagccgatgtttccaaaagagaaaaggaagaggagatctcaaggatcatttgccctcaaacaattcggccggagaaggaaaggcgcggccgaatttggaaggagaaggcggcggcggcgcgctagggtttgcgggcggcggcggccgaaggagaacgacgaacctgacaagcggggcccacctgtcagcggcagagagagagtggagagcggcggctcggcggactgggccggctgggccgagggaaagagagagagaagggttttgggccggctttcggcccaaagccaaaagaagacttttaaaacctttttttcaatttaaattatttcttaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttttaagcttttaaaatcatttctaataattccttttaaacaacaatttataatttaaggattttaaacaagaaaagctcttaacaaatataattagatcatcaatgatcaaataattactgaactgttctttgtattatttaagaattgagctctgaaaaatccgagaaaatttcagagagttgacttaaccatggagaatttaataaaaattaaatccatccatgctttatatttaggaaattttatttcccacatttaacttcacttgtaacttaaagaacatttaatataaattctattaataatttattaaataatttataaatcctgaaacaaaaaatcaggatgtgacaaggagagcagctatgttccaccaagctacattgcccactatggaagaggccatttcagcaatggtgcaggaagagatgagattgaggttgatgagaggtacaaattctataagatcagcatacattgcagctgataatagggaatgctacaattgtgggcaagtgggtcatgtgagctacaattgtcccacttcccggaacattggtggtaggggatcgattcgaggagggcatggtggaactcgtggtggatttggaggagaccgtggtggttttgggggaaatcgtggtggtagaggaggtgatcgtggaggtcgtgttggaggtcgtggtaggggcagaggtgttcctcaggccaatgcagctacggaggatgggaaagctgttaccctaataggtgaacaagtgacacaatgggaggaatggtagaagaacaagaccaatgagagctctaacaccaccactcactttggtaacttcgccaactacgcccaagtgggcgaaggtactcaggcacaggcacttgcatctacatagacatcctatagattggatcatagactcaggagcatcaaagcatgtcacaggattgcataatactttcacatcatacactccttatatccactctgaaactatccaaatcgctgatggtacatccaagcctattcatggtatagggtcggtagagtgcacatcatcaatgaacttgtcttctgttctgcatgttccttcctttccagttaacattctctcagttagctcggctattgatcaactcaagtgcattgttgtatttgatgagaattcttgtctgttccaggagaaggggactgggaggaggattgggactggagtcaggcgtgatgggttgtggtacatcaatcatgaggaactgggactagctgcggtggttggagatgttgagaaggagatcagtttgcttcactgtcagttaggacatccatcttttgagattttgagtaagttgtatccagacctctttagtagagtggataagcatagattggtgtgtgatgcttgtgagcttggcaaacatactcgctctacatatgttggaattggtcttcgtaactgtgagcccttcatattaatacattctgatgtttgggaaccatgcccagttacttctgtgagtggtttcaagtggtttgtcacctttattgattgtcacactcgtatgacttggatttatatgcttaaacacaaaagtgaggtccttcgttgctttcaagactttcataaattagtgacaactcagtttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagtatctatggagtgaggctgtgatgacagcagcatatcttatcaatcgcatgccttctagaatacttggtatgaagtctcctgccgaactgttattgggtaagcgagagttcaaggttcctccaaaggtgtttggctgtgtttgttttgtgcgagatcaccgaccttctgttggcaagttagatcctcatgcagtaaagtgtgtgtttgttggctatgcttcgagtcagaaggggtataaatgttgggatcccattgagagaagactgtttgtgagtatggatgtgacatttcgtgagttgagccctattataaaagtaaaggagatcttgaccaatttcttgaggaattctcgactgtcatggaggttgatagtcgagagggggagagagagagagaggtgacatacatgaaaaaaatgttggtgacaagaatggagaggcagtagtgattggatcaataccatgctctattgatgatgcgagtaaagaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctagtttaccaaaggaggcggtttgatagtcagggggagaaaagaaaagggttagtgcaaagtcaaattgaagagttaccacacccaaaatgtccagtctctgaatcctcccagagtctctctcctccagcctccttggcttctcttgagacaattggtaatacttctccaactcttgaacatgtagaattacctcttgcacaacgtagagagactagatctaatgctagtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgca

SEQ ID NO: 60992 - DNA, 8621 bp, Oryza sativa
tgagcgtccatatgggtgcaagcccgtaggatgcaaatgggttttcaagaaaaagcttatgcctgatggtacaatcgaaaagtacaaggcaaggcttgtagccaagggttatacccaaaaggaaggcgaggacttcttcgacacatactcaccagttgctcgcttgaccacgattcgagtactacttgctctggcagcctctcatggtcttctcgtccatcagatggacgttaagacagcttttctaaacggagagctggaggaggagatctatatggatcaaccagacgggtatgtactagaaggtcagaagggaatggtgtgtaaactattgaaatccttgtatggcctcaagcaagcacctaagcaatggcatgagaagtttgacaccacgcttacatttgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatcttatttgctgtaagcaagctgaaccggtttgtctcaaatccgggagatgagcattgacaggctctggaaagagtaatgcgctatctaaagggcactatgagctatggaattcactaataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctttcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgaaagaagagacccttgaaaagggctcattttcatgatgtgcttctcttctttcctgcatggtagaatggcttatgtcttaatgtgaaccgagtggcttttccaaacagagatgttgacctgcagaacattctcagaaggaacacacctatatgagttcgactgctagtcacagtctataaggtttgggcaatctctagatactcatgaaaggcctggagtttgacttatatgctccaaacagaggggatgcgaacgacagcccagtcccagtcaaggttttgagtgaaacctgatcacacaaaacttacaattcaaggcatagtccattgttcagttgtggtctgatgaagctcatttcctaggtggaagttcaacttgacagtctccaccaaaaccctggtatatcaaacaggcacaacattgggaacatttcttatgagccttgaaatttggtggggattgttaaaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacacgcgcgcgccgggccgggccgggccggggcgagggcgaggcgtggcgtggcgtggctggctggcggctggcgtgcgtgcgtcacgtcgctatccttttgcagccactaacccacgttcccacgattccctccgcaacagcgcgtccacgttctttctcctgatagataaggaggccgcgagtccgatccgacttcttcgcttctttcccggtgttagtttctccttctccgcgcctgagttgctctcgcttccccgcttctgatctcttgcgcgcacgagagattggaaggagtagtgcctccgaaaccacaccttcgcctgagatctgcaccgggtaggcgggtgatcaggttttttgggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaccaacggaggcaattctgcctcaccatccagcggagggccattctcggggtataatcttctcctcctgctactgctgttagcgctattcctgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttggattaaaatatgccgattaatgactatattttcaacagaccacaccactatcaccgttggccatgggcgagggcagtaccaccgctgcggctgagagggatgctgctgactcctcatctgagtacagctctcctctccgtcgaccaatggtttattataactccgatgtggcagcagtggatctctaccacaggcagtttttcaagtaccaggaaaaaaaaggtataaaagtgctccacttttccccatacgttcaattttgcttactacctaaaacaacaattgactatttctcaaaacatctataagcttggccttagagttactgtcatcctgtgagctatttttcactgagtttcataaacagttataatgcatgtaatcttttgatgacacaatctttgtctatatatatttagctcgtctagaacagttgcccacactcaagcagtccgattattatcaaaatattgccgattggcataatctaaatcagaagagagcagttctgggtgtagcaaaatcagtgctgagcctttcatcgactcatggtattacctttttttctctccggtatacattcttagttactttatccatatgcacatatcactaaatttgctaagtttttattgatatacagatgagaaagaaatctatcgctgcacgggtatcatcatcgagtgggatgaagtcagtaaatctgccactcttgtcacctcttcacaaatcctatgcaatgaggagtcacaggataacagtatctactatcccaacaccaaggtaaatttgtgaacaacattacttcttggacgtttgctcagtattcttctgttgagcttaggttttgcttcttagtgtttccttgatactgtaatttcgccttactttgtggtgctctattttctctcagcctttgtactttggttattgatgatacgaatagtatacctgtggcgagtaatgatttttggtgaatttttttatacatttctgttgcatttattatggttattggttgaagttaagaatgcttagaaatttcatagaaaatgcagcttcctaatagatacaaactttacctaagcagttcagtgaaatgaattagtgcccctcccacatccacatacacacaaggtcacacatacaaaatctaatatgtagcgatctttcaaataaaaaaaactgtgaatacataatgctaatttgataccccgtcaagacaaactaacaatctacacccactatttctatgtattaaaacataatatacaaagtctttgaatgcacgcagctactgccaggtcttgcccatcttaggccccgttcgatctcccgtgttggagatggatttctgttgcacgcaaaatgagaaaccttattagcacatgattaattaagtattactacctccgtttcaggttataagactttctagcattgtccacattcatatggatgttaatgaatctaggcacacatatgtctagattcattaacatatatatgaatgtgagtaatgctagaaagtcttataatatgaaacggaggaagtaactattataaatttgaaaaatggatttatttgcttttttaaacaactattatgtagaatcttttttaaaaaaacgcatcatttaacagtttgaaaagcggtgctaacggaaaacgaggtatgtagctccatggcctcacagttggctgcactacaaatctttccaattaacctttctcagttgctgagcaaattatcacaatggcacattctgactatctttgaagttcttttcagcataactactggatattttgcatggctagcagtatgcacaaacagtttgcactcactcttgaacacactaagccctaagctttttttcacgggttacatggttgcccacgaaggcgaacaatctgccttctcatgatcttgagcacattatgcgctaaacatttttacatggctaacttggttaccagtgaagatttccaatccaagtgtagtcttgtagcgtactcattgactgcccaatatagttgttcagctcatgcattcaccaaatgtttcacaaatattaatccctggcatccctggctaggaatttactaatttttcacagaagtcttttggatgtttttacctatagttgttgattgcaggattttatttcttgttttttctgtttgttttcaccattgttctcaagactcataatttgttctacttttgtattctcatgtaatcatcttttgtgaatgtcatttacttcaaatcacaatattttcttttcagatgattgctcacctattggatgggactacttctgagatggaattgctctactttagcaaacactatgagattgtcttttttaaggtcaatggggcattggatctacaagtcgcgttgctagatactgagttggaatttggcagtgaagcttgtgtgctagccagggacaaaaatcttgatttgatctgtagacgaacaacaatagtggcaatggacccttgtgaacaccaaaagaaccattatttattcattgatgcttcggactgtgaggtgataatataagcaattatctgattcctttattattatttagataagattgtttagtataacttcattgctaattttattcaagactgcaatggaggagcactgacaaattttaataggaatattgtgagtatggtattatatgctttacccaatgttgcttttattccaagctctcttattctgaagtgcttcgcattatggaaaaagttcaggtattttgattcttgactgtttctaaagtttttgaattcttataaatgattaggagtaagtagagagtagtcttcaaaacttatttgctcaattcttgcatatatatttatctctacaaaaaaaagagacaaagttgcatttagagcaaatcgtagcctaattgttatttatttatttattgcttgctcgtgtctgatttatttgatagtgttttgatatgaaaattgtaacaaatgtgaaatatttttatttttttattttcatctatgattcttaatttaactaattccatttgttcgaatctaataaattgatgataatttggtgtaggaaacttggtcgacctcatttgggtttgaagctgactgtgaattttctggatatatcacatttagagaatctgtctcgtgtttatggtattagttctggcctgattgtagcaaaggtatacccctttctccaagttttctaatgataagctctgcaaactgtaggcatgttatgctttttttttctatatttagcaaactacatttctatcttacacacactactacacttttaattgttcggatcatttctgatgagctggaccaaccaatagctctcaccagcccagccttttttcatttgactatcagtaggcttgtgacttgtgactttgtgagtccaacaagtgggaccaatcttttgaaataatcacaatagtccaagtgtagcaatatgaaatagatgcttgaaaaggtggatttacgataatttaatcaaatctagtgtgattttctgaagctaacttttttagcacagatacagactgttcctatgtttttaacttgattctaggtatccaatggttctcctgctgagagaaatggaattagaatgggcgatgtcatatttcattgtcagcaagagtccatttcaaccacagctcaggtaaaaatacgttgtccttataaatgcaagacttgtgggaatttattttaagtgacttgagctatttctttttagtttgaagatgttctgctagatgtatgtgagaagcactttgagaagggaatcaacttgaactccaaagtagatgttgaggtaagcttttattgaaattagcacattgctttgtggttttttagtacaacttattttttttggcacatatactatcttatagtataaatttctcataaaaaaaactgcagttttttagtgcatttcacgaaattaaaacttgacaaaagtaatgttctaaaaaaatatacaaccgggtgagactggcaggtgattctgcactttcaactacagaatcagcagaggtttgcatattcgatggatattttctaatagttttagttttggatgtttttagatcaaaagggaaaaacctgtgttccattttttaatggaaatgaaacaattttcttcagtttaccattcttacattcttagcacactagaacattgtttaatcgcgactgacacgagcagaaactaaaatgagaacaagttagatcctgcaacatatagttctagtacagaataaacgagagaggaaaggaccaagacatcatacttataatctattacctgccgtgaaatcttatccctatctaaatggtacctttgatcgaagaagccaagagataagattcaggtcttgcaggtttgggcacttcttttcttttcataccgtaccccaattggaaaggcgatacttgtgatgaccttaatgattgcccaaaaatgccatgccatgtgtccgttgatagctttgatagcccattttggaaacttaatgactgaaaagggatggatggggatacatatctacttaagtaaaaggagactttaagaagcagtttttctccatgatatttttcagtcttattcaagaagttatcagctagagacatatttaatcaaggttcaactgcaattggtatcatatcttttgttatcatataccagtccctcaggcccatgcagcattttaattgtttgcttctttttcctctgagaagagcagcattatggtctctcactaggatatctttctctctagatctctatctatccttcatctttccggactcccgaattgaagaaattcctgggtgatttctttcattctatattatcatcgacagataaaacgtctctcagattgtctacccaaaacattatattcattaaccattttttttctgtttagcatcgacactcacgttccaacccttgagagtttttttttcataaagtctaattttaaactgcaccctattaattacttttgtttcagaatgcagagtattccaaatctgtttgactaagccatgggaatctttcttttcaccatttttgaaaatgaatttttcaggcctgatatcaattggttatgtttcaatgaagagcgtaaatattgccccaattgtaggtaaaacaactacagtagataaaggaaattgcgtatcctaagaagtagataaataaattctatccatagcagccaagaccaaagtacattggttgttttcactaatgtactgtcttgcagcattttcgaatttgagttgaatagttcaaatattaatcaatgaaactcttttggtttcagataaacccaaaaagtcaggattacatttctgttgacaaatatactttttgcctttacagctcgttgtttataacttacgcaagcgttccagaagaaccgtcagtttgtccgtagagttatcagatggcatggaggtcattgactaaggtaacaaaattttgccttgttgcccctagatcatgtttggtcacaacattttgttgtttcttacaaattatgcggtcatgtttcctaatattttgcagggttatgggacgactaggactgcaaattgctgtgaggaaattgttattttgtagtagg

SEQ ID NO: 60993 - DNA, 2209 bp, Oryza sativa
tagaatccggcagatgcgaattattcggtaggttatttgctggataatctgaagttgtcaacacatgtaaccactttatatgttgcatacaacgtgagttggcccatcaaatggcctaattcatcgattaacttggattgcttagactacgtctctcaccgtctcatcacacacttgcgtagctatgtttttatatagagagaatccactcagtgccactgagttttgcccacttctacaatatacccctgactttgtcaagttgaacaatatgccattgggttttctttaaccttcactgcgtgccatcacagcacagttagcatctgttagcgatgtaaaaagacctatttgcccctaactcattatatctgttagccatctttattcccattttcaaagaaattcatcgcgtatgcattttcatatatacatcggtgctcatatattaaacctaatctgagtagcagtgcttccaaaaacgaatggattcgcagaaactagtatcggtaaaaatgtaaatacacgcctctaccacctgctaatctcaactcaatggatggattcacagaaatggagatggatcaatgcctctacaaagctcgatcagaccttgagcttgaagctgtagttgttggagcggatttggatccgcctgccggcgacgaggttgtcgacgacgaggttgcaggtcgccttcccggtcatcttccacagcttgatggcgccgaacttgatgcggatcggcacgcgcgcccacaccgtgagcggcacgaacccggtctattgctgttgcagcagctgcgccgccatggcgctgtccagccgcgtctcgccagcgacggcgacggcgaggacgagcacagcgagcagcgtccagcacacgcaccggcagcaccgccgcccgcggcccttgcgccgacgcccaccgggtggattcggtggtagtccattgagatggagacgctgcttgccgggcggctggcggcgcgtcgatgggacctcggcgaccggccgcgcgtcgatggggaggccggcgagccaccgcgcgtcgagggggagccgagctccaggacgcgcgtcgtgggggagccaggcggccggcctcgcatcgtcggggagcaagacggccgaccgcgcgtcgtcggggagccggccggccggcggtgcgtcgaggagtcaggcggctggcgttccatcgatggggagtcggcgccgctcactagagaaacaacaatagatcgatttgggggtggatggtgtgttacggttttcagtcaacaagtacaatgatattttagtcaaagggtattttagtcatttagagacaattcaatgcggtaaacggaggccaactaacggctcgtggacggcgatggcacgcagtggaagttaaagaaaacctgatgacatactgttcaacttgacaaagtcaggggtatattgttgaagtgggcaaaactcagtggcactgagtggattctctcttttatataattggcataatgtattcatgctatttaacacttcagtatatagttattatgattgatcatcattgattattgggttgttgtctattatattgctaagctgatgtggcattgatttgcatatacacgtaacgaccgataattttaatctgtttttaaatcaggtccgcaccattttcaacatccaaaacaatctgctcgatatcagtatccacacactaaccgcatccgcttaaaaaaatggtttgaccactattcgtctgaatccaatctgttttcacccctacttcttgtagccccaccgaatgagttgatcgtcgggcttaggaggacgagggcaatagtcactgtcaggttgggcccacacctgtcctcccgcatagggcccacctgcttcacatcactccccctgattccccgccgcaaaatccaatcccaaattcccaaatccaagccaccaccaccacaacgagcccagcttagagcataccctatctctctctctctcgctcgggcgcgcgtgagcgcaatgaggactttggggtcaaaaggaattgatgccatcagagacatggggggagtcggcggcgtggcggtggtggcagggaaggagaaggggacagccaaatatactataagttccaaagtgcgagtaaaattgtttgataagggccatcccaacctaaaaaccatctagtggtttccatacttatcac

SEQ ID NO: 60994 - DNA, 16202 bp, Oryza sativa
cgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaaccggcgaagtgaggccaagcagaaggaccccgccgaggacatcgatgacggcgatgatgacctaggtttccaagagcctggggccaccattgccactgtcgatgagggagcgtgtgctcacgtttctcgccggagcctcaaggccatgaagcgagagtttctggccgcggcccctactcatgaggcgacgcgccgggcacggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagccttttacgccatcaaggccccggggatggtgctccggccgtcccagccgattatcggtgtgacgccgggtcacacttggccgctaggtcatatcgacctcccggtcaccttcggtggatccgccaacttccgcacggagcaggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcaacctcaaagtcgcgcttgcttgtatggagcagcgcgcggaccacctcgccgccgcgtccaagcccgagggtggcgacgagatgcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcatcgtctcgccgtgcggccgggcgcaaggccagtccggcagaaagtgcgacgccaggccccggaatgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcgaatctagcggaaacttttgaaagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgtcccggagccaaatgaacccttgctactctacttagcggcgaccccacaagtggttagtgcggtgttggttgtggagcgcgatgaggacaatcctcattccgcgcacccccaccctgtgctggcttggctcgggagagagcagggaggagaggcccccgagccgaacggtggcccaaggcccctgacgaccggagctggtcctctgcctgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgttgtcctccgaccccgaggtcgtcggcacagaagacaagtgcgccccgcgaggccgcttggacaaagagcgcccaagggatgtggcccctagcgaagaggatcggccccaccgaaaggtgcagcggcccgtctactttgttagtgaggccctccgggacgccaagacccgataccctcaggcctagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcagtcgaactttctgagtttgatttgcactttgaaccacgccacgctatcaagagccaggccctcgccgattttgtggcagagtggaccccagctcccgagcccgtctcagtccccgaggccagctcgggtccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaattctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaatgcgtccagcgcatctccaaacgctacgtgctggtagaagggaccctctatcggcgcgcggctaacggaatcctcctgaagagcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataaccactccgcacttaaattcattaagggcatcatagcccggtttggagtgcctaaccgtattattacggataacggcacccaattcactagtgaactttttggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctaggcgaaccgaaccacgccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaagcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggtgtgcagggttggccgggggctaccacatatgcatattcttatttctcttatatctgtatttcaataaaagcattttcgatttcctaaaggctgtatctgtgctgttgtttccttttgaaggattttgacttgaaataggtcacttgtgttcaatcctgccgtcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgcctcatacacacaacaaatagaattgacacaaaaaatttcctctttatttgattgcagattaaattagtctatacaagaaggaggcccgaaggcctcggaagaagaaaagaagaaactatttaaagattggcgggggcctgggggctcactccgatccacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccgaccatctccgagaggcgctgagcgaggcccccctggttggcggcgtacttcacagtccgcccgccccagaggcctgcctgccggccggcgtgatctagacgggagacggcgtcccgaagcatgccgggccctacctcgcctgccaaacggagggcctcgacctccccggcggacgagtctagcgcgccctgcagatcggcaatggtgtgttcggcagctgcgaggcgggcggctaagtcgctttcgcccgtggccgccccgccgctgcgcgccctcgcgtccagctcctttgcctgcgcctcgagttcagcggcccgctggttcagtgcggccttctcggcgcgggcaccttccaaattgcggcgcgcttgttcctctagcacagcctcacggagggacgcgctctccgccagccgttgcgccgtggcctcggcctcctcaagagctcgctcccgatcggtgagcgcgtcctcgcggaggcggagtgcgcactcctcctcggcgcaggcggcctcgtgcgccgccagcgttacctcccggatggcaacggcggcctcgcggtccgccaggtccctctccacgacgccggcgcgctcttccagcgccatggcacgagcctcgagggcctcttcgcgccgccgagacgccgcctcggtctccgccgcccgccgttcttgggcagcggcagcgtcaaggaccccccgggcggtgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctttgagacgtgccggcggtgtgccttgcggcccacctccaccatggcctccaccgagcgtcgcccctcttcgacacgcgcccatgcggcgtcaagctccgcccgctctgcttgcagggtctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatgaacgtgccggactcagggatgtcccccagacctggcttgtcctgagcgtcgcccgagggaatgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcaggagggacgcgacgagatctcgctgaaacagaagaaagaccagaagacaaacaagatggatgagtgaaaactcgcgttgagggaatgaatacggccacgatgggcgtgggacgaacctgcgagggggacggttaaacgaccaccttggaggggaaataaggtttccccgggatggttctgtcccccccatcttgcggagccgtttcttcttccgctccccctcgggctgcgacgtcggcgtggccccctccgggcgcctgctgctggtacgcgccgccccgccccctcggggaggagatgggggaggggttccttcctgcttcctcttcccccgggcgtcggcagggcggccgctccccgggcccccgtcgcggggcccagaagcacgaccccctcccggggtagatcgttcccccctgcggctcccgcccgcgccatcgtggcctcgaggagcccgctcctccgatgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgactccctggtgggtcctcatgtagtcttcggatccggtgtactcccaggcgccccggacgcgccgctggagcggcgcaatccggcgacgaaggtagtcgccgtacaccatggcccctatgagccccagggatcgcaggcccgccagacggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggccccgcggctggaagtagcaaccaccaaccaccgacggcggcgacaccggctgtacagtgaagaaccaccggaacagccgaaggggtgggcgcaccccgatgaacatctcgcacaggtgcgcgaagatggccaatgtcattaccgcgttgagggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtaactatctcccggccggtggcagattccggcatgaagcggcgcggcagcccggcctgcctctcactcacgatgcgggaaggcggcagcacgctaccatcaagcaaagcggagccccgtgccatgacgccggaggaagagaagtttaagagcgagcgcgtgtggcgaaggtagggcacaggaaacaaggagttagggcgcaagcggcgaagacaaggggaataatggcgagaggaaggaagcaaatctcttcctcggcgtctttatacccttgccaacgctgcgcccggctcctcgcttctcgcgtccactatctcgctccctcgtttctcgcgcccacgcttccactaatcccattcgcccgtttgcggtgcatgaagtggatatgcggctgtggcagttgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagagcgatcgccttggcataacgccgggggctactgtcagtgacatgggaccgggagtatcatgacttagagacttgaggcagacacgatcacccacgtggcctaaccccctcgggggggtcgggcccgagggtgatacggccgcccttctctttgtctccccgaggggtcggaccgctaccgcctcggccccgagggccgaggtgccccgaccccttgtgggttttgcgccgcgtatatggggtaggtgagcatagcggggctcacttaaccacatttattgcggtttggacgagcgcgtcacgccgcatgtaacgcagtgcagcgcgctcgtttatccggtctgtgaccggtcacagaccggtcagatcgtgggttaggtggcgacaggcggtctgacgcacgcctcgccccatcccgtcaggacgagagcctccaagcactcgtccctagccggaaccggcatgttagctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagtgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcaacggaaaaagataaaagcgagctaagcctgaaggcttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaaacagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgtcaggacccttcgcataaccctctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcttgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacggccgaaatctacgcgacaaacaaagcacacaagcaaaacatgctataagactactgtaacaggaaacaaaaccatttttaatggattctacacatttttatgaatttactgagacttgaatggatttaatcggagctcggatgaattagttatgatttttagaagattatatgtgtttattactataaaagaaaaacccttaatcaatttattgcgcaataattcatcccagggctgacgtcagcacaaggaggggtggcgccgacacgcgggacccgcgggtcagaggcacaggagagagggagagggggcggctggcaagcgggacccaccgggcagcgtcacaaggggggggggaaagcggcgaggcgcccggtcggtccggctcggcttcaaaccggccgaccggttatggcgagggcggtgccgcgcacgcacggtcgccggcgacggcaaccggaggcgcgggaagcgacggcggatgacggcggcgcaaaggcggcggcacacagccgaagcggcggctcggcccggcacggcgctaggagggagaggaaggggaaaagagggggaggggcgcctcaccgcgagttggccggcgtggggggggaaagacgacggcgaacggcgacggcgagcgaccggggaacggcgacgataggcggacgagctccgagacctcctagggaacaagatgggaggtattagagggagaggggtggttaacagcgagcggattcgccggtcgaaggcggcggccatggggtactcaccgacgcgcgaggagaagcaagctccggcggcgggattgaccggggaaacggcggacggggtggcgcacaagctggcgaacccggcggcgtcatcggcgcggtgcggcgacggctctagcggtggcggagtgcggccggagcgtggcggcgagcggcggaaggcgggatgagaggcgcgggagcgatggagagctcgggagggctcggccgagaaaggaaaaagagagaggaaggtgcgggcgtgcttaaataggagggggggcggcgagtcgtggccgggaacggcgcaatttccccggagtagtggaggaggtggaggaggagagagagagtgggggaaatttcaaatcccccgccgtttgcgggcgcgcgagctggcgggaggagcggggaaagtgggcggcgacgtgggcgtgcggtacgggcggagtgggcgcgggagcagcgggatacgcggcggcgtgggcggtggtttcgacggcggttggcgcgggcgtgggcggccggaggttagggaaagggctgacaggtgggccccacctgtcagcgcccgagagggagagggaggccgggtgaacttcgggagtgggagggaggagcgggccggcgcgggaggaaatgggccggcggcccaagaaaaggaaaaaggagggaaaagaaaagataaaaggaaaaaggattttcccagggatttaatattgcactttgcttattttaattggttaaaattatttccaatgctctgaaaattccactaaaaatcctgttagcatattttgacatgtagaatccaagaaaaattccacatgccgattccgattattatttgcatttattaatttagggtttctctcttgcctctaaagaaataatttcttccaaccatttattaattgaatttttgctagggaaaagaacttctgggcgcgacaaacctaccccccttaaacggaatctcgaccccgagattcggaagagctggcgaagaggtgcggatgggcggcctttaattcattttctctttcccaggtggcctcttcctcttagtggtggctccactgaactttgcaaaatctgattactttgtttctggtccttctctcgctggtttccaggatacgaattggcatctccacgtaggtcaaatcttcttggatgtcaatgtgctctgagctagcttgttcctcaggtaccctcaaacacttcttcagttgagacacatgaaacacatcgtggataccaaccatattaggtggaagctctagctggtaagcgacttcacctctgcgttccaagatcctgtatggtcccacaaagcgtggtgccaacttgcctttggtttggaagcggtgtactccccgaagcggagtgacacgaaggtacacataatcccctgcttcaaaagtaagctctcttcggcggttatcagcataactcttttgccgagactgggcgattcgcagtctttccctgacggtcctgactttctcctctgcttcggttaacacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgatttactcgctcggtctgaccatctgtttgcggatgataagccgtgctgaaattcaaacgagtccccaattcttcttgcagtttctgccaaaattttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttccgaccctcatattctttttcagctcagctatttcaggatcatttacttgagctgctctgacttgatccacgagcgtaggccgtgcctctagggcagctacgtacccgtgttctacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaattaactctagccatcttcgctgtcggagattcaagtcaggctgagtgaagatgtacttcagactcttgtgatcagtgtatacttcacagcggttgccaataagatagtgccgccagattttcagagcatgaaccactgctgctaactcaaggtcatgagtgggataattggtctcgtgtggacgcaactgtcgcgaagcgtatgcgaccactctgccttcttgcatcaacacacatcccaacccttggcgagatgcatcacagtagacttggaagtcttttgtctgatctggcaaaattagaactggtgcagagactaacctcttcttgagttcttcaaaactttggttgcactcagctgaccacttgaatttttcatctttctttagcaactgtgtcatgggcctggcaatcttggagaaattttcgatgaaccgacggtaatagcccgcaagtccaagaaaactccggatctaagaaactgtctttggtggggtccactttgtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgatgctcatgttcctcttctgattttgaataaataagtatgtcgtcaatgaataccacgacaaacttgtcaagaaactccataaacactttgttcatcaagttcatgaagaaagtcggtgcattggtgagtccaaaggacataaccgtgcactcaaacaacccataccgagtggtgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatcaacacacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccagatcaattcggaactcgatttctctcttcggtggcattgtagtgaggtctttaggaaatacctcaggatattcttgtactataggaatatcctccaacttcctgggacttttctccactgtttctgtctgaccctcaatagcagcctgattcagactcgctacggacttctgcgacgctggggaacggaaggtgatcttctcccatttgtcgttggttagggtgaattagttatgatttttagaagattatatgtgtttattactataaaagaaaaacccttaatcaatttattgcgcaataattcatcccagggctgacgtcagcacaaggaggggtggcgccgacacgcgggacccgcgggtcagaggcacaggagagagggagagggggcggctggcaagcgggacccaccgggcagcgtcacaaggggggggggaaagcggcgaggcgcccggtcggtccggctcggcttcaaaccggccgaccggttatggcgagggcggtgccgcgcacgcacggtcgccggcgacggcaaccggaggcgcgggaaccgacggcggatgacggcggcgcaaaggcggcgg

SEQ ID NO: 60995 - DNA, 947 bp, Oryza sativa
taaaactagtttcttgcatgagaaatattttttttcatcttttttcctcttttctcattaactctttcgccacctaacttttcacttatgtgaaggattgggattgccctaatgatgaagagagaaaaaatgtttgctcaatggtcaagtgagaatttgtgagttgtaagatactccctccatcccaaaatataagtatttttttacttcaacacaattttcgagatgatattttgatcaatgatatcttataaagttaagatgctttaaatcaaaagacttgaatattatgatagtttgtttaatgattaatctagtaacatcaattgtgcactttttttattttttgactattaatagtcaaagttaaaaaatgcttgacttagtattattctaagattgcttaaaattttaggacggagagagtactaagatagtgatggtacgaatccacttacaattattgtttctaaagtaacgattgaagaatgattgggaagaaggtggggctgtcagctggtttgatctgcggtaaaggtaaaaaaagaaaaaaaaaactcccctacaggtatctgtacttcttttaaaacaaggcaatggtggtgccagtaaatctgccacctcaccaactcgattgtgtagagcattatttacctattactccatggttgtacctactcttctttcatgtgctttaatattacaaaatagtcctacatatgactcttatcttatttcatttctaaaacacaagtttattatgcaaagacacatataaggacgaatttgtcccaaacatcacaactaatttgttccaagcaatattagtacacatctaatttattttatcatagcaaagcacggtgtcggtgaaatgggaaccagggtacccatttatccaacaaaaggatcattatcaaataagtagcatgctcaaaatatcttta

SEQ ID NO: 60996 - DNA, 2628 bp, Oryza sativa
gtcctcagcaaaaggggcgtagaaacctgcaagacctatatcttaagagaacgagctaagatccactttgggcctggcatagtcttgggcccccgggctcaccttagccagcgcaagtcgtgctactcgataaagaggagtgtcgagacataccaaatataaaggtgtaaactgaggtttgcctctagcctagccttgtttcgggtcacagtttcaccttggtccttgtataactcacgtccctctgcctagaggggcactgaaacgtacaagacacgtaatcttggaataatttttcatcaacgacatcttcgagaagctcatctgagaataaccaaactacttctttaaacgcgggagggcgcgacctcagaacttgccgggaagatgggcgtgctccacagccagctgtgaggcagcatgccccgccataaatgaaacaggtttatggggaatccccagccagtctggagttgaaaggacgtggacaagacaccagcgctaagtcacttaggacggtggcgcctgggacacacgtcgcacatgccccgcgccacctaatttagccaaacgggcagagaagcaaccgtgatgctgtttttggcaggtcaggccttgtcaggcccaccacgcaccacatggtgagcacactggcggaggcccaacttgtctcagacggagtccgacaggcccggggtaatatgattttcaagactcgaagggtttcttgaagactgtgtttgggaaccagccggcaacgacaagacgactgataagacaagactaagagtagatttgaaataatgtgagcccctccttggactataaaaggaaggggaccagatatgggtgaagggttggactattttagatcagtactctcgctttgtagcctgaaaaggcctcctttgtacttatctgatctagagaagacaacaaacaccgatacaggactagggtattacacctctgggtgatgtgaacctgtataaactcctgtctccctctcttcgcgcgagggggcgggcacgaacccttatgatcacagatactccgtacctctcaccgtcaatccccctggtcagatcttcactctcgggaggggtctccactccccgctgtccgagggaccaccccctcgacacacgagtatttaactagttgggaagaaagactctggaattttccctaaataaggggtcaacattagaactttgtctggatttgctgatggcttgaaatttctgcgaaaagagccccattagttgcttaataagccaaaaccaaagctaaaatttaaattttcaaacttaaaaattgttttttaagatattttcaatatagcttctttgtcaatattggtttttaagtcgataaaaacatatacatatatgggaacactacaaaaggttagctccacgaccttgaacctcactaatagaggcagttaaactagattgggtcaagcctgttgtgcacgacagcaatgcctcgccacgccacatgctatgtgcatctatgaggcttctggccaacaccaaatctagcaaaaggagccagatccagccaagcatcctcgccaacagtatggaagatgacgatgcgcgatggatccactgccatctggtggaaagaggggcaaacagccttccaccggagcgggcaaccacaactacacctccgttgtagctccgcatgacaccttcggctaagatgattgaaagcaaggaaaaagaaaaaaagaaaaaaaaaggagaaggaaagggcatagcatccttcaccttcgcatgacaccttcacataatgttgtgggcagagcaagatgatatctctaaatatagcataatgtgaaggtgaaggagagaaattagaagagagagggtgagcgatctctcgtgcaagcagcaacctctacatcatctccaataaaaatgcaagatggtgtaagattgaactaataaaaaaatattaaagtttgtgtattaaagatgatatgctatacttatctcctaattaataaatagatcatatggctcaaattagagatagcatccatatgcactataaaactttctcttatagaggactcgagggaggtagcaacaggggcaagtgcgtccatctccaccgccaccaacaacgttggggttgatgccttgatgggagacgactcaagggttgtggcaagatctaactcccgagctgccggatgcgttcttttctttcatttcctaacttctactccttgtttgtcacgcgcaagcttgccgaactgctaaacggtgttttttttaaaaaaaagttatatattaaagtttatttgaaaaaatatattaatttattttcaagttttttaagctaatacttaattaatcatgtgttaattgatcgatccgttttacatgccaagaaagggttcagacacaaccttaggatgcatattagtggacatactaattaagtattaactatcttaaactttgagaattgatttattaaatagaaaaattttgtattaaacgcatcatttagcacttgatgtccatgatcccttcccatgctgctaagccacgcttctacagttgctaagccccctgccacctgtgtagcagtcagccgcctgttggg

SEQ ID NO: 60997 - DNA, 3532 bp, Oryza sativa
atttttagtcctggttggtagtaccaaccgggagtaaagatctaaatgatctttagtcccggttggtagccccctgacaatacctgtgacggggctgaaccaggactaaaatcatctttagtcctggttggagatcacaatttttttaaccggaactaaaaatcgtttttagtcccggtttttaatgaaaccgggactattgtggaatttggtcgaccgaccaaagatggtttctccaccagtgttcttatacattttcttaacattgatttttattttaactgcattttaagttgatcttaaaatcggaccatatgatttacttactctgaatagcttattttctggatgttcttcaggaatttggatgcaactgcactaggaattcatctggatttttttggttggttgtgataactgcagcaaaacatctcaagaggataaaccttcactgtcattgaaataaaaaatacacttattaattgaataacgtatttttaatccattctgaacagtgcagaactttctgaattatctatcggtgtttagcggttgattgttgttttattgaggggtattattaaatatcaaagtagatagatgcagataaagaatcaagttttatgacttggttttagttatacatatttttcttcaaagtgcaaaaataaaaattgtactccctccgtcccatgatataagggattttgagtttttgcttgcactgtttgaccactcgtcttatttaaaaaaattgtgatggtgactcatacatatattgtcattactaaatatcaccatagcattagcacgggcacaataatgttttatagtcaattaatgacttgtttctttttagtatcgctaagcagctcacctaaaaaagttagaacaaaaccatacacaggggccaaaaaaagcagggtgagtggcggccaaggatcaaagtgtcaagggggcatttgcccccgctcactgcaaaattgagtggtgttgatgaaaaacacgaggcctgggagatctgcttaactccagtgcaggtccaaaactcgccttcgggtatgctagcgtaccataccaaatttggtcgttaacaggtgggggcaaaggtccccacttgtaatactctagatctgcacatgaccatacatccctagctccctgccaaatctatgctccctgtagttggtcggcttgtagtagacttgtgacgtacaagtgtaaagaaaaatctatgcactccatcgttataaaaggaaacgctctctcactcccttctcatcacttcgctcactcactctcactcatttcctcccattagtcttcccactcacgtctcactcctctcactcacttctcactcgaatgagtcagcagccaccctgttgtgggcacgcatcctaaggggctgccaaggcaaccagggcgggaagggtagtcggggtcagctaggatgaaaaggagaaccaggtggcgacggtggcttgagcgtacacggtggcgcaagcggcgacggtggtggtctaggttaccatggcgctagaggaggatgaggacaagatagcagaaatggtggccgcgggtcaacggcagtgggcgcataaggtctagggcgaggtggtaagccatgatgcggttatgatcgttaggttggtttagtcattctttttacaacttgcctcgatccttactgcaaatggcaaattcatgcaagaaagagtgtagctaataggtggaggataactagtgcaggtgaagacaaacatgctcagtgcggaattatctggcaagtacttgcagctaacttcaaggtttattggcaacaggttacagacatttgtccaagctgagccaatcttgtgtcctgtaggtattgtcgaggcagttgagcaaatatgtcactatcgacatacgtacaacaaagcttggcgtgtttagcaagttgctatgaaggttgtttggggagattgggacgaggcatatgaatgccatgaaagaaaaaaaaaacccgaacatgcattttcgtgttgaggctcaccatgagaagtcaagaattgtggaaggagtgcatagttgtgtatttggccgtgcgtcatgatattcgggcagttagtggaggcattcaagcacttgaggtcggtgttagcaattgatgggaccttcttgaccggtaaatttaggggtgtattgctcacaaaaatagggacattgtctgatcagccataatagagaagtgtgtataatatctgataagcacccaggcatattgaactccatcaacaacgagatactagggcatcaacccattcaccatagatggtgcacgaggcacctatgcactaacttctatatcactagagctacccaggatcagatgaatgacctcgagcgcatatgtcaaataaacaagaaagttgtgttcctatgtgcggtgaagtgccccatgggtttggttggaaagtgatcaaagaagtggctagaggacaatatgccacttaaggttaaatgggccagatcatttgataccgatggacgtctatacaacttcatggctagcaatatggtcgagagtttctacaatgtcttgagaggcattcaaaaattctttttatgtcaaaaggagaatgtgtaataacttttttataccaagagcacgatatgagaggagagatgagttgcacaagaaacgggggcgggtggggtaggaaagaaaattcttgacattgaaaatagaggaggagcgagggaggggggaatgagtgaagagtctagtggagacaacaaatgttgataaatgtgggtgtaattctttttacatcaagatgaggggctgtgaggcgcactattaagtagcgcactgtttagcgcatattagtttgttttttttactttacgcatgcatgacctatttagttttatatttacatcagattttctttcatatgaccgatgaaaggtctgagagttttataaaaaattaacagcaccatacatttaaaagcaagaagtaattttttttattagataaggatattttttacctggcctatacatccaaccgtgtgtatatatatatatatatatgtgtatatacatatgtatatgtatatatatatatatgtatatgtatatacatatatatgtatatgtatatatatgcagctatttaaattgggaacttagccatacgaacaaccaaatctaaaattcactcctatggagatatatttgaaggatcttatggtgctaggaataattaaatgtgcaaccactatatcttccattcactcaagtacattcttgtcacatcacatcttattctcacgttaagctcgcgctcttagtatgatttcacgtgtttctcgcaggcgtggttatttgtcacatcaagttccagatctcattcaaatgcatttcgctactaggtaattaagttaataattacatttgttagaagtgtatatcacaataataaaatgcaaacgcatttccaatattgctgattaaataacacttattctaaaagaaagta

SEQ ID NO: 60998 - DNA, 4839 bp, Oryza sativa
cccttatattgtgggacagagggagtaaaaatgaagggagctaggagagcgatggatatatgccttcctagctagttcccacacccctcttagctacggaactaaaaataacaacaacaacataataacagaacacataaaaaaatggattagtatgattttttaaagtaattttcctatagacttttttagaaaaaaaatattgtttaatagtttgtgaagcgtgtgcgtgaaaaacaagttagaaaaggttgggacattcacataaaaactcagcctaattaagctggtgtttatgtcacttttaggtccgtatgttttgatacaccatgaacagtagtgctccccctctcacatcgtaaaaagcagtgctccctcgtaataattcagtgaaatgcaaatcagtactatgttgtgttcttaaataatgtagaataaaaataaaaatatactaccgttgttccaaaatataccattataagatggatacatgtattaagaaaatgaaagtgattaaaaacatgttgtgattgattgagaagaaaaaaagaaaaaattaaagggaacatagttgtaatttgttgaaaaaatatattaaaaaattagctttattttggtacaagttaagtacatatctgggttagaagcagtgagaaagaagtgagaggattcattcgatcattcgtcgccagctacgaaaaatctacaaggacaggaacaaacagatggatgtttcgtcgccatcgcatgcggagcgcgcggtgagccctgcctgccgaatccacgagatatcatatcaaccctgcagcactagctgccactccgtttggtgcagcgtccataaccaaatctagaaataattgccatttccaattaaataattgcacgtgcactgcatgtctggttaataattaaataatcttcgaaagttttgacaaacttgacccggtccattgtcgagataagctctttaaattaagggtcaatttttcaaattttcgcggaagtaatccctagctaactagctagctgaccaattaccattgtttctttaatatatgacttatttggtttttcaaatttatttgactattcgctgaaatattcatgcaaagaaatcacaaacacggtagacatgcttaaagtacttttgattattagtattttttaaatttacttaacaaagtaactaataaataggaaaaaattctatatgtcccaaaaacattggatagaagttcattgaacaccctaaactttaaaattaaacatccaaccaccgaacattgtcataccattcatatattacagacattggttttttatattttaaagtttaaacgaggggttttgacaaaaataatataacatatgcttacataaaatccatcatccgttattagtttgtacagtaatgttatattaagttcgcactcatcccttctttctataaagctaatgcccactaaacacctagagctcaacatgtaagtgttgtatttattagtactcctaaaacctagatgcaagcatgccacatcaacccattaagcacacaaatctcaatatgcaagcatatagtaattatatctacaatttatttcattctaaaactaaacatacacatgctaaaccatcattctcaaattattttcatattatttcaatccaaattatttcattaattctccaatatctaatatatatcccgtggcaaagcgtgggatatcttttagtttatataggagtacaagtgaaagaaataagggggtaaagaagagaatcaagtgaagatttaacatatacatccaagacatatgtcacatattcaaactcatccattgtatatacaaattatatagtaatcatttttttaaaccatcatatgggctgcatagatggtattataaactacataggattaaacgtctggttttaaagtttagggtgttagatggactatcatctaaagtttacggggtatatggaatttcttccccaataaatattattcaaagtttaaggaaaaaaatctacatcatatattagaaatggagaggtatatacgtgggtttagactgatggtgtgatattatctttcacgttatattttaataaacacggatgacctataacatgtttattttttttcctccgaggaatggccctcgtaaccatgttgtctattcagatctgcacaatatttttataattaatgatttctaatatagtatacatgacaggctatcatcttactataatagagcgtatggccccatcatttggcttattacggaataagccaaacgacatatttgcaaatgaaaaataatttgtaaataaaacttttttatatgtgtttttagtgatctaaaagcaaaggctaaaaagaaaacttcggtgaaaatccctaaaatcatgataagtataagcataagcgaaaaatgaggcttgtttctcccttgttttctcatgatttcacatcatcatagcatactccctcatactataaaattgttcatgcgcaagctactccctcacctagtcgattaattatattggccgcgtggtcactagcatgcatcatttcgttaattaattaattgctcttacgtacccttccattttcggtgtataaataggcaacctccagtggacatggcctcttcagagatacatataccatcaactcacgtaatggatgtcctcgtactactcatctcactgatcctcctggtgagtgtgaatttgctgttaatttagtttagaaattaacctctgaagatacattctgcgtgacagttaattgattatatatatgtttatatgcggcaatcaatcgtatctctcctgtcagtaatttttaccaacgtaacttaatttatcaaggtatatataccttacaaagtgtaaaccctgcttactactcttacttattagtatctctgctatcacttaatttttttttcatttactcggaattgattgctttacattgtttgtcaattatgttaggctttgttcggcaacaatatacagtgttttcttattaaaaaatattactgtgtttctaaatgaagagttagctagctagttttggaatatgtaataacatgggaagaataactgtaaactagcatgcactacccagtacctacatagagtgcttatattatggtatatatacacattatttagttttcatttgatttattgtctagattagttttttctgtacttcatatgttggtgagtatacatgtcagttgtaacttaggtgatgtcacaaattatattataagttgcaacaattttggaatgcacgataatcataaatataaggcaaaatttgctacacgacacgtaaaaattgtgtaattagctgagggacaccgcaaaaacgtgacactgccccaacacactacaaaaactgtgaaatttgctgtaggacaccgtgcacattattttatcattttctagctgaaagtggtgagaatatttttgaaatgcccagattgcccccgcacgtcaccacacacagacaaaaaaaacaattctccattaggatggccgaaggggcgcagctagctgcggccggaggggcggcgcgagcggcggggcacggcctggtggcggcagcgccggtgcgacgggggcgcagccgagcggaggaagagttcgaccctggcgttggcactgggcacggcagaccgaggatggcacgacgatgccagcggctgggcggaggtagcgcggcgttcacggcgtggacccgaaggcgacgacatcgacattgagggcatggtgctgctacagcctgcttctggggcgcgcggtggctgccgtcggaggaggaggaggaggccagctggcgcgacgagccgctgatggtcgcgccggacaggctggacgcgctcgggccgtacatgacgggcggcaccgctggcaacgacgccccgcggatcgaccctcccgccaaggacgtgtcgttgcttccacgctgcagtgcgctggttgccgtcgccgagaaggaagtactgagtgaacgcggccgctagtactgagtgaacgcggcgcccttggttgaacaaaaagcaacgagaaagagagagaatgggagagagagaaaagataaggaagaataaagaaaaaagaaaaaaaatgaaggatagaatcgtacttacacaggtgtttctctctccaattcctccggatataataaaattatccgacgggtgtccaacagcaaattaccggttttttgtggtgttctttagcaaatttacgttcttgcgatgtccacaggctaattatacatttttttggatgtcctgtagtaaattttgcctaaatataatgcagatcggaggaagcagcggtgcaaacatggcggttgctgtgaccaaaccgtccccaacagcgatggagtattggcagaaaaaattccctgagacacccatgcccccagccatactagacctgctgacaccactgcctacaggtctctatctttctgctgatagttattaaaccaagaaatatttaaatttatatggttaaaatttaagtacttgttgagacaaatatattgctagatataatttactgtacattaaatacaaacatttaagaagatattaatacacagttttgaaagtgtaatataacaccactttttcaaaaagactagcctttttttcccaagcctcctattacactgctagtaaaaatcgattttcgcaggtgatctaaataaagaggggacgagtgtgttgtcaaaaatggtttttttaactactatgagatcatatagttctttttcctgataacatggaaaaa

SEQ ID NO: 60999 - DNA, 1167 bp, Oryza sativa
cgggctacaaagaaactaaaggaaagatgtatgttgtaatacgctggatatcttatatatatatcaactgaaaacaaaaagaattgggccacattagctgcagaaggactcaaggaagtttctgtgtcatatggaagtgaaggtaaagaggagcctaagaaagcattccccatgggacgatatatgttagacaaggaacgagaaatgacttcatgtatagataaaggttagaacgtttgaatttggtatattgtatttttgtatatgtcattgaaatatataaagaactaaataaattgtttctatatgggccttgaactagagacaaactcaaagaagtccaggtattagagaacattagcgtattgtatatttgtaaaagttgttaacataaaaagaaaaaatataaaaatattttctgtattgcctatgaattgtagaggacctcagagaagtctcagtgtcatatgactcaaacgtgaaactaagcaatttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctccatgacatatggaagtgatggtgaagaggagccaaggaaaacattctctcaagtagggtatatgttagataaggaacgcaagaagtcttcagatgtagatgaaggtacaatatttgagagtgcattatgtgttctgtgttttctctatgttgttgacatatttggaaaaactacataaattatttctacatggaccatgaactgtaggggaactcggaatagtctgggtgtcatatggcccaaaagtgaaactacacaattagttccccacagaacataagaaataaatatacataaacgaagatgatattatttggaactaaaggagattagtgtaatgtattgcatgtctcatataaatgtctattgaaaataaaaacaaatgagccttacgagctgcagatggactaaaggaagtctcggtgtcatatggaagtaatggcgaagaggagacaagcaaaacctttgctatgggaggattcatggcagataaggaatgcgaaatgtcc

SEQ ID NO: 61000 - DNA, 2972 bp, Oryza sativa
atctgggaaatgctttggtacgggtataatgtttgcttatgcaattacactatgtcatgacgatgatattagagtagtatttggtagtttaacgtggtgtctagattacgggatatcattatttggggttatatgctgcggatgagaggtgggccgctgatggtgacagctcagtacgggtattcctccgtgcctgtatatagtcctaagttaattccctagggagggtattcctccgtatttagccccggttgtatggtcatgactggctgtcgtaaggaacttagcagtcagaggtggcttctcgaagtaccacgagggcatcggatagagggtattagctagtgtatcagttaactagaatgtatttatattatgtatactagaagtataggaatagattatctttctcttttctttccacttagcttagataatatattatgagaatgagtagctaatgcttgtgtgtcactctacccttggattatctgaaccccttcttagaatatgattatcacaagtaatatataaattattagtcaagttctctctacatgatcttctcatgggataaaataaatacgatacctttggaatactctcaggtgaaatgccacaatggtatatccgtgcgttagcggataaactctataaccgtaatataccaggagtatttctacgccattgctgggaattatatttctagtaatgtcattaagaaataccaacagtggatacacaatataatctaacagtaaaaaccagccgattgtgaattagatcgtgaaactaataaatattataaagtatatatgataactcgaagaattacgtaaacaagattagagtgtcataaagatggaagcgctaatcccgataacgcaaaccaccataacaagttttacctctagttgaagatcggaatcgatgcagctcaacccaaaagcaagaactcgtcgaaataaaacgaaagtaaaaaaggttggcgatgcgccgagagtgttattgaactgttgttgtttgattacatgggttcgggtcatatttatacccaaaatacataagatgtccttgccggacacaactcttatctctaacaaactctaagatacataagtctttatagcagacttttgcccaaacatatctctaagaaaattacacaaaatgtactaattaatagatacagttgcctatccgagagcttatctccattgtggcaatccttgtgaagcacgctgatcgattctagaagcagttccataactgatctcgctataatcggctatatcggtagtatcagttatatcggctgccctctgtccgatccatctcagccgatacagactacagctgatgccttcgcagccaatttagactctgttcttcgaatctaattctttgccgaatccacattgactccaatgctggacctggtttgtatcttaccaaatttggtcgtcaacaagaagacgacgacctcatgagtgtcaggagttgggaaagccttgccgcacgccggacgccatccgatgatctcctttgccggaaaaactccttgcaccaccatctccttgagattttcctccgtaacgtcggagggcgcccattgactctcgaagctttctctctcttccgccatggatgcaaaaggaatgaagagatctggagcgagggctgcgacgattggtggggagattgatgtggtggttgcgcggaggaatttcgcggaaggaaaatggttcggaggaggcggattgagatgtgattgcaaaccctagttttcaccggcgtgggtctgttacatcagcgtgaaatggggaaagaagcagcagttgtggcgaggaagacgaaggggtttccttcgatgtgatttttatcgctgggtatcggaaagcgctgatgggcctgggcctaaacagtgttttcagcccaaatatatttccggtgtggctaattgtggtcttttaggacttaggcatatttttgcttaggctaaattgcccacaataatagagcccaataccgttaaattcctttctatgcagttcgataattctttgaaatttctacgatgcatatatggaggtgcccaacagtaaaaacgtcatgttatttttgttgacctttttataaggccacaaaactgttagggtttaatcaggacaaccagtttccaaagctgttattcctttgcgcatttatatgcttaatttctctgaatacaggcttaagttacagcttaggctggataaacttaatagtcggtattaattaagcggttgataaatcctttaagagttttactcggattatttatcacgaaagctattttaagctccaaaatagatcatagatcgtttttccattctgatctttatatatctttatggtgagcttattaggttaaagcagtcggctgaatctttggataaaaatcgcatatgttttgctatttgattacttcggtaatattatctataaaaccactcggctggttattgaactataccttgactatatatttagttttgtttaactaatcacatagttaggggctacacctaattaggtgcatctagtcgatgcacctgattttttattttttagccctccatagccttcagttcaagcactcggaataacaagacagagatagtcgaagtactcagattttcgttcaatggtttcagaggagattatttcatcgactgtgaaggtctctgggactactgtgtagattatggataccccatacccacacggtatgtatatccgactaggtataggggtaccatatacagatagaatgtcttaagtaaaggactcggttgttttattaacttgtgtctcaagcaaacgcccgaggatcctagtctgttaagattgtaatttatctttacttgcatattccgttaggaatatgggctgtatcttgtaacaccgactcctccccttatataaggagg

SEQ ID NO: 61001 - DNA, 54452 bp, Oryza sativa
  unsure (1)..(54452): unsure at all n locations
cactttgcttattttaattggttaaaattatttccaatgctctgaaaattccactaaaaatcctgttagcatattttgacatgtagaatccaagaaaaattccacatgccgattccgattattatttgcatttattaatttagggtttctctcttgcctctaaagaaataatttcttccaaccatttattaattgaatttttgctagggaaaagaacttctgggcgcgacagacagccatgttcccacgtcgcgcctgcttccggcggaagtggaggtaggtatgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattatgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcagctacccttctcttcttcttgtagctgtcccatctcctttctccttctagtgccgccttgacaccatcctccccccaatcttccgctcaccgttccaggcgtcaactcccagtgaggacggaagcagaatgacgtctcctgtctctagcatccatgagaccatgatggcattgctacgacaattgccgttgttgattgcatcttttgatccaggaagaagtcaaagaaaaatcctttggacttagaacaggttttgttcatctctgcttgatgcaatctagcacaatcccaaattcgaacggtaagggctcactgtaatgagagagaggagatagggggagagagacgagagggaatgataatgaagaagaaaaagacgaagcaagcaacaccattccgacattcttcaatattggcacccaccaagaccgacggtgttgcacgacgtcgaagccagtgtagaacgtcatgaagacataggcgtgcaacgctatgctgggcttgtgacttggcattaccacctccctcgtctctcctcctgcctgctcagcctcgccggcgcctatatagatgccaaagaccagggtcgatgtgtcatgtcatagaaaaccaccatatataaaaaccggtttaggagtcgttttgtacggtttaaactgttggaggcgttgttatacctgattttgcggttgaggggtatgaatcaaattcgacctatatttgagggagtctagttgaactttcccctttctatttggatccgaatccaacgcgcatagccccagttgagttttgaagtaaacacgacgccgagttttatgcatgcgacgcgactcgccgccggtcacgaacttacgatggcgtccaccgccgccggcgacgacttccgggattggtccgggctgccggaggacctcctgctcaccgccatggaggcgatgcaactccccgacctagtccactccggcgccgtctgcagatcgtggcactcggcgttcgccacgttccgccgcctcggcctccggtcgccgccgcacccgccctgcctgctgtacgccgccgccgccgccgccgacaatgccgtccgcctctactcgccgtcgtccaccggcgcccacttccgcgtgcccctcctcgacgaggaggcggccagcggcgtcgtcggttcggcgcacgggtggctgttcacaagcgacagggacgccaacccttacctcctcaacccgctcaccggcgcccgcgccgcgctcccgccggccacggcgctcgggcgcgtcaggggcaggaggttcgtcttctcccccggcgacggcggccgccggggcgtcgcgtacgacgtcgacttcggccggcggccgggcggctcccccgacgtcaggcaggtcatggcgcggcgggcgaggcggtggatgtaccgccgggtggcgatgtcggcgagcccttccgccgccaccggctgcgtcgtcctgctcctgcacatgccggagcgggagctgtccttcgccaggccgggcgacgagcgctggacgccgctcgtcgacggcggcgtctgggccagccacggcacctccttcctcgacgccgtccacaaccccggcgacggcctattctacgtgctgcaggactccagccccggcggcgacaccgtggtgcactccctcgacctcaccgcgccgccgccgccgccgtcctccccggtggccacgatgctcatgttcgcgacgccgccgcgtccgtgcaaccaccacctcaagaagaccatgtgcaggtacctcgccatcacgccgcagcacccgcagcacgtcgccggcggcctcgaattcctcgtcgtggagcggaggtggcgcaggtcggggagcgacgacgacgcgagcacgacggagatgtacgtcgtcatgctcaggcctctcgacctctacttctacgagcaggtgagcctgcccggcggcgtggggggcgacctcgcgctgttcgtcggccacgccggcgccgcctgcctccgcgtggaggactaccccatgtttcgcggcaactgcgcctacctcaccgacgaaagcgacggcgacggcgaccacgcgaacccgccgtcgtggaagcggctggaccttgctctgtgggagttcggcgggagcaactaccgcgggaggttgacgaagctgcgggacatgtggccactccaccatccatggcaagataattccccgcctcctatttggtttacgccatcgctagattagcgcatctccaattcaaaggtgtgtgataagctatatattgttgttattttttaaaaaaaataatacaattgtaatgcaactaattacattgtactcataacttatattatagagaaaattctctacatacccttgaaaagtttcacaatttcttctatacccctaaattttacttcatcctatacatacctttgagttttcatttggatcttctctcacctatacgaacgctatgattttttcatttcttgctcgtataaatcttgaaacaaatttaacaattcaacaattattaaaagttatatacaagttacaatataattacactacttagattgagaattcgagagaaaccaggtgaggagaattggacaaacaaaataggaatggagctagtacttagattgagaattcgagagaaaccaggtgaggagaattggacaagcaaaataggaatggagctagtacttagattgagaattcgagagaaaccaggtgaggagaattggacaagcaaaataggaatggagctagctgaagtgttcttataaaataaacttgaaagatggagttaggtttagattactctacaactttacttcagacctacaactttacttcagacctagctcttacctagctcttgaagctaaacttacaagttggaaactaaatataaactccacttcttttctagccattccgctctatcggatctatggtagtctcagattcttttctagccatttcgctctatcggatctatggtagtctcagatttggtattcagtagaatttcagaacatactcaacatagcaatcccctacaaccatacaaggcaagcagaatctgaaggcaaattctagactaatgattcatgtatcttttaactcccaatttaaacagacagcattggacatttggaaaccaactgctgcaagcctgcaacaggtgaagaaggatatactgggcaaggaccaaggagaatcaacttataacacaaaataattcacaagttgcattgatgttctgcaacagtcctagcctgcccattgacatataactccaatatacacaagaaataaaattttaacatgaacaaattttcaagcaatatacaatggaatgcttaatgacaagctgaaaaaaaggggatgtctactccggaaatgacaaatccacggtactttgagcgaatcaactttccatgaagcacacacctcactattcacaagactgcaagaagggattaaataaccaaatgtgcaatcgaatcaaccttggactggaacttcattcgaagcaaccaaagtggtggcccggtctggccctgttgcatcctcaacaccatgttcaacagtgagcccctctgggccagaaggttcagcaggagggatttcaaccgagttgtcttgcaattgctctaccttggctcttggagcttttggttttgtgtttgaggttttctgctttgtcacaaggggttttgtctcggtctttgcagtggcagatgcttgggaaggaatttttgtgactgatctttgagcaggctttctggcagtagcatgaggtttgttattttctgtgctttcggtcaatttggccaaattagttatgctccgaggactctcacatgatacagaaccatcaacagaagcagcagcagcagaattggttggcttgtgccggccaagctttggtgacctagcgcgtgttggtgggatctgcaaatagtcacatgagttgatttcattatttctttataaatatgaatgggaacaggttcttagtgccatacaaaagatagcatatgtataaggaaactgaacacccaaaaaaaacataagaaaccacagagaagttgtttatcatgttctgaactatgaatagtctagcttactgtaaaatggcaaagctggttctgctagcatacagcttggatggagaagaccaagtatttgtcagtactccgattaaattaccttacaaactacaaatcttggtgattactccgtcaaaacatatagacatattatgatggatgatttgaatacattaggcagttcagggattcaaaaccatgaaaactaaatacagaaaggtataaactgacaaggtggaacctgccattgtatagccctagcaccaagatttgcaagaaaaatgcttggcatactcaatcattacagtacaagcctgaaatttgtacagctacttcaatcctcaatactattatgaagatccagtagaacataagtaatatcatgccagaagatctagcaaagcatacaaaattatgcacagctaggcctagttaagtttcccctccataggtaggcctctttctctaggaactggacccagctcagttggtgggaggtgtgcttataaactcccaccatctacgtacaagccctcttggacttgaatttggtgcctattatcttcttcattaaaaaatatgctagttcctcctaggtattcctgctttctttcatactagatcaaaatgatgacttatcacatatatctatcagcactcaacgggaccaaaattcaaacttcaatgtaggatcattttgtcaaccaatgatgatttaggatcagatctgctaattgttagttgagtactcttgttagtttacacgtttatattgtgctaaaattggaaacgagcaagaatgaaattgacaccaaaagatgccagtgagcagaaacatgaggcagcactcctagaagggttacaactaaggtgttatcaaaacgcgacttatcaaaaagatagcacaaacagataataagcatgtttttttttcttaagacgtcttcgcccctaatacctccaagcatgttgctaataaacaagttctggtattaattcctggtatattaagctacagattgacatcatgtaatgcttattttaacattctaataacagaaactagaaacaaatgattatttttcaatttatatcatacagtgaacagagtatttgaaatgtccatgcaaacttgtcaaggcatgtttggtggtgaggatattgcagtctagaactctagaagtcttgaataatgtggatttttttttgccaacagatatcagcaactttgcaagatcaagtttatcttagtacctttttcaactcaactttaggaggttgctccttgtaaaagcttggcatgggtgtcgctttaaatgtcaggctcttcctaagtaatttgatctcagcctcttggctctcctgagtaatagattaattttcagatccaagtggtacaaatattcaaaagttttatattaatgatatcaaaaaggttctcactttagattttgcctgcaaatttgtttgttcaagctcctttgcatggatcttctcttcaagtttttggtagaactgaaagtaagacagcactaaacctggtcagcataaggggggaaaagagaatgtaaatgaacatatggattagcgcaatgcctttatgggtataatatacctccttcctcttctcagcacgctcctgcagcctgaaactaaaaccagcagcagcagcagcattcttgcgttgagcagctgctcggggagtattggtactcctgcatgaataaatgagcatgtttcatgttaataaaaacacagggcataaaaaaagagcagctatcaagaaaataaaaatgctttacgatgtggtggagtgcacatcatcctccattttctctggcagagtctgttccaaagcatttgtggtgttctcgtttgacctgatataaaagatcaaccatttcaggccaagcaaaccccaaacagcactattatgaattatcagtggcagtaccatataatttttttctggcaagcatcacaacttggatgcacattaattgcatggtgctaactactaaacaacaactgaaattgcaatccagaagaaagaaaaggacggccaaaattgttggttggtgacagaattgacactcactcttgggtttcaggagaagcatcatttggaggcgcgtccaccgatccagatttaacaggctacgtcacagaaatctgtaattaatttttactgcattgcaactaaaaattgacaagattgttactcgcggaagatcactcaaactcatgagttttaccaaggagcggcttgcggcaggcgtccgggctgaattcaccttcttctccacggctcgccctgcgattccatccaaattcagtaaacgcaaacatcaatcaaccatcacaattcacaaaacccgagcgaagaacaagtcccaactaaactaaccagccgccttctccgatccattgggcacagcgcctttcccgtccgtcgtcttggcctgctttggtgtcgccgccttcttggcagccgcccctctcgccgggaacgacgcgctctgcgacagcgcgggcttcttccccaccttgccgttggccaccgccgccgccaccttcggctttctcgccgcggccgcgccccccgatccgcccttctgcgcaaaccaagcaagcaaacacccagagagtcagcaacgaataccaccgcactcaccgtcacaggaatcccgcgatccccgtaccttggccgtcgtcccctccgcggccatcgccaccaccaccaccgcctgatcagatccacccgccgccgccgcctcccccccactggcgagatccccctccgccaccacctccgctacctccacagccccattcaccctcacctcgtcctccccctccatccctccactgactcccacccctatcagatcccagcaagatcgatcacggccaagattcaactcactctaccactactgatcagtgcgggagaggggaggcgatcggtggatggatggatcggcgtggagagatcagtgagaagatggtggtggtggggaggggagaaggcaaccacccaacaaccaccgcgctgggctggctggcagccgatgcggctgcgagtagtgtagagagggagagggaggttgggggggagtgagttggtgtagggagggggagggagacggagacggagacgggacgtgctagccgttcgcgagctggacggtttctctgccgttttttttccgcggacggttttgccccctctcctccactcctcggagtcctctctttttctcatttctcccccgtgtgcgcccgtgcaaaccacctccggaggaggagggggcagagaccccgtgtgtggggtgtggcttttgtccattctgtcagttggtaatacacttcggttgttttctctcctctctcccaacttccacctctctttttccacgtttatacttcctgaacgattaaacggtaattattttaaaagaatttatgttttaaaaaaatcatattaattcatttttaagttttaggctaatactcttcgttttatattataagtcatttgatattttagatgttgcttatttttttataaacttgatcaaacttatcgaagtttgattagaaaaaaaatgtcaaactatttacaatatgaaacggtggaagtatttaattattcatatgctaacggcttgctccgttttatgtgccgagggattagttcctaatctaccataccgaacacaaccttctactctctgtgaagatatgtttaatggtggaggtctcattgtttgatttatgcttatgtttagattctattcggtaccgctttagatctcagacccacggtagatttaaagtttgtatgttaaattgtaattgtttaaagtactaaatttcatctaaaacatgaacaaaaataatttatctgaattttatcaacgtaattatagatctagacctatgcatggatttgtgtagttcggaataccgcttcggaaaattttggatccgaagttgtgccaaagaaaactttataagctaaattttaagttttaacacttaattttggagttgattttatgattttttttaatcattacttatttttatagtatttggttttaaatcgctaacagtacggtaaatgttttactcgtaatatttttttaattgaaaataaccggttctgatatacatatgcataagcgaaaatatagggcgaatgttaatgatgctacacaaatgtaggtggtgattcgttcgttcggagtcaaatcattttgtgtgttagctatgtttattctttggacacacagctgtgtggttgttcttatccgctagtaacacggaaaaggtgttaggagagcactgttggtaaggttagactaatgattacctttcctccacaaaatgctgaaaataaacatcatgttcctctccctttcacctatacgagtttcatttaaggattaagagtttttgcatgcatcaaatggtatatttgacacgcatatatatatatatatatatatatatatatatatatatatatgcccgtacaaccatctccgggggttgagaccgtgcgagttgacaatgtgccgactgttaatcaaattacacttctcacactcatatgttcaacaatgtacattgagatattgttgtaggtagtgatccatttatttaaaaaattaatcactggttgtggttatgcatactctttttcaaacacaatcgtgtttattcttatcgtctcataagaagagagatgctaggggcaatgttgggtatgatatggctagcatctatcgacacaaattgccaaaagcttcaatcatttatgttgcccataggtttctgtgggcttaaaacatgtgtgatgtgatggtttcaactgttggtaagtttaattaataagtaacataaatataacattctgcacaagatttctgtttttttccttaaagaatctgttataaatagctttctattgaataacatattagcatattataaaaatcatttgtgctatacgtcgccactacaaatgatataacaaaaaagaaattacattacaattttttaccttaatattatcttatattactgctagatggttagttttatctactactatcttatattaatgtagcataatactattctactactacgaatctatataaaaatattagtattttattttttgagacgaaggaagtaacctatcatcaaccgacgaccatccatccacccggcacgtatagatacagcaccgcaccgcaccgcacagcacgtcagagagaataaagcgagaatatttgtcgcgtcagccagccagtcaggggcagtgccgtctcacctgcacgagctgagtcgacgaccagtccatgtccaccaccacgagaaccacacgccgcgcgcgagtggggagcatccgcggcacgcacgcacgtaaaccgcgcgccgtcgtctccggttcttcgctaccgcgtacgtgaagcggagcgcgcgccgcgcggctcgcacaccggccggctgccagtttgttcgggctggagtagttgagcacccccgcggcgcgcgtcttagcttattttcctttggaattttgtggctcgatcgagagcttgctagctgcttgttgcttgtccggatcgatcgatcaaaaaggacagggtgtggaacaaaccgcacgcgtacgtgcatgttcggttgtaggggtgaaaaaaatgtacggaaatttccgacggtatcaaacctgttttgtgtaaaactaatattaaaataatactccctccatccaaaatgtttgacgctgttaattttttaaaatatgtttgaccgttcgtcttattttaaaaaattaagtaattattaattcttttcctatcatttgatttattgttaaatatacttttatctatacatatagttttacatatttcataaaagtttttgaataagacaaacggtcaaatatgtttaaaaaaatcaacggtgtccatttaggtaaggagggagtatcattttagttcattttctcggtcagttggagaagatcgccggtctaatcagttgtcaagcattcaaacggctttttttttaaaaaaaaaaacaaagatcatccagccgggttactatattgttttccataagcacacctataccgaactactaaatgatacttcatccgtaaaatataaacatttatagtaatgaatctagttaactacatatccagttttaactaaaagttgttatattttgggatggaggtagcacttttattttttgcaaaaacattctatataaaacttttttttagcccttataaaaataaaacgaattcttaaacctctttcacgctcatgtcacgtgagagttcatgctcagcgtgaagaaaagctaattttttgggaattttagaccaaacttctaataaactcttttaaagttcaaataaacccatttttctaatttataatagttcatactcaactaatcatgtgttaatagatgatctcattttgcatactgcgaaaaagcgtagccaatccactttgtccaacggagccttagttaagtatatgtgcatacaactcaatatgatatgaaataaaaaatttcacataatttttccgtttcttttttactttatactggatattactcatgtaaaaactttgatcgttcatgttcttttttcaaaaatataaatatttcaaagaatcattgcattatcaaagtactttatatgccaaatataactatatttcgtttatcaaaactttgtaatttttttttaaaaaatattggtcattgataaaattacatttgtcaacacgtcaaaaaaaaagtaactgagggagggagtaattaaatttcaaggatcaagttctacaaatatttagaactaaaatatatattttttaggaaaaaaaaagcctcgacgaggcttctgtgcctgcaaattaaaggttcaccgttcctggacggtcgagttaattaatttcgctgtttttcatgttaatgaatcgagttgattaatacacaaagtacaaaaggcaaaatcgtcaggtacagatcaaaagatcaggaggacggattttctcgttttggcggtgaaaatcaagtttactgctcttccttttgactctcaagtctcaacacgatctcttttgagagcacgcttaagaaagcaacactggggtgggtctctgccgttaattcaacggacggtgtatagaggctgtctggggaggttcctgcagctgcagcttcttctataattagaagctccgtcaaacagtctagcttttagtctaaattctgagaagctgtagttatagaataaaaaaattaactagaagtcagttttttcagattttcagaatttggctaccaaccagctgcttattagaatgttaaccgtccaaacaggccaaagtgttcttcacccgtgcggtgcacccgtgcaacaaaccacctccagaggctgcagaacttgtgggggtacgtgtgtcactgtgtcagttggtaataactttgtactttcgcaagctgcaagcatatctgaatatgttggatggtgtacggtgagactattaattgtacttgttagtggtgattcgtttttttgaagtcaaatgatcgacttgtgcttttgaaacacacatctatcggcgttcttcagctagctaatacgaaaagatgatatggacgacgaagggtatggtattgtactatggttagatggtttagcatcgacaactagatcatgatcgatcatggatcaataattttctttcagtagacgtttgatgtcgcaattctggtatttgtatagtatggggatcgtcggtgctagaatacacgcgagactgaggtaaaagagatggagacgaggatttttatacaggttcgggcccctgaattgttaggtaataaccctacatcctgttggccggagccggtattgctcttattcaccataatcacaccagtacaatatgtggggtagcctatctaactgttgtcgacatggcggtctgaaggtctgactcgtagtcgacaacagggtagccttcctcctcgagctcgcgcccgtcgaaatcagcgatagcgctagattcctacggccgacttctgtaggtaccggatagggccaatccaggcatatctctgatgtcgatatccggcggcttgtcttggcgtatgtaggcttgtatgttgtggcttctggtgggtgtatgttgattgtgttggttctccctctggtcctcctagggggtcttgtatttatacccataggtgtccccttgtacaagtagaactaggaaaaccaatatggatacaatccgagtagtccttgtcgtttccatgtagaactctggttgtctttccttatcggaactcctcctatatccgcaggttgtttccgtataggacatggtatgtggtggatcctatcgagatttagtcaactactattaggtatgtggtatccataaccatgacagtagcccctgacttcaatgcaaatgaacaagttcatgttctcgactgctgaccatggagtaactgttatcgagctcaagtgaccgttctcggtgagttcagagataacgttagacttcctttattagcctcgtgcgggcacctaaagggtttgtctgagtcaatctccgacgacaaccaagaaagtacatagcgtacgactaagtctcttgtcttgccgtaatcgagaatttggattgaaatcaagaaattttatctcggcgggtacaccatctcttcactccgtattccttgtcgagatccagcaaccgttctcgagcgatcgagaaggcgtagagtctgcgacggagccttgtcaacatttgtcgtactcgccttagtcgatcttggtgtagaaccacagagacatggagtcttcaacaatgtcgaatagaattttcctgaaatcaatactcagaaaaaatattaaatagaaatagcccccgagcgaacgctcaaagggtaacatgttataatataacagactagtgaattgaatgtacagactaatgttttgttatatgagcgtcttctctcttaccgactccaatcagtcagtttgtagagtcatacactctccctagcccctagccttgtcgtcggagaatcgttctcggatgataaggctcttggacctttgacctgcctcggttgaacaagcactgatcctagcccccagccgtgaagttggaaaactcattttccgattacacggcttggttaatacgcacggcgagaactcttacacgaccagatcttacatggtcttttgtctctacaggatccgacaaggccttatcggctttgggcgtccccagctgaagttcccttaggttcctcggaggccttgtcaagacggcgtaaagggacagtaggataggtttcaacgctaggtgtcatcgtggcaagggatctctggataaaacacttggcgatctcgtgtacctgatatcaactttgttgaagtagaggtagtggaaggattgctacgccgctagtcgaggaccaggtagtagtcgtaactcgacaacttaaagtggaaatagtgggagaaacgctacatcgctggttgaggaccaggcagtagtcgtaactcgatcacttaaagtggaagtagtgggagagacgctacatcgctggtcgaggaccaggcagtagtcgtaactcgaccacttgaagtgaaaatagtgggagaaacgctacatcgctggtcgaggaccaggcagtagtcgtaactcgaccactagaagcaaatgtacgagagatcactacgatcaactggttgagaaccagtgagaaggtgtctctcgatcatttggagtcgtggcacgaggactgctacgctaccggtcgaagaccagtcgtagctgttcctcaaccatctgaagtcatggtgcgaggaccgctacgccgccgtagtcatacctcgaccatctgaagttaaggcgcgagagattgctatgtaccggttcgagaaccagcgagcgagtagaattatctctcgaacaccaatggaagttgcggtgcgagagattgctacgtcctggtgcgagaaccagcgagcgagtagaattatctctcgagcgccaatggaagttgtagtgtgagagattgctacgtcctggtgcgagaaccagcgagcgagtagaattatctctcaagcaccaatggaagtgctagagttggtttattacatgtgcgtctcatgtggccagcatgactcacacacccaactcgtagcatatccggatgtccattcgcaatcatgtcgggtgatcaagccgacggcgtttacgaggaattatccgttaacaaccttttctcgagtagtccagcgatggccggtgctatgagataggtcgtcggtcttcgttggcaggttgggtgcgataactccgcatttgtcgagaatgttctcgataatggagtgtacttgaccataacctacccgagtacttaattgtttctgaaaaatattttctagaaggcaagatatatagcagataatgtcgagtatatactcaaaaaactgcatggatcttctagtattatcaggacataactgcagatgtaattatcaggcattatgtaaaccgtaaacaagcataatttatacagaagagaacggagcgagcccccagcgttagaccgtagttggcctgacatcggaagcactcgcacaatagatattgtataaaaaacatgctctaggtaaacataataaattattgatctgacaatgctgtatgatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttctggtacgccgcgtatcttaaggcttgggtgatctcgatagaccaagttgtcgatgacaatggtggttccgatctcgtcggaagacatgctccggtcaggttagatctccacagccgaagtcatcgagtagcttgttgtcggagaatccatctcttaaaccaatctcgtcgaaatcctagagcaccaaagtcccctacctggcgcgccactgtcgacgtttgatgtcgcaattctggtatttgcatagtatggggatcgtcggtgctaggatatacgcgagactgaggtaaaagagatggagacgaggatttttatacaggttcgggcccctgaattgttaggtaataaccctacatcctgttggccggagccggtattgctcttattcaccataatcacaccagtacaatatgtggggtagcctatctagctgttgtcgacatggcggtctgaaggtctgactcgtagtcgacaacaaggtagcctttctcctcaagctcgcgcccgacgaaatcagagatagcgctagatccctacggccggcttctgtaggtaccagatagggccgatccaggcatatctctgatgtcgatatccggcggcttgtcttggcgtatgtaggcttgtatgttgtggcttctggtgggtgtatgttgattgtgttggttctccctctggtccttctagagggtcttgtatttatacccataggtgtccccttgtccaagtagaactaggaaaaccaatatggatacaatccgaatagtccttgtcgtttccatgtagaactctggttgtctttccttatcggaactcctcctatatccgcaggttgtttccgtataggacatgtatgtggtgggtcctgccgagatttagtcaactactattaggtatgtggtatccataaccatgacactttcctatccgacaaagctgttgaaagttgccgtagctttacctttaaaaaaaaggttgtcatgtataggtgagatcagcagtgaacacatgactaaattttagtgggtgctatgtttggaactccaagttctaaactccattgcttcgttttccgcacgcacgcttttcaaacggttaaacagttcgtttttttaaaaaaggtttctgtacaaaagttgcttaaaaaaatcgtattaatctatttttttaaaagaatagcaaatacttaattaatcacatactaatgaaccgctccgttttccgtatgtactgtttaggatgagaactggcatatgcgaacacaaccataggcaaaatacatgccaagctgattaaatataaaacaaatctaaaattcatacataaatagattatgtgtcatacataaaatttgtacataaataatggcctgatacttatttatctttttcttccctctagcaatttttttatctaatagaattggatagtacatatagtgggtttggccaacagtaggagggactcaagctagcccaccttgcccccctttgggatcgtcattgggtgagatctctctctatgtctccttaggatctgtttgagttaagagaaaaagataatattgagaagatacgtaaaacgagataagtcattagtgcatgattaattgattattatttttaaacttaaaaaataaattaccatgaatttttaaagcaatttttctatagaaaattagaatatctccatgagcctctctaaattttgctctccatttgctcatttagctaactaggcaaaaaaaacgttgctctccatattttttatctactcttttcttaagaacattttctacatactcctacatcctctctatttaccctctccattttgacaatgaaagccacacgtcaatctctctctccttccgatccccttctctgcacaacccgtcccttccccagtccccacccaccaccacgagaggccaacgttggccactcgcgctagcagggtggctacaccggaggaggaggcgattgatagcggtgatggaggcgagacggacagcactgccacctcgtccacggtggcgtactgtgcggcgaagagaagggaggaagaggcggcaacgtggtggaagacggatgcaacggtactcatgcgggcaatttatttatttatttaaaaattcatatattaaccaaatattaagacagagttcagggggatgtgatccccggtacatcaccatagctgatagaacttacagagcacaccatcctttcggaggccaactgaactaagaaaactagcatccaaataaaactaaacagcaatagaggatgatgtcgcgtacatagcataactgactgactactgccttcatcctatgaagttttaacggaaattaagactgaggtgaaaattaaataatagaagtttatgattgattaagacgagaggtaggtgaagaagttgattttagacattaaaatatgctatatgtgggagggaactacatcttttatagttgaacattttttttatgcgcgagggcaaaagaaaaaagagttacaacctcttggagaaagaaaaaaaaatgttagtttggtagacaaaaatgtcctattctaatctttattttgagctgaaacgaaaacagtcttaaaccctcttacgaaggcatctacgacgtgttcaaattggagccattttaaatcatacatttttcaaaaaaaatgacagatatatggatatatttagtttgttatcaaacataggtaatgcatatagaattttaacaacaatacatttagcctatctgatagacttggtaatgttagcaatttaccgaaattttggtattgctaaatttagtcattttgaaaatgtttatttcaacactaataacctagcatcaaccatccatccacccaccaggccacaggccagcacatacatgatacatcacggtaatagcatgtacaatagcatgtacaatagcagactataagctagctataaacacatatcgagaagataaataagaagagataagagcagcagactatatatttgtagccagttgcagcacagactataagacgcaatgtgtgtataataggtgggaccatatattacttgtgtaatatatgtttatatgtaaaagtatgattagattattaaattgattatagataatttagagctaatactgattggctatactattagagcaagttcaatagtatagccaactactagctccaattatctatagtcaatctaatagcttattcatacaatatttacatactacactattaatacctggtcccatctatcatacgcacacggcgtcttggagtccgtgctgcagctagctacaaatctgtagcctgctgcccttctctctcctcatttatctccttaaaatatgtttgcagctgacttatagtctactattcctcctcttaaacttgctctaacgccagagaataattttcgcgtcagccagccagccaaccaaccgtcgaccgcaagcccaggcacgtatacaccggtccacgtagtacgacgagcccacgagcgcgcgtgcaacgcacgcaaacgtaaccgcgcgtccgcgacccgtcgtttccccacccgacctgcgcccggctgcctctgctgcatctatggatcggggacgcgtacgagcgcgtgcgcgtgcggcgtgcggtgcgatgcgggccgcgcgcggctgatcaccccggggtgccagtttgtccggacgcctcgtccgatcgccaccaaacggccaaacagctagtagtagagcgggcgcgccgcgcgttttcatacgtttgcctttggagttttttgcagcctcgcttgtccggagtcgtcgagcgggcgcgccgcgcgcgcgggcgcatgcgtgcgtgcccggtgggggtggagcacatcgccttcccaactaattaatcagagcaaaactaataatacaaccgatctaataatacaaccgatctgttaagtataagattttttttagccttctctcagcatgtttatataatagttagctctttataattaatacatgacccacttatctctctcaaagagtttattggttcttatgtgttcaaaccagctataagtttatagcccacttctcctctctctctcctctatcctctcctccacctcagcatttagtcggcttatagcatactattatacttgctctcaagtgcgcctccgcgaccgacgaccgggttcgcacttcgatcgcgcagttggtttggttggaaggtgtagtacgtggaacgagagatttttttttcaagtacagctgtggataatttgctaaactttttcagcggggcctaattcttttcaggttttaagggctactggactttcgtgggcacgtcttgtaagacgctaaaattttccatatacgggtatatatacgttcgaataattgtatcaccttgatgcaattgacttagtttaataaaagcttccattatctaaaaaaaatgtcgttacgtgctagatagactagaagggatattggatcagatggttatgcaagcggagtggacgtttcagggcatccgcaatatactctaaaaatggtccataagcaatataatatttgattcagctacttagcaatattgtggaactagtccataggaaagaaataacaaaagctacccataagcatatgggctacccatagagaataaaatatattatttgtctctatctcttctctcctactaatactactccgtatttgctatccatatatattgtgaaggttataatagttagggcctgttcactttgataccatttcaattttgttaaagttacaaaaaaaagtggctacatttagtttgctgccaaattttggtaactatataagaaatcctgccaaaatttggcaagttgccaaaatttggtaatgttttttttttttgcaacaaagtgaacaggcccttaaagctcatatatgtggtttccatctctatggattacttttgccatatacattattgttacccttatagtattagataaaatgtatatctttttttaaaagaatcaaataaataattatttttaaatctgataagcccatacctcactgtaaaatggacctaaccgtaggcacatacggagtacggtttaacgtgatatcatattaatatattaacacgattaaattcaaatttaaactgtcgtgcgcaacaattttagaattatagagagcctcagtttttttttgtgtgtagtgtttgcttgtattgttgactgtgttttgctagagttaggctgtttcaggtaataaaaagaacttttgaatttgaatatactaaggctatgtttttcggtgcatgtccgactctacttccttatttttttaagcacgctttttaaactactaaacggtatgtgcacaacattatatagaaaatttgttttaaaaaattatactaaactattttctaaaaaataattaatacataattaattatgtgctaatgaattactccgtttagaattatttctcttccgtctgagagcaaaaacagcttggaaagctatctatcccctctcttcctccacttgttttctggattcacgtactggttggctgtgttcggatgcctcttttcccaacctctctcccttgttttctacgcacatatttttcccaacccctctcccttgttttccacgcacatgtttttcaaactgctaaacggtgtattttttacaaaaagtttctatacagaagttgtttaaaaaaaattaaattaatctatttttttaaaaaataacaaatacttaattaatcacgcgctaatggatcgctccgttttccgtgatcaccgttccggatgggaacttgttatagcaaccacagcctaatataaaatagtgagataccaattgaaaggaggagacggatttttccctttcgggcggtgaaaatcctgttagtgctcttgcttgactctctcgaaacaatccctttttaagcgcacgcttaaatgtgcatgtgttctttacaacactttctttacttctaatatttattttctatatgttttcttaaacaaaaattttagaggaagttacttttagaaaatcatattaatttatatttcaagttttatctatcaattaattaatcgtgcactaatcttatatagtgaaagcagcaagctttcttgcacgaggatgtgccacattatcaaaaatatattagccgtcggataaaaagttcggataaataatggtcattagatcaaaaaagtgcatgtattaagaaaagaatcaaatttccggaggtttctggtatatcctctaaacatatgatataaagagaaagtgaacaaagagaagaaagatggggcttttaatgattcctcttataaacatatactccctccgtttcacaatgtaaatcattctagcattttccacattcatattgatattaatgaatctagacatatatatctatttagattcattaacatcaacacactagtacagatccttctatctgtgacgggctctaatatgcttagaaataccgggccgtcacaaggaagtcatctcaatcgggccgaaaagtgcccaattgagatatggtcgcacagacatgttagatgggtataaaacttaagcccgtcacggatgacacctatcagtgacgggccacaactttaggcccgattgagataaaattctatatctcaaacgggcctgaccatcatctgtgacgtgcacctcatctgtgacgtgcaccaacttgaggcccgtttgagataacaactagacccgtcacagatgactcatcagtgacgggctatatacttaatctctatcgggcattaactaaagcctgtcaccgatgactatttttccatttttcatatgaaatgtttatatttgtaagttgactatagcaaaataattttacgggtagaaatgatttcaaatggaaaaaatgtcaacaacaaagttgtataacttatcaatatttacaacttttagtttggtcatttttcaatataacattttttttgaacagtttgaatttgaatttaaaaatatgaaaacttcaaataacattttcaaatactaaatgatttcaattgaaaaagtcatcaacaacaaagttgaataactcatcaagatctaaaacttttatttttgttatttcttcatctgacgaaatgttagtaatattattcacaaattttacatatatgtgttatagtttataaaaaaccagataagagatatgtcaattttgtgaacaatgttactatcactttgtcgtatgaagaaatgaccaaaataaaagttttagatcttgatgagttattcaactttgttgttgatgactttttcagttgatatcatttagtatttgaaaatgttgtttgaagttgtcatattttcaaatttaaattcaaacggttcaaaaaatgttatatagaaaaatgaccaaaataaaagttatagattttgatgagttatacaactttgttgttgatgactttttcagttgaagtcgttcactgatctaaaattctatttgaactttttaaactttgaatttcaaatttcaaattgtttaaatagagtcagatggagaaatgaccaaaataaaaattttgcacctcgatgagttctacaactttggttttggtgacttttctatttgaaatcatttagtaacccaaatttgacatcctggcttagggcataataagattaatagaatactcataccaacatgttacaattacttttccggaagccaatctctaaagaactttccgcgtgggtgcacacgagtgagggctagccaaaaaataaaatttatttatttttggaatatactcatctgtgacgggaattaactctagcataagttaatgcccgtcacagatgactcatctatgacgggctataattaatgcccgtcacagatgactcatctgtgacgggctatagttaatgcccgtcacagataagagtcatctgtggcgggcgctagttgtgacccgattaagataggtcatctgtgacgggctatagtttgactggttgtctgggtcaaagctatcggtgacgggctttacttagggcccgattgagatagaatcatccgtgacggccgtttgcccgattgagatagctctttacatcagtgacttctagcctgtgacggacgccatgcccgattgagatgagagtatccgttctagtgacatgaacgtgggaattgctagaataacttatattctgaaacggagtaagtagtactacttggactagaacaatatatacttcgtaaacaaattaacttatatcaaaaccttcttaaaagttaaggtaaactaataaggcatatacaaaagttcttaaatagaattaacagtcgcgcatcgcgcgactatgtggctagtatatgttgttttgtttaagttgtgagaatatcccttaaaaaagcactgcgtaagaaaacaacactcattcgtcactagcttcaccaacactaaagataaacattctcgctgttcagtaatgatgacggtaataccgatggattaggatagatagcaaaagatctcgatcgtccaaatccgaatggagagtgccgtacaagctagcaatacagacaaaattaatagttagtactaattcgtatccagttaaaattctcctccttttttgggtttgacaaggccgcgggcaggcccagatagaatgtgacgtaagcatgactacctatacatttatcgataaattttctattaaaaatttatcaaatgtaaatacaatataattatactgtgattacactgtaactacagaataattacactgtaacttacgtgtaattacactgtaactatagtataactacactgtaactataataattacactgtaatttagtataactatactataactataatataatataaaacttgcatgtaagtgagatgtaactttagaaaacttatgtttggcactgcccacgtgaaagagggattacggactcgcaatgtctgtttgtacaatgcgtgcggaggccatcatccatgcatatgcatgttcggctataccctgctgctttatctctgcccttcgtctgtcatctacgcgggcatgagccacgcctgaggtcggcggccggcggacgtcgaaagaaacaaattaaagcgtcgacacaaaagcacgaatcccaaggttcatcaagcggttcaaaaatcgataaattccaaggaagaaatttgtcagcagatttatagcaaaaccgttatataaattgtggtctaatccaaaggttaattatataagcaattcctcaatacaaaatgtcattaaaatagtggtatatatgaaattgtataaattcttcatgaaaaaatgcgccgccaacagctagcccctcatccacgactccacctcagctcctcgctgccctcgcccccatgctactgccctagctagatgcgccgatgacagcaccggatcaagtcatggggataccggatccagcctcagcggttttggttctatccattgatgcaagcccttccagtccgttctaaaatataaaatacaattatacttttcaccgttctaaaatatataaggatttttagtgtttcctaaaatatatatggaggttttgtgtatttctgaaaaaaatgcatcggaacgtcgagaaaaattttggaaatcacgtaataatccttatattttgtacaagaggccaagagggagtagtttctagagatagaaggaattaccagagttgtccatccaaacaaatttagtttcaaataaacgacaatcatatttcggctagttttagtgttatgatgagaaaatttctgatcacgcacagcattcatcttgactttgaaaaataaaatactttttttttgtttttttgggggcaaatacatttttttttgttgaagagagtataaaagcatatattccttgtgaactttcgatcaatacacatattgttgcttcgctcaaggttgatcgatttatccattaattttaatattggtcgctgtcgaccagctagctaagcgtatacgttcaacaataccagatcactctgctagtacttgatttctctctctagataatctctaaataatgagtcatttggctggtttgttcatatattccattgtattgattgaacaaactaaccagaacattttatactatggtatgcatgtgtggtgtgtcctaccgtgtttctttaataatcgggtttagcacgtccgagatcacaggctcacaactactggacgaaaagaagttttaaaaaaacaaactcttcgtgcacccttgatgttagacttgccaacaagacatggaatatgtgtacacgtattatatattttttattactgttatgtggtctagaatatatgttatgtgttctagaacaaataatattaatatatacatttggatggcccaaaattatttggggtctatcatcactccatgctccgtatgtaaaagtggcaattttttttctctgttttgtattatctcggaacttggtatagcactctgtatttagattgatcagtttgcgcaaaactatttgaagttcaatttttctgctggtccagggtttgaagatctaagaatgggcatggcaaatatatataaagtaggtaggatgtagaaaaaaacagagaatcaattaagggaagcaccaggtttatggtatatcgagtgaaatcatcacatcttaggtgcccacatatatttacatgagtgaaatatatataaggtctctaaatttgtgtaggtatgtcatctagattactggatctttgtgtgatccgaggaaccacatgagcgaggacctacacgtttttaacagaaagttggggggttttgatgcaacattctgattgcatggcgtcgctagtccgtgactttctcagcatgcgtacgtacggtgtttagagaggtaatgttagagattttgtcgctgacctcatcgagcattcacaattgcgggttgcgggtttgaggggtgtgaacgcggacattttttttccatgtgggtctcgtatatgtaacttaaaaaaaaataagcgagagaacaagtaaaaatatcaaaaaataaaactaattaatgccgctcggtcctatttaacacaacactaaattctatatccatattgaatttaaagtttgtatgctaaaatataatggtttaaaattttatatttcatttaaaatagaaaccaaataactcattctaacgctatcaacatatataacataacagtaaactcagattggtaggtttgtgaaggtatatcaatacccaaccttaaaaatcttatatatgtggttatgccaagtaacatcccaatgatcccatatatcggggaggtcgaagctagggagggaggccgaggagcggcgatttgtagtggcttaattaggctgtgttcgggttgtgaggtgggaactaatccatcgtttatataaaacgaagtaacccattaatgcataattaattaagtattagttactttttttaaaaaatagatgaaaataattttttaaagtaactttcatatatatatatatatatatatatatatatatatatatatatatatatattaaaaaacataccgtttagcagtttgaaacacgtgggctagaaatgggttggaaaagttggctgccgaacaccgccaagctcttttgtggcgcggtgctctcgcgtcgcttgccctgtagttcatcctctggccgtgtggccagattgatcgatccggcgaaacaaaatactgagcatgtaccacttcagtgcctctagtggtagcagtagaaaagaaccgagatcgtgtcccatgtggccgtattggtggcaggcagccacacaggctgcatccatgcagatgaggatggagctctatagctagctcagctagcgtgtggtgatcccgattcgatcggaaatgttaattttatctcctcggtcataaactaatactcctaatgatgcttacagagactaattaatcaagtgattagaagcgttgagttactcctaattaaaagtcctaggttaccactacatgacagtggaccacagcatatgttctactccctccgtcccataatataagaaattttgagtttttcatgctgattgaccactcatcttattcaaaaaaatttggaattattatttattttttttgacttactttattacccaaaatactttaagcacaacttttcgttttttatatttgcataaattttttgaataagatgagtggtcaaacaatgcaaataaaaactcaaaatcccttatattatgggacggagggagtacttaattaattaccttagtcatactcccttcgtttaaccacttttaaatttgaatctgaacatagttgagaaattgtttgtagcactcgggtggacgaccacttatttcttacatgttgactaaattgttatgtaaaaatttcacaaaaattgacaagatagagtattatattatatatcactccatagacatgtaagtcaaatttaaattctacaagttttaacaaaaataataaatttaactgtgaatatgcgtatactagttagagtttaatttattgttttttacaacttgtagaaaatcaaatttgaatttgcatgtttacggagtaatatattacatattaattatcttgttaatttattttaatttttataaccatttattcgacgtgtaagaaacgagtggacgtccacctgaaagattggaatctatcaacgaacatatttacgtccgcttcaaatccagaagtgggtcttttttgggtgaagggagtacagatcggagaacagtaaaaaaaatataggggtagttcacgaaagagggagagctgtaaacaaattaaagaataatctagctgttcgatcccactgtactcctgttatttgcaactgctctcgacgggatgagaacgaaatcgaccgaccggccgaccgggcggccgttgcgttggacggaatccgatgcgaggcgaatcatcatcacccgtccttgcttgtctcctcatctacttctccactcccatccagctcaccgtgcgtggagaagccatatcatgcagattctaactacacttgcttccataatcacgtctttctttctaatatcatgtagaaatggcgcatttctttctaatattttttcttagcatgtttttctttttgctttttttactgacgacgaaaaccatattttctccctttttgcttttttttttctcgtgtgtttttgcctattttttctgacaattattttctcgcgcgtttttttcttgtattttcgaatgttcttttttgctttttttcaatacaggagaatatatgacgaaataaaagccgtgtagcagatggcaaaaaattgatgaattctatccgactcaagcgtctatcaatttagcgtttttctgatagttttttcagagcgatttgttttttaatacacggtacttttttcttgcgaggttttctcaaaccattttttttagaaatggcacgtttttttgtagttttttcctcgcatgtttttttttaaaaaattaccgacgatggaaataacttttctcgcacgtttttttatggaagatggaaaacctttttagagtgtttttttgcgcttttttttgacttttttctcatgcgtttttttgaaccgtttttattttctcatgcattttctctttttaaatagttagattagattagagatagagaagagatatataccgattagaaatcagactttgtttcacccattctatttttttctcgcatgcattttttaattcatacgaagcagatttttattttttacgaaccatttttttccactttcttaggaaatcggatgaaattttttagatgttttttttcagattttttttgcctttattggaatcagactttttttttcgtttttaaaggaattggatctagctttttttcaccaccttttgtttgccttttataggaataggattttttttttgttcggatctatgtttttttggccacataggggaaacagacttttgttgttgttgttgtttttcttttttcctttattttttttgcggcttttctttttctttttatgcacctttctgtctttgttatctcccttttattattattattttttaaaaaagacctcaaataccttgttgcaagattatacggacttaaatgtaaatataaaaattatagggattcaaatgcaaaagtacacacccaaaaattaaaatcatataaaaatagaatgctctcgatatgtaggttccttttttgcaaacatatccccaatcaggcacatcaatttttttcatcaagatgtatgggatatcatggcatagattaaaaatgaggggagtggtgcctgggatctcggactcaagcctagaggagaggtgccttttatttttcgtttttaaggggaatcggatctagagttggatttttttcgtcagagatagagaatcggacatattttttttttatttttttcgtccttctttttacccggagtcggacagatccaatttttttgtccggattttttttctgtaatggacagatccgattttttcctttaatgaacagatccgacttttttcctttttcgcctttttttttatcagacgggtttaggttttttttttcacccggttttttctggattggatagatttggttttttcgcccggtttttcgttttttcgcccttttttatcggacaagtttgttttttttcctttttttcgtccagttttttttacggacagatttggttttttggtctggtttttttttacgaacgatggaagcacctcttatttttttttaagtagtagagatagagaattgttgagttcattttgattgtgtttttttaccatactccatttttcagaattattttctaccagtggtggagtcagaaaattttttaagccctgataaacttcaatataactagctataaaaattccatcattaattaaccctttattattaaagtttagtggactttttgccagcgagcccaggcggctgcccggctagccaggcggtggatccgccactgttttctaagttgctaagaagtaagaatacataaaaaaaaaactcccaaattactttttaccgttaatgtgttatgttggcttacaactgctggcatggactgatgtcggcaggcagatggacatagctaatcacaattgacaaagataaaggtagtttaattctcttgtgagttgtgaaacgtgaagctagcgaaggatcctgacagggatgttctcctgtggccctgtgggtagcagccgatcagtggagttagagaggttttggtacattttgatgtatatgtttttccatagattttgccattgccttttgcaaagtgttgggctaatttagcatcacacggtcctgcgagagtcagcctgtccgattagatcaggtcgttttcgtgtggttcggtgtgtgtcctactagcttttctgattgatgctagctttgttgtcacctgtacttgaacacagctatatagctctcacttttccttaacgaaatcaaggcatcgttttaatggacgtgggccttaattcagcctatatgtacatgtttatgggccagaattttcgtactataaacttttatgcaaacaaaggagtaaattgcactcacggtgcatcaacttggtaggtgggtgtaatttggtgcaagaacttgagatataagtgttctagtgcaacaacttggcaggtaggtgcaatttagtataaggcctttataagtgatcatataaatgcaacaacttaaaggtaggtacgattttgatacaaagttatgcggacttaattatttggagctagattcaatttttaagtacttattttgacactatactagcatgtatttgtataagaatatttatatttttatcctaataactaataattgaaagtcaattaaattggatgtagaaattattatatttcggttgatatttgagaaggtgaagaaaacaaaaaattcttaaaaggtaattagatgcaaattgtatgtgcagtataattcttaaagattaaatttactatgtaatggcatattgacatcgtgaaaaaaattcacccactatacaagttgatgcaccaaaatactaaattgcgaagttcttgtagtaaaacacacttacttgtcaagttgttgcattcggacgttcaatttttaagttcttactctatatcgcacccacctgttaagttgttataccatgggtgcaatttactccaaacaaaagtgtcagggttatggataccacatacctaatagtagtcgactaaatctcggcatgacccaccacataccatattctatacggaaacaacctgtggatataggaggagttccggataaggaaagacaaccagagttctacatggaaacgacatggactactcggattgtatccatattggtttccctagttctacttgaacaagggacacctatgggtataaatacaagactccctaggaggagaggagagagaacatagacacacccaccacaatctacggaacaatatatcaagacacaagatcaatgtacaagccaacatacgccaagacaagacgccggatatcgacttcagagataggcacggctagtcccctacggtatctccggatactgataggagagacattgtgctgtctctgatctcgccgggcacgaactcgaggaggaagactaccctgttgttgactacgagtcagatcttcagaccgccatgtcgacaacagttagatagtctaccccaaatattgtacttgtgtgatccagatgaataagagcaataccggctttggccaacaggatgtagggttattacctgacaattcaggggcccgaacctgtataaaaatcctcgtctccatctcttttacctcagtctcgcgtatatcctagtaccaacgatccccatactatgcaaataccggaatcgcgacatcaaacgtcgacagtggcacgccaggtaggggcattttggtgcttcaggatttcgacgagatgggttcaagagatggattctccaacaaaaagctactcgacgacttcggctatggggagatccaacctgtccaagtacatcttccgactagatcggaaccatcatcgtcatcgacaacttggtctatcgagatcatccaagcctcaagatacgcggcgtaccaaaggatgtcagatcatatgatgtcgaacgagtacgcaataggtaattggtagattggttttccaaattgatctactaatttcgtagatacatccggcatgtagctacaaaggtatgcaatattttatatgcaatttatcgtatctattcagatcatacaacattgtcaaatcaataatttattatgtttacccagagcatgtgttttaacaatatctgttgcatgggtgtccccgatgttaaatcgactacgatctaacgctgggggctcgctctgtcttgttctgtataaatcatgcttgtttacagtctacataatgtctgacattttctgctcgttatatcctgataatgctagaagatccatgcagttttttgagcacatactcgatattctatgctatatgcttgccttctagaaaatatttttcaggaacaattgagcactcgagtaggttgtggtcaagtacattgcattatcgagaacggtctcgacaaatgcagagtcgtcgcgcccaacctaccaacgaagaccgacgacctatctcatagcaccggccatggctggactactcgagaaaaggtcgttaacggacaattctcgcgaacgtcgtcggcttgatctcccgacatgattgcgaacggacatccggatatgctataagttgggtgcgtgagtcatgttggccacatgagacgcacatgtaataaaccaactctagcacccccattggtgttcgagagataattctaaacgttcattcgctggtcctcgaaccagtacgtagccatctctcacaccgcaacttccattggtgttcgaagagctcgctggttctcgaaccagtacgtagcaatctctcacaccgcaacttccattggtgttcgaagagatgtttctactcgctcgctggttctcgaaccagtacgtagcaatctgccgcaccgcaaactccattggtgttcgagagatgattctactcactcgctggttctcgaaccagtacgtagcaatctcccgcaccgcaacctccattggtgatcgagagatgattctactcgctcgctggttctcgaaccagtacgtagcaatctcccccaccacaacttccattggtgatcgagagatgattctactcgcttgctggttctcgaaccagtacgtagcaatctcccgcaccgcaacctccattggtgttcgagagattattctactcgctcgctggttctcgaaccagaacgtagcaatctctcgcaccgcaacctcagatggtcgaggtacgactacagcaataacgcagctgtcctcgcaccatgacttcaaatgatcgagagacacctactcactagtcctcaaccagtcaattgtagcgatctctcgtacatttacttctagtgtttaagttacgactactacctggttcttgatcagaggtgtagcgattctcccattacctctacctcaacaaagttgatgtcaggtacacaatatcgccaagtgttttacccagagatcccttaccacaaaagacacctagcgttgaaacctatcctaatgtccctttacgccgtcttgacaaagcctctgaggaacctaagggaacttcggctggggacgcccagagcggataaggctttgtcagatccttcagagacgaaagaccatgtaagatctggtcatgtaagagatctcgccgtgcgtattaaccaagtcgtgtaaccggaaatggattttccaacttcacagctgggggctaggatcagtgcttattcaactaaagcaagtcaaaggtccaagagccttatcctccgagaacgattctccgacgacaaggttgggggatagggagagtgtataactcaacaaactgactgatcgaagtcggtaaaagagtagatgctcatatacaaaacattggtctgtaagtttaattcattttcggttttccatacatattataacatgtcaccctttgagcattcgctcgggggctatttttatctaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaatttcttgacttcaatccaaattcttgattacagcaagacgggagacttagtcgtatgctctgtactttcttggttgacatcggagattgactcagacaaaccctttaggtgtccgcacgaggctgataaaggaagtctaacgttatctctgaattcaccgagaatggtcatatgagcacaataacagttactccaaggtctgtgcgcggttgagaatatgaattcgttcatttgcatcgaagtcgggggctactgtcagggttatggataccacatacctaatagtagtcgactaaatctcggcaggacccaccacataccatgtcctatatggaaacaacctgcggatataggaggagttccggataaggaaatacaaccagagttctacatggaaacgacaaggactactcggattgtatccatattggtttccctagttctacttggacaaagggacacctatgggtataaatacaagactccctaggaggagaggagagagaacatagacacacccaccacaatctacggaacaatagatcaagacacatgatcaacatacaagccaacatacgccaagacaagacgccggatatcgacttcagagataggcacggctagtcccctacgatatctccggatactgataggagagacatcgcgctgtctctgatctcgccaggcacgaactcgaggaggaagactaccctggtatcgactacgagtcagatcttcagaccgccatgtcgacaacagttagataggctaccccaaatattgtacttgtgtgatccagatgaataagagtaataccggcttcggccaacaggatgtagggttattacctgacaattcaggggcccgaacctgtataaaaatcctcatctccatctcttttacctcagtctcgtgtatatcctagtaccaatgatccccatactatgcaaataccggaatcgcgacatcaaacgtcaacaaaaaggcatagaagaatacgcttatttttgtgcaaggaaaatatgcatgttagagcaagctagaaccacatatcaagaatattaaagaagagagaaaaaaacgaactgtagatttgttgccagtggcaatacagacttgaagacgttgtgtgtatatgagaggtgtgaccgggtattaatagattagtatatttttattcgtaactattatataaataggttattagattagttatactccctctgtttcacaatgtaagtcattcgagcatttctcatatttatattgatattaatgaatctagacatatatatctagattcattaacatcaatatgaatgtggaaaatgttagaatgacttacactgtgaaacggaggaagtagatgatttatagatatcatttggctatactattaaacttgctcttacctttaatcttgatttttggccggaacagcacagggacgcttatcgattttattagatttaggaggaataacttaatctcgtctcaaagcaaaatatttgttttatcccataggtaaatatcaaaaggaaatatgggtctaggatttgacatgctacttattagtattacgacatgactatgccccattattttatcacgcaaatatagggttctcaatggctgtatttagttcaccaaaattaaaagtttggttgaaattgaaacgatgtgacgaaaaagttagaagtttgtgtgtgtaggaaatttttgacgtgatgaaaatgttggaagtttgtttaaaaactttggaactaaacacggcaaatatatcctaagtgaaatatactaaagtgtagaacaggaagacaacatgatccatgattgtgtagaccacgaaatactcccccatctcacaataagatcaatttttactaagtcagtttgtccaaaaagaaaattatttttaaacaattattgaatcggagttaatgaaattggaaagtaaatgcattagaagcgtgttcagtgaaaaataattacattaggatttgataaagtggggtattgtagtcttattgattttgtattattttggagtaactaaaatttttaggacggcgaaggtagctagtatcactgaattaatgataattccagtgctcttccgtcctactcatattaagagctcatttgaatcaaaagatttatataggaatttcataggattcaaattctatagaaaatttttctatttggccctttgattcaaatgattgaagctttccaaatcctatgaaattcctatggaatgacatattacatatggtaaaagcttcaacctccaggcacggggttaaaataatagaaatgactataggacatggagaaagtggtgaaatgactgagtactgtggttacattaaagaaataatagaaatcagctttgatggcaccaaacctctcacacttgtgctcttcaattgccattggtttgacccaagccaagtctggtactcgccaagatatggccttgtcgaagttgctcatgcatcaatccttctcaagtttgagccatttgttatagctcatcaagcgacacaagtgtattacatgccatacccatgcaaatctgtgcaagatctcactaattggtgggttgtatataaggtgcagccaattggtagattagaagtacccactgatcaagattatgattttgtccccaacactgatgttgtccactatttccaagaagatggtctgctcggcagttttgtaattgatcttggtctgaactttgataataattctgaagaggttgcctccagtagggatactgaagatatttgcaatggcaaggacttggagcttctcaatggatcatctattcaagatgtcaacgacgatgatgacgagtcttattgtactgactcatccaatgaagatgatgaatatcccaccaatagggatatcttatttgatgaatatttctaaggtaaagacctcaatctgagttggaggccaatctgccaatttgttatatcctacatctgtaaatacatatttatttttatcaaattgcccacaatcgagctttcataaactaatgtgtactgtaatattatttgacagctaacttattttttcatacttacaggcatataatgatatggcaaaggactagagtttatttttaccatcaatccggttaagacaaccactagtgtctattgccttcctaggagaggtgtaagaacttagactgtagtttctatggcatcatgtgtacctagttgttggatgtattcatattgtgttcttctatcatgttccttttagcactgagaatctgcagctaattgtcgatttctaggatcgacaacatattttatagggtgcgctagatcaaagaaagaaatggtgacacaaatgttatactggttcaggccctcgacgtgaggtaataccctagttcagttgtatatggattggatctgtgtccggtatgaagagtggataatgacgcaaggtgcagccatcatccgggttgtcgagagtcatccctcgtctcgggaccccttcccctcttatataggatgaggggggagggttacaaggaaagtatctagttgattgcaactagatccctctattccatctataaaagatatgtaggatcctcgggatttatactttatcccgggtttgtctatttccttatttacaaggcagccatatgggcctatggcccttggcccaccgtatgtcgcagggcccgaatgcctctccttgggtacccgggtaccgtgtaacccacagaagccagctgggagagacaagactggctgagtacttgtagacccccgattttggaaattggaaatcttctgtgtttatccgtaccaatccctggatcagtagttggtacacacatacatagttggatcacaacatatcacgaatgaatttaggctaaaagagttaaatacttacattagggccaggtaggctaacaactatcagagaacaacagcaaaagacaaaataatataagggcctggttaacatgccacaggcagtcgaccggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtattcaaggaatggtttcaggttcttttgcataaagctgcgttttgcaaatattttcacaagcctaagacctatcatagactgatcaaattttagttccagtgttcacattaaacaacgacggttctgtctaccatccattgtgatcccaaggatagcttcccgccattgagtcgtcatggttttttgaggacgtccacgttccctcctctcaggaaatggctccatcagcataaaaatcaccatgcaatatcccatcctacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacgacaaagcttttcgataacctcgcattggcagtacccgctccgtgaactttacatcctcatgcactctaggcgcacacggtttctagcagtgagaggagttctggcgcacccgggagggaaagacttacacatgcattaagttataattatgtttaaattctcacatgacagtcctaccaatggcgacaccactgtagacacccgcctcgcggttctacctatggctgccccaccgtagagcccctgcctcacacatcaagaaaccactatgcatggatactgcctccgctcagccatctactccgccaggtctatacccatacgagaagcgcggttgtacgggggtcgtttcatgcttaacttcatggctcggtccttaattgaccagggacggcactagccttttccggataccacccaaatcctctgtccgccccagtcgaaaatagttgttttagttttatttctcttttcacaaatcatgtcatcaatatcatggcaatgtggcgctcatgtctccacatgccgcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttatttgtatacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtgtgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatactaatttacagttgaactataattataattatatgaggtcaagatttataactagtatttatctaatatacatgtttgtcatacactccctcttaatttcatatatgcaacacgcaaattaatactataccgtaccactataatgggatgtatagtatatgtgtaagcaacaatatcttattattggatcatatatttgagtagtttctttttactgtaagctatacaatacatgttgattttaagatggctctatttggttaactaatggatatcaaccgactatatatatatatatatatatattctacttcacatgacatggtatcaactaattttttttaagtggtccaaatacaactagctctgtgattactctcctaaacaagttaaagattcatctatatgtgtttatagtttagttacaaaatatgaggctaaactttatgtaaataatttataagtcatggaattagttatatttggacataggctagtaaatggcactaatattttcctttacatccattaatttgaaggattgattataattaatttatttggttgctacagtgacaagatatattaaagataattatgctactgtacaatatccatttttttatttattggcacactatttaggttaactattatctaatcatttgatattaattaatttataattataaatatattttattgaatagtgaattatatattattggaaagcttatgaatttagatgaatttaggttcaagtttcactcaaatccgagttaaaatgaataagttatgctagtgtaaagattcaaatttgaattaatccgagaaattgcgaaaagctactgttcataaacgatttatttttaatccaagacatatccattgacaagtgggaccccgggtttatcctttttcctaccgaattattttctaaagggaaataggaagagctaatgacaagtggggcccacatgtcataaactcgagaccaaaaaaacttctataattagatttttaaccacccggacccacatgtaatagattcaactaataaagattaagaaggggtttactattcactaaacacgtggggcccactctaatctctcctctcctttctctctctcttttcttttcttttcctttttctctctcttttcttttcttttcttctcctttctctctctctcttttcttttcctttctctctctctcctttccggtttctctcctccttccctcttctttctctccctcggcttctcccttcctctctctttctcggctccctctctacccggcggcacggcgacaaatagggggggcagcggctcaccgacggcggcggtggcgacgacggcggcggcgacgacggcgcacggcgcggcacactgaggcggcggcgcggcggtcacgaatgcggcggcacgacagcacgagggcggcggcgcggcggctcgaaggcggcgacgcggcggcgcgtggagagggggaagagggagaggagggggaagatggagtgaggagaggggagaacggtggctcttataggggagagagggaataaggggaagagggaagagaagggagggggtgacgcgacggcggcgcggggctcggggcggcgcggggcttggcgcgcggtgagggcgacgggcgacgcgacgatgacggcggagcgtcgacgggacggcgacggggcgacgggacggcgcggcgcggcacggggctcggcgcgcggcgatggcgacagggcggcgcggggctcgagacgacggcgacacgacggacgcgacgcgtgggcgcaggacggcgtgacagcggcggcgcgcggcgcgaggcagtgacggctacggcgcgcggcgcggcagcggcacgcgacgggtaanggcggtgcggcggccaggcgnacagagagagggggaaagaggaggggctgggttaggggaccacgtcgaacacctggcggccgatgaatagtgtcttttcctatttaatccccattttagcctatttcttgtgtaaatttgattctataaatcctagattttgtataaatgaagtttacccaatatttgtgtcattccaaccaatggatttattctagattaatattattcatattttatttatataatttatttgaatttttaattagggttaattcttattattattatatatttttcaaagttttcctatttttcttcttttagggttttggttgatttataaattgagaaaagttgcaaattaaatttgtatttactcctaagcatttaggtgaccgtattaagtgttcaaatgtgaatttgcccaaaatttaatattgtccaatatttaaggtttattaaagattctataattttctaatgagaccgttattaacacaataccacattagctcaatttatttatatgttagtttattttatatggaggggtttaatatatcaaatttcaatccctaaatgcaattaggaacttggtgcaaaatcgatctacatatcgaattaaatactcccgtaattctattatatatatagagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagcaatagcaatcataacaaccagcatgatgcaaaagttttaaaaagttcgaaattttcgtgattttcattgtcttgaattttaaggatgttacagtactcatccccagcgttgccgagtgatacttgttgtagccgagtccttgtccaactgactagccaaataatcatcttgttgaagaagtgtcgtttctgacgtagaggcgaaaccagtcttctcggagatgaaagccttcaggcggcgacgaagtaaccgtcctgcgcggagacgacgtcgcccgacggcggtgtaggtagccggcgtggtggtgtaggccctcaggtggcgacgaagtagtcgtcctgcacggagacagcgtcacccgacagcgacgtaggtggccggcatggaggcgcaagccttcaggcggcgatgaagtagccatcttgcacagagaggacgtcacctggcagcggcgtaggtggccggcgtggaggtgcaagccaccgggaggcgatgatgtagccgtctagcacggggacgaggtcacccggcggcggcgaaggtggccggcgtggtggtgtaggcctctaggcggtgacgaagtagccgtctagcatggggacggcgtcacccgacagcggtgtaggtggccgtcgtggaggtgcgagcctccaggaggcgatgaagtagccgtcctgcacatagacgacgtcatccgacggcggcgtaggtggccggcgtggaggtgcaagccaccgggcggcgacgaagtagctgtccagcatggggacgacatcacccggtggcggtgaaggtagccagcatggtggtataggcctccaggcagtgacgaagtagctgccctgcgccaagatgacgtcacccggcggcggtgtaggtggccagcgtggaggtgcaagccaccgggcagtgacgtagtagccgtccagcacaggggtgacatcactgggcagcggcaaaggtggccggcgtggtggtgtaggcctccaggcggtggcaaagtagccttccagcacggggacggcgtcacccgacagcatcctaggtggctagcgtggaggtgcaagcctccaggcggcgatgaagtagccgtcctgcacatagacgacgtcatccggcggcggcatgggtggccggcgtggaggtgtaggcctccaggcggcgacgaactagccgtccagcacagggacgacatcacccggagaaggccataggtaaccggcgtggaggtgtaagcctcccggcgacgaagtggtggccaagtaaggctaccctccagggcacatctcccgagtacgcccacccagacctgggtctcatgcccgatcttcagcaaatgcaagtcagtagctatacctagtaggcccctgactccatgtcgcaatgactggggtcatcgcggagtggagttgtcttgacgaacttgaagcgaagccgggtagcatcctgactccgtaccggggtgactggggttgtcgcggggcagagttgacttgaagaactcaaagcgaagccgggtagcgtcccgactccatgccgggacgatgtaacgccccgattttcgttcgggattaaaaatcattaaatactacattttctagaaattaaataaaaattaaagcaatttaatcaagtgaattatcgagggaattaaaatttcctttaaaaatcatggtcggaaataatttgtaatattctctgtgccctaatgtactctctgaaatttcccgtgaattttcggagctcaagaaataattttaaaagcataaaattcatttaatcaattaaaataaaaagagaacaaaataaacttcccttcctccccttgggcccttttttcagcccaagccctcctttccctcctccctctctcggccggcctcccctctcctctcttgggccgtctactcattttccctctccttcagcccgccctcgtgaaaatctactttgccctcctcccggtctcccctctctctctagccgacatgtgggacccgaggccccacatgtcagctcctcctccttccttcagccaccccgcaagcaaccgccatggctgccaaatccacccacgtcgtcgctttcatcgcatggttccctctcccgtgcgtgcgtgggcgtggtcgccgcccatttccgcaccgtttcctctactctcctcgcaaaatcctgccatgccaccgcctccctcatctctctgtctccccccacatcgccggcagttgccgccctctaccgcctcgcccgaccacgatcccaatcccccgagcccataaaaacgatccccggagctccctctctcatttccgctcctctccctctccaacaacgcgccaccgccgctcccgccgtcgccgcatcctgccgctggcgccaccggcttcgccatgccgctccgcaccccagcacccactccacttctaccttccacccacgaaacaccatctccactgtgaatccccagtgccgctgccgttctgcacttcggtcggccaccaccgccgctcctagccacctcaagtcgcgccgtcactgccgtttgcttcacctcatcgaggagtgccttggccgcccttctgttttgccccaaccgctccggagtggttgcctcctcgcgaaaggtgagctccatcattccctcctcttctggccggcgattgacgccgcctccccctcctctaacccttcccccttgttccctaggttccgccggttctcggccacgcctccgccgcggttgggagtcaatggagcgtcgtccccgactccaacccgcaagcaccactgccgtctctcatcgttgagctccccgcgtcgcttccttgcctcgggcacttggtgagcacccctctctcatccccgccgccatcttgcgccgccggtggccgagcgccgccgtcgcgccatggctcagccgggccagctttgagccgcgcctgtgccctggccgcgccactctatggccgcccgatcggttttggccgatttgggccgtcggttcccgtggaccggcggtggaccacctcgtggttctggtccacggtggaccgctccccttgacccactgacgtgtgaggcccgcctgtctgcgccggcccctttgatgacgtcagcaacagccttttctttgagaaaatatttaataattgcatcataaatcgatgttaattctagaaaatcattcaaatggctcaatacttctaaaatttatatctaattcatacgaactccaaattgggccatttaacttgcaaaattcatctaaaattgagatctacatgtttgtttactttttatatactgtctacttggtttttattagagtttttcctcgttttgcgtgccagactgtagttttcgccgtttcggaacatcgcggttgcaaggataagagttcagaagattgttttgaagaagcaaggcaagtgacacattcctcttgagcatattgagcctactttataaatattttatcatttgcaaatgaaattgcatgtcttgttaattatgtgggatcagggtattacctatctgctcgcttgtgccatgtttacttgatatccttcctttgctaaatttgggtgataatttgactagttcgtgttacttatgtgacatagctagaactataggcttagccatgcttaattaccactagctcagttgatgggataattacattattatacatcttagtactcagatgagctgcgtgctcgagacatccgaccatgtttcattggtcgtaattatccaacaaaaatgcgacttaatggtgggctatgggtgcatggttttgctagtcgcacccatggcaattaaggaccggttcgcgggaaaccctggaagaattcatcacgcttaccacaagccagtgtgggcaacgactgggcttgtagtgtagcttttctctagctgacgtacccaggctagggtgggcgtgatggagttgggtcggtcggggtgttcggttgatcggctttcggatccactgtggcacgatgggggctgcccgttgcctactagggatgggggcgaaaccggaggtgtggtgcgattggttagagggggttatgcgaagggtccagtcacggcgtctttctggtatgtcgtggtggcatgtcggcgctcgaaaacgtgtcgtgggctgtgtcttgtgggtacagttgtacacctctgatcagagtaaaactattcgaatagccgtgcccgcggttatgggcggtcgaccagattcaccgtgattagtctcacccttaataaatcaactcaatgcacttagtttgagtgggatggttgggcctattcaacgtggtgtaccgttgatcaatggagatttaatgttaccttaattacttaactattttactgttttgctcaataaaatattttacaaccgcatttatacaaatagccacaagccatccttgtatccccttgcacgtctgcatcgttagtatggcttgatgagtacggttgttatactcagccttgctattgttcccctttttagaagtaatagcgcttctgagctgaagacgaagttagaagactaaggctcagaccccagttgagttttgcctgtggagtggagttgaagccccgctaggatcgccttttctgctgctgtcgttctctttcggtctgaggactaagtgcctcttctgtaagtattttatgctttatttacgtttggaactgtttattacttgtcgttttgtgtaccctagctgattcctagacagcgatttaatacacaaaatagtctaaaaatttgggctaaatttctgggtgtgacaaatgactgggttcatcgcggggcggagttgacttgacgaactcgaagcaaagccaggtagcctctcgactccatgccgggatgactggggtcgtcgcgggttggagttgacttgatgaactcgaagcgaagcccggtagcctcccaactccatgccgggatggctggggtcgtgctggggtcgagagtgagtgatgtaaggacctgtgccaggctcctagatgcgcacccagcacctgcggagccgggctctgaggcaggagatcacaagcctcctacgtggcaataccaaggaaacaaggaccgtgaagcccatgaacccgaggtcttcgctcaactcctagagggctctgaccagggtcgggtgatggcctaagggtagtgggcccccgggtgtggccgtacttcatgtgacgggggccgtcggacctgaagcctttgctcaacccctaggtggttaccggccacctgcggggccgatggtataaggaacacctagcttagccgggaggggcatggccagggcctggcggttgccgggagatttcgagccttcgggcgtggcagaatttcttgtggtcaggcccggcagcgtgtgatcttcacctcgtgccttgacggttgcggtccgctggttggcgagggagacgctcctgacccgataggaagggtgagtgaaggtgtgacctatggcactcggtttagcctctaggcttttggtgtttgcgcggcggtcgttcgtgctgtctgggtgagggcggagctcccatcgtgcggcatagcccccgggcgtagtagtcatgcccagggcggagtcgagccagccaggtgaaggtggagcccccagcgtagtagtcggtgaagctcctcgtggcagcgtcgtgccgaccaggtgaggatgtagcccctagcgtgcggcgaagcccccgggcgtagtaatcgtgcctagagcggattcatgccggcagggtgaaggtggagcccccagcgtgacgcgtagctctcgggcgtagtagtcggtgaagcccccggggcggagtcgtgctggccaagtgagggcgcaacccctgcgtgaggcgaagcccctgagcatagtaatcgtgcccagggcggagtcgtgccagtcgggtgaaggcggagcccccgggcatagttgtcatgcccagggtggagtcgtgccggccgggtgaaggcggagctctctgcgtgcggcgtagcccccgggcctagtagtcatgcccagggcggagttgtgccggatgggtgaaggcggagcccccgggtgtagtagtcgtgctcagggtagagttgtgatggccgggtgaaggcggagctcccaggcgtgcggcgtgcggtgtagagcccaggcgacgagagaggtgaagccccccgagcctgtagggaggttggtgaagcgtgccagctgggtgaaggacgaagcctcccagcgtgcggcgtagcgctcaggcggagaggtaggtgaagcccccgagcccatggaaaggtcggcaaagcgtgctagccgggtgagtgacgaagcccccggcgtgcggtgtagcgcccaggcggagaggtaggtgaagccctcgagcccgtggcgaggtcggcgaagtgtgctagccgggtgagtgacgaagcccccggcgtgtggcgtagcgcccaggcggagagggtggtgcccgtggcgaggtcggcgaagcgtgcttgccgggtgagtgacgaagatacccggcgtgcggcgtagtagatgacagagcctcctgtttgtattggtggagccgtggggcgtccaagtggtgccgatggagaataatacatcgttgatgtggtccgtcgatcgtgttttcttctgagttgtcttgcatacaagcttctatacggatgatgatgatgtcaggctgatgtggcctcgtctcattggttggccatgttgccatgcatgctcctgttgactgtacgtgcaaatttcaaaatatataatatttttctcgattttgtatatatatacatgtttctaaaaattttacgaaaatatacctttcccgctgataggtgatgcggcaccgtacctttggcgcacctcagaaacacgggaccggctgtaggggggcggtcccgcggcgccaatatgcgctgtggaagaatctaatatgttgtattattgtgttttcttatattttctgatatattacatctaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacattccccctcagtcgtaacgggagcgaagcaaacgattgcgactggatttgaaatcttctatttcttcatctctctgagtcatcatcatcgattgcatctctgatggtcggtcctccacctggtggctgcgtccccttctgtgtcgtcccttgactatcctctattccctcccgcagtcatagcgggagtgtcatggacgatagcgatgacacggacgctttgactggagttgtcgtagatgattcttgttgtagacgttcgtcgatgtagccaatcatgtggtagtcgtggtcatggtagtcatggtagttgatgtagccgcaaatagccgaaggcggaaaaaaaaattcacgccatggtgtgaagacaaaaactgcaattgttagcatcttgcatcttatagatgtcagaggatgagagaatgccattggggacgtcttgcatatgtcagaggacgtcgttggcgatgaggccaccacttcagttggtccttctgcgccgtgaagcggtcatcacaataatgatgccgagttgatgcagtcgttgtcgttgtagatgacgtgatcgatgccgtcatcggtgacgcggtcgttgccgtcgtagaggacgcggtcgatgtcgtcgatgaagcgtcttgcagattaatctgtcagaggacgcgaggtgtccatctatgtggacgagtcggcggcggcgcgcttgttcctatgttgatgaagaccatcggcgatgttgtgtcggagaagacaaatgtatggctgatgtagaggaggaagcagttgtggcttgcgtcgcggccgttcataggagcttggcgaagatgatcgatgcggattgcttggtgtcttgacgcttgattctcctgtcacctgtgcaccatgtgcttctctcaattgagtagatggatgcaacagtagatggctcgatgacgtttggtgttcccgtcgctcgggcttcacggcgacttggacggtggtgctgtacgccacggcctcgccttctgcttgatgatgctattgagcgacggcttgcgacgaaatcgtcgtcgtgttggctcctagagatcgtagggttcgatgtggcaaaaaaataaattgatctaattctaatattggtaaaatctaatctatggataatttgtggagctaatagatgcggcgccccagggagattataagattgatctcatctccccagggcgacgcggggatcgaacgacgttggtctctaaggctctgataccatgtggaagaatctaatatgttgtattattgtgttttcttatattttctgatatattacatcgaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacatgcgcgaccggacggcataggatcggtgcctcgccatggccatgtgggaccaatgggaacggaagggagtgacgatggcatgaggttaaaacgtgggactggattgcgatcccgcagaatggtcgagcgacaccacgcctaatgcaaacgatcatgtacataatcaaataaacttattcctaatgcccatagcattagctaattagtatgtgctgtgtatatgcatgtgtatggccactttgatatactaatcattaatcattgtacactactacatgatagatcattaatcattgtacactactacatgatagattttcctgaataatcaaataaacttattcctaatgcccatagcattagttaattgggaaaattggaaccatgccattataattttgtaaaatttgagatatgtcatcctgacctacatgtcattgactcatgtgggtcctacgtgtcattgagataccgatgacatatcttaaactttacaaaattataatggcatggttccacttttcccagtaattggtgtgtgctgtgctatatatgcatgtgtatatgtgtatggccactttgctacgtgtgtggcggtggcgcagattggtcacgcggcatcgccggcggtgccgcctgccagttctgcgcgactggctgggctgccagctgaggagcaggccgacgcgttaccgcgctgccccggtgcgggaccgtgacggtcgcgcgtgttggcgccgcggaaccgtcctctctaatcggtctcgcatctttgatctgcgcctacggtgcggtgccgcgaccccaatttacgggagaggtatatttgtgtaaaatttttagaagcatgtatatatatataaaatcaaggaaaataatatatatttcaaaatttaattcgctaggcttcgtccttgatcgtaggagcagaggatgttggcgaacttggcgtcgagtggcagcaacttgctgcgttcttggggagaaggatgtggtttcttttctgcattttaattctccgccggtgcagatgcggcgcggtcgtcttgtacatggcgttggcttagcttgcacgtagaggaatggcttcacgtgattggttggccatattggccatgcatggcttgcatgcatgagcctgtcatcaggcttgagcagcaggttgtcgatggcgtcggagacgatatatgtcgtaagggaaccggcggcagctgtcgtccgagccgcaccgcgaaggtgtattcactggtggagaaaccatctttcgtcggtcggccgaattccacaatagttccggttgcaataaaaaccgggactaaagatcaagtcccggttaaaaaaggtaatgggcatatttgatctttagtcctggttggtaacaccaaccgggacatctttagtctcggttcaaatgctgtcagggcttgtcaggcccttcgagatctttagtcctagtttgtaacaccaaccgggactaaagattgtaaatgtagtcccggttggtgttaccaaccgggactaaagatctcgaagggcctgacacgccctgactgcattcgaaccgagact

SEQ ID NO: 61002 - DNA, 588 bp, Oryza sativa
cacatttctggtggtagaataatctaacagttcttttttgggttaattggttcagtctgcagattttttccgtgatgataaccctgaagggattgaggcacgcaatgaggttagcatgctttctgtacagtatttttgcaactctatcatattccttcaattcaaagtttcgatttcatcccagatattgtagttcaaaaatgtacgttgttattgctctacattttgagaataatatataacatggtaataagataaactattagggctagcatggtaattttgaactacaaattaatcctgatgactgtctacaacatcatttatttaaagataaagggagtacaacaattacagtttctgtgaaaacttttatttagatttagaacacatcatatttgtaattttaaatcttgttttgtatttgtataatctgtttgctgcctccttctgtgatatagttgcattttgccattgctcctcctccaccttaaggtcatgctaaggcatttcatttgaattatcttttttcccaaggagaagtaaacctatactattctcatgaaagcaccacaaagttgatattaa

SEQ ID NO: 61003 - DNA, 3513 bp, Oryza sativa
aaaaaaattaagcttatattgaatttttttaaatgttgcacgatgttccagcaggtatatcgaaattgtctcactaagtagattgaaaatgtttcactcgtttaaattgggtattgtttcaccttatataaaaacaatgtttcagcaaatagcgaaagaatgtttcagttcactgcaacattagatctatacatagtgaaacattgtgagtatactaggtgaaacattttttggtggaacaaaaagtaaaccaaattcccttaataggggtttccaaaatatatgtgtttttgttgcaatggaatatttcgttcactgcaacattagatctatacatagtgaaacattgtgagtacactagatgaaacattttttgtggaacaaaaaataaaccaaattctcttaatagagagtttccaaagtatatgggtaatttgttgcaatagagttgtgtgtgtggacacgtggtgggctaggggaggggagcgcgcgtgcatggggcggtggagcgcccaatttctcctcccccgcccgatcgcccaacgggcatcattatcggtctgaaatatgccaagaaaatatacttaattaaataaaccttcgttttatactataagtcaattttgattttttttctagtcaaattttccttaatttaattaaatttatagaaaaatttaacagcatctacaataccaaattagttttattaaaactaacatttaatttattttgataatatatttgttttgtgtcatattgctatactttttttctataagcatgaccgaactttaaaaagattactagtgaaaaaaatcaacataaaagggagggagtatgaacgacagttataatggtttcagagactgaactcatcattcttttttagaagttttgttccctaggtgtacaaattgcattaatttgttaatccaactattctgcacctacagcaagtctgattgaaagaataagccaaacaacatatttgtaaataaaaaataatttgtgaatgaacttttatatacgtgttcttatcgacctaaaagtaaaagctgaaaaaaaaacttcaatgaaaaaactccaaaatcaactctaaatttaagattgaaaatttaaattttggctgataagtataagtataaacgaaaagatggaacgtttaaaataatttataactatttggatgagataaaaaaaagagtagaggtccctttaagagccaaaaatgactttctcatgtcattaggctatctgctcagaactctgaaacaacatgattaggagagggttttttcagacctgcttagcatcagggagtatcctcctcagtgtagccaggtgagcattaatcctctcccgccgccgcctctcagcctcgctgtggatcgtcatcgccgtcgcctgagccgccgcgctcctccccgacgacgatgacggccgcggcggcggcggctccggcgccaggccgccctgccgccgtggcagcacaaccgtgcctctgtacactgaagaaagatcatcatagccaccgtggtgcagatgctgctgctgcttcccttcttgccaaatctgctgctggcatgcagccatctatccaaaatcctcaactatatgaattaatgacgattaactcaataatgctgcaagaagaatcagtagactgttaattcgaccttcaagaacaagaaaatgatgaagtaattagcactgtaattaaacatatatagatacctatatgaggttcgattatttctgtcggtgcaagaatagcaatgaagagtgaagtgaagtgagggctgaagagaagctaataagagggggtacttaaactgctgcaaaaggaagaagaacagaagcctgcaggccctcaccacattaatttgttaattgtaggatagatggatatgctcgtcagaccaggatgatcagatcatatctcacctcatgataaatctatgtatagatgatctatcaatatatatgtgcatgtgtttcaattcattattggccaaccaaccacaaacacacaatgacatgtacacctaggtgcattctttttccacatttgatccccactaggtgatgctcctttggactattcagggatagctcacatcatatcatatactactaaatttcaattagtcactacctagggactatcatgagtttggaggaggattaactactacttaattagtctgagataactgaattttgtaagcttggcaaatgcaagcctgctgtccaactgagacttctttcttggcatcattgcctgaaaagcaggggtctttctgcatctgaatgatttaattaagaacacacgcacgtacgggtgtgactgatgagtaggattacatggtgattaaggcacgcaattagatcaattggctagttatactaatcaaatcagtgacaaacaaatggctagcttagctaggttaggacagttgaacagttagatccaaatccaacagttacagccagccgccatttggtttcacactaggatcgctttgcggcttcacacaggaactctcttggatgcttccttcgccacaggttccaacgtgtgattttgcgcacgtggttaattcattaatccttctgttttcattctcggctggatttttttaatataataataatatgatgaatagtcattggtaagtaggacccacttgtcggtcccttttgttcttgctttcggtttgccacgtgaaaaagcagggcatcggcttcgaggcatttatttatttctcttgtttatttaaaaaaaatgcttgatacatcttaaagcggatggttaatgtacatgggacaaattttgcaatatatatagtatagcaagaggcatgtctgaaagttgcataaatatatagaatcggaattaacatgaggagaaattactctctctggttttaatagatgatgtcactgttttttttcatgagcaccacataatattcactatttgtcttattttaaaatttctgtgtaaatatgtaaatttgtgtttaaaatacctttagtgataacctaagtaacaacaaaacaaatattaattatgcaatctttttaataagacgaatggttaaatgtatatcgaaattaatggtgtcatctattaaaaaccggatggactacttcatttggcgagaaggtcaatgcagatttttaccacctaatatacacagcttgggatttacagacatatcgtataaagtttagagcgatgctttgtttatctctactgatagtattatattaccaatagaaataatttgaaccattcgttattaaaggtaaatcagtaatttactaatacagtgattaggttaactttatcatttatgttttttttcagggctagatagatatgtggtcatttattgcattggtatcgctcctattccatcgaaaaaatcaaaaaagaagggaaaatgtttagtaattgataaatgatgattagaccctttcgcaacttttttctctttttgctat

SEQ ID NO: 61004 - DNA, 3279 bp, Oryza sativa
cccaaatttaaatcccggttcctcccctcccaaacgcgaatgcaccaaaatccccatcactttataggtttagaagttatactatcacgagcaggcattttaacgatagtgtacactttctacagttggccttcagcgatgcatcgaaagcactactactatatgtaaaatgaatactttttaaataatgacacctgaacatgtaaaatgtcctgcattggtaatgtgcctaaactgatttttttttactactatacattgttatattacactattgagaacatggttctataggtgctaatattgtcggcagaatcagtttcaaacgtagggatttttctttttaccttggaggatttgagaaattcaggcaccaatatctttttcaagcgcttattcccttggactgaatttcttgattaaacttcctgattctgtttaacagggattctcacactgtcatctcttgatttccctttatcgtagacgttctcccaaaaaatacaatcacaaaggtagacatctcattcaattcagagaaatatatttttgtatatgtgtgtcgaaacatgaattcggcaataataaaacggggtagcgcacgagacctaaaagtggatggatgtggagacaaatgatttagacaggttcaggccctctcaatgagaggtaataccctactcctgtttggggatttgaatccgccgagtgtgtattgatctgacgatcaggttgtctcatgcccctagaggggctccctgccccccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatttgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgatactaatatatagcatatgcggtgtgaatccccgaataatatgatccaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaaacaatgatattgtatccaatcaattgcttgataaacccaaacagcaccttgactatataaaaaagccagcggggcagctatataaagctttactgtttgacaccttttaagatgcattgtaccaactcttaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtgggatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagcgcccagcgataaagttgtgtagccatggcagcgaaataatcagtcggtgacagacgaggcaaatcaaaggcgatgacaaaatccaccaatcatggagatgaagaaaatagtcggcgacgacaaatgcaactgacatgatgaagatgacgatgtcggtgatccagtcaatagcagtgtcgcaaccaatgataatgacgaagacgctcatcagcatttgcatagtaggtcaaccgtcaaggtgaaataataagtcagcgaaaacataatcatccattagcaacagcggagatgtcagggccgatgaagcagaggtgctggtgatgatgtcagtgacaataatccatcaaattaatgttatggctgttgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcatcgaatagtcattgcttgattgaagatatgtgttgaagatgtccgagtagaaatcctgaatattggagagccacttgttgtagtaaaataacatggcattgcatgccgagatgtcgaggttcacaaagacgtcg

SEQ ID NO: 61005 - DNA, 5327 bp, Oryza sativa
ggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgcccctagaggggctccctgccccccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacaatgtgtttttttattttttttaaaaaaaattcagattattgcatcatctcgtttatacaaaattgcagaatcccatttcataatctatattgtatattcttttagcttctaagttgaatggacctcatgcatgattaaattttcaatctatattctaactaatgttcactggtcaaataagggaatctacatagtttatgtggactgccggcatatatactatcttcttctaccctataattcaccaattataatcctacaaacctcatttatcaaatccagcgatccagaatcaaccaaaccaacgccttagataagaagctagaggcaaaacattcagccaccgcagccgattgccaggaagtcctcgccgccctttcccctgatcgagtgctcgatctgcctggacacgtgcctacggcaagtctgcctggactcggtgagcagcttttttttcttatatatacttgcagtttaattttcctctctcccactgtagcatacatcatcagtgagattattgatatcagattatgtgcatgtgtgacacaaaatttattatataaatggacttttcatttaattgccgcttcctgaataatgtaaataatcctaatattaaattatcaatggctattagcctattatgcatttgtgaaaaagttactgaagtagagataaataatgaatacaaatgaatatatacttgcagtttaattttcctccctcccactatagcatacatcagtgagataattgaaatcagattatgtgcatgtgtgacacaagaagttaatatataaatggacttctcattcgattcccgcctcccgaataatgtaaatacacacctatttccatgttaacaaaataataaacaaatcattaatgttaacaaaataattccatattctcagatatatcctaaatttatttttcattggttggtgtagctttccagcatataatttgaacaaaaaaaatccatgattaaaaaaaaagaacataagtatcaccatttttaatatatctgtgtgtgtttttttatacattcttatggaatcatctttttcttatcctcgctgttaaattactttggtacttgctgtacaaaataatttgagaagctcaccatgtgtttatggctaattgtccgtactaaaatgggattgaaattggataacatcttcaattgtaatgcaatatgtgtatatgtctaattgttttagcgatatggagtctcataaaatttattactaatgctagaactgacagtctcacctgcactgaactattcaagataccatcatcctgcccttgatggtaatttagaaacttagatccattcacgatttgaagattgctaacgtgatgaagaattccaaaatggaggctgaaccttctgagttaatggcgtctacaattagataaaaccaaccgatatatgaactaaaatgaacttaaaagacttttattgagttgaactgcacctaaaataatatattttgtgttagtatctctgggaaggtatcgatatgtcatttttcattattccactaatattttggacaaacagcaggctcatactgcatactattttgcatcttgattcagcagctagactcgatgtctgtctcttgcagctagacttggtcagccatcaagtttgcagtcttacatgcatgtttaaaaaactgagaatatcgggcacattagcgattcctgataagagaagcttagaatatgtctggggagtgaggatttaaattcttagtttttagcccaattgacaatacaaagatttgtacccaggatatatatcatgaattagccatttttcctttgtatggacctatgtgtaagagatgatttgaaaaatacaacatttgtgatgttatttttcaaatacaacatttcaagtgctttattcccttggactaaatctcctgattcaactttctgattcggtttaacagggattctcacactgccagctcttgatctgcctttatcatagacattatcccacattgtgtactgtaagtatactctgcaaactgaaaagtatacatgttcttatccagttctttacaacctaagattttaaattgacttttttttacataccttaattatatgaaatatcaggtgtgaagccaaaataggagcgacaacaatatgaatctcctgtatagaacacaaagtgaatcattaggctgtttttgtcggtgacctttggaatatattaagaacaattatgattaacttagcagattctatataacaacagtactacctccggttctataactattgacttttgggataaggttgagtctaaacttggacaactttgactatcaatatttttaaaactgctagcaaccatgcctgtgccttgcaacgggcaagacaattgctcttttgtgtattgcagttggtgtacatatcgtgctttgttgttggcattgatagtaaaccaattagattgttattgtcaactcaggattattatgctttgtacacaagaagcttctattgattgatagagtaaatcgataagaatgtaatatgttatattgtgctttgctgttggcattgacagagtaaaccaatcatgatattattttcaactcaggtttgtttattattttatctgttaggaatggatccaaatggttcgtccaatgggttcgcattgccttcagagatatagcaaatgtttcttcaggtgttgtaacacgccagatattttgtactttgttgttgagttctatatacacccatgatgtttatgaactccactatactgtcgtgtgcccgcaacaaataatagaataactcaatactttttaacatattttttaagcgtatattgcccttttatattgtatactgacatgattatatataattaagtcttgtaaagttttattgtgcccacacaatatcattgtattgcactttacatgaaatatattttatgtatgatataaattgaattaaagtttaaatgcacagatcatataaaaatatattttgctaacataaaattttaaaattattatagacaaatagaattgcaccgtagcgtttagcacgggcatattactagtatattataagttcttttatatttgttctctgtcaaatttatttaaattgattaagtttatgaaaaagaatgtagcaatatttttagtataaaacaaatatgctacggaaatatatttaatggtcaatttaacaaaactaatttgagcttatagatgttgttctataaatttgattaaacttaaaaatatttgacttgacttaaaacatagaactgagggagtaatgcatataccttatctacatggatttgtttcttcccttttttggttccttcacttctctgtttctccattgcatattggactggttcattggacccctgaaagggctctaattggcttggactggacgtggccggcttgttctatttcgacctggacatcaatccacctcgatcagacgtaatctttgaactcgtaatgtttgtttacatttctggcacctttcttggtgcttgcattctttatttttttccaatattttatgacttattacctttatagtgtatattgaccaatgccacagcacataaatcaatataaatcaatatgaatgagagggatgataatcctacctgtggtaaagattaccgtgggcacattattggatggacacaagcgtggattcaattttttttgcacgtgggtacatccgacctggggccccaaatcctaacttgtaggcttgagtattcttttatgcctatggataacccacgcccgacctgatatatgtgtttctagctgattttgtctaatcctatatactttagccaaattaatcacatcactcaatgaaaatagaacttagccagcttcgaactcaattctatatctctcccttactcatcttctctcctgtgacgaaggtcgatcgatagagcaggtaggtgtcagcgtagtcttgcttgtgattctagattcttgtatgttcttagtgcctatctgagtatatatatgagctagtggtgcctatctgattgtgtcggttaattatgttgatatgtttaattatctaataatgtgaggatattagttatgttttaataccctattgggtacccaccgggttgccaatgctcgtcgagcatgggcatggattgatttctacccaccaaaactatcgggcatgcatgggtcaggctagagatatctggtctacggtcatatcatgcgtgttcttgctccacccgactcggctcattgccaccccctagttcatagtgcaatggctaatgtgttatgtgtgtatatttgtgatcaggcaaacgcattgcttagtacatatccatgattgagctacaattgcacttctagtgacattttagaaacaagccccactgcttattgtcccatgaagcaataagatgggacacacgctaaagggaaaaaatgataggccaaaacaagcagcatgcgcgcgcagagacagagaaaacaaattattatttttatttaaaccagggtcgcaactcacaagcttatagtcaac

SEQ ID NO: 61006 - DNA, 12007 bp, Oryza sativa
tttaaagccttaccaaatcaaatatttgagagtagaaacttatggaattatcaaaatgtgatagagtagcaattgcaaataacatgtttgatttcttgtcatcctaaaagttgctaatactaaaattcgatagagttaaaaatggtaacagtttatattaaccacgtataaatatgaatacattattgaagcatgatgtatataaggtatattaaaaataaccatataatttataattaagaacaagaaaatacgataatttaaaattcatgaatggtcaaaactgagataacaccgatcaaaagcgataaataaaatagtactccctccgtttcacaatataagactttctagcattgcccacaatataagacacatatatatatatgtctagattcattaacatgtaaataaatatgggcaaatgctagaaagtctttcacattttggtccttttaaaaaacttatttcgcaaatagacccctagaaaaacttatcccaaaaatggtcctttttggggcgccagagtggacgacggcgctagccactctggcgccgtccccctgccgacgtggcggggcgatgctgaggtggctagggagtgcgccagagtggctggcgccccccccccaaaattttttatttttgttttatttgtttgatatttttttcacgcttagggacacacaagaaccaaccatagaaaaattgaactcaaatggacgtaatatgtgacctgtagaatttttcctctcctctcctctctccgaactagtgcaaaggagagatgtgcaacttttttatttttattttattttttgatatttttttcacacttaggaactcacaggaatcaactatgtaaaaaataaactcaaacggacgaaatatgtggcatgtggaattttccaaagttttaccgaaaaacttctctcctcgaaaacacaatcttgcaagcggaatttggagtttttaatatcgccgaacccggcaaagcgggggagaatcagatgtaacattttctgtagatgtccgtgcatatattatttgcctgattccgagtccgtatgagaaagttacgcctattttaatagatgacatattttgtccgtttcggtagagttttggaaaattctacaagtcacatattttatccgtttgagtttattttttatacggttggttcctatgttctcctaagtgtgaaaaaatatcaaaaaaatgaaataaaaataaaaaaattgcatttctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactaagtggtatgctagctattttcagacttagctaagtggtagttcgagtttaaatttttttgtggttggttgtatcgtgatcctaagtgtgaaaaaacatccgaaaaaataaaataaaaatgacaccgttgcaactccatacagaaaaacaggaatggaggcggcggcgccagcatggctggcgccctcctcctgccacgtcggttcgcgtgcgctacggtggcaagaggacggcgccagcctctctggcgccgtcctgttggatgacggcggcagccactctggcgcccaaaaaaggatcatttctgggataagttttttcaggggtctatttacgaaataagttttttaaaaggaccaaaatgtgaaaaatccaggaagtaaggagtatatataagaaaaaactgtgtaacttttcatgggcagagaggagaggaagtaacgataatttatttatttactaaaggatcccttgcaaggtcgtcccctgactctgaaaaagtcacgccgggctaatcgccattccccaagggcaatcccgtactttcctccaccctacccccgccaggccgccaccaccagcccaaagcatggctcctgtacctctacggcgatacgtcaccaatccccttcacaaaaaaaataataataccagaaaaataaataaataaaaataataaaccaggaaaaataccaccaagaatcaacgggagacgagacgaggagatagagtgcgataagagagagagagagagccgagtcgccgtaggaggagggctagagagagaaaggtggtagtagagtagtagtagatttgaggaggtgagagagagagagagagtcatctctcttctttgtatcccccgtcgccaacttctcctaccaacttctctctctctttttttctcctcctcctcttcttcttggtggccgctcgccgccgccgacgccgacgccgccggcgggtctcgtcgtcggtacgtgttactacgggggccggtctgtggcccctaccctccgtcgccgtcgtcttttcttgttcgcgtgtgcgtttatttctcggccagaggttggcggcttccggcggttcttggattccggcaggattgatcggcgtggtgtttcttggcccccccgcgaattccggcggcattctgatggcgtgcttcttctctcttctttttttctcttgctggttgttttgttgagttcgtgtggggtggtaggattggaaggtggcggtggttggggggtctttgggtggtgagggaagggggtgaattctctgtgttcttgggggttgttgttgttatcatctgagcctcttaggattggttgggtggcggaaggttggttgttgccacctgccctgttcgtgtttgcgattgatttgtactacacagtgggtgcttctcctatgtgcaaatcagataattccgcggtaacaaagtcagcgtaggattatgttggtgatgatgatgactagtgtgcctgaaaattccatctttgcagtagtccttggcttgataatacagatagattctttgcagagttcgtgcacttcactgtcacaacaaagaaatcttttttcctcaagagttaaattctagtaggattcgttggattctgtaggccctggagtgtgcttgctaggtctgtgctaactgttagtggtgactggtgacaagtacatcaccttgatttcttcttttttttttcactcactatttttagggcgtttatttggttactcctttcgccgagtttcagttaaagctgacctgtgcctccacgtgacgttagtggggcttttgtcagatgatacagctctgttgaggatcgtgctggacattgctgcactgtcagcatccttgttcctttgctgtctatttgagccctcaatttccagtgcctgtagtactcttcactgtctccatggaagttgtaggcctgttgaatgttgatgtcttattgtcaacagttttgttcccagagattgataactcacatgagtttatcagtttttgtagtacgattggctcctttagattccattttattgattagtaacttaatgctaataagtaaaaagatatgagtgtgatcttccacatttgtttgttagtgcattaacccgccactaggtttgccagtcgcatctatgtgctactatcacaaaacattttttttttgtctattgatgtgaagaacaaatagtcaatattattctgtatatatttggcaatatggttaagattaccattcatagggaagaaatagatatggccaataagagaagtgtaacgtaattccagttcgagaaatggtggcagtaccaaatgccgaattagcggctgtaccaaatgatcaatgcctctggggtttcccttctcttcagctctccccggtttcaccaatgtgttgggcactgaacactgttgttgtttccagcaggctagtattgtctaatgtaatcaaaagctcttgcattaattgcgacacacttatttctctcacgatgtctccatatttgaacctaaaacctttttttatacaaccttatagtactcgcttttataattggtttagaaaatcttatatttctaactatattgcaggtggcattgaaatatggttagcttgaggaggcgccggcttttggggctttgttctggtatgagactcactgcaatgtcatgatttgtttcctgatatgtttacgtaatttttcagaggaactctgttgtgaaaatgtgctactttaattacttacaagttatatacaaagtcatcatagcatgtctttcttggttatgcttatcaattctattatgatctgactcttcaatggaacatgctatacctactctttcagattaaaaaaagcagtactgtgcacccaatttacaaatatcttgtacatgaaatttcttgattttgtttctctattggtataccatctgtagtcagcttccgttgatacaactttgcaactccttgtatacgtgttttatgttgctccccatggtgtataagttagtgggattgggaaattatgtggagaccataggaggaatttgaatagtcaatggaccttacaagaacatgatttggctgcgaactaattgcttccagcaccagaattatctgtgcaaagaatttagacgggagttgccgtagccctgatggtaccatgattagatggagcacgtataatctgttccatattgcatggtgtggaatgaagtactttaaacatttttctgctgactggttagcttactatgagcagtctttgcaaaatttattatggaaatcaataagggaaggctttctatatatgtcgtgcttcctctaccgttcttgtaatttttattcaaagatgtatatcagtgccctttgtgggttaaaaatcaattttgtttaaagagtaagttgcattgcccaccatctgattgtaaacacagcagcttgcactatttgtaagttaacacaccacttccaccttctaagttcacagaaattgggctctctgaaccaggttcagtggttcatgaacattatgtgaggtgggatgcacccaaatgctggtgtagcaatggccagaggccattcattgtcctgttaggatgctgtgccatactgaaggtgatttctttgggggcatgtctgagctggcttattcacccacacaggaggtgaaagtgaattccttgttttgcaatggcataacagaacggtcaagccgattctcaccctccatttggttagctcctgacatcacaggtcatgttggacacacctgggtctttgttcacatggatatatgagccatttcgtggatgtgcccacagaggtctcaatgcaccatttccatctcattgtcggaatgaggcaaacctgtaacaataaacatgcttttacatggtggaagagtgctcaatttgtccaaattacatggtggaagatgatattttaatgtgttaaatgtcacaagctgcggttttacatgaacagatggtgcaaaattgcatattacttatgtttaaataaatttagagggctatcgcaaatgtcagcgtcaagtgttctggtattcttttctgaagctacacgtaactctagaagtatttcagcaagaagggtgtaagttcatactattgtgtaggcacacagaaatgaaacaagggcagatgtagccagattcgtgcaactatacaaatcctaatatagtaagacatcgtaactacaaatatgctgtgtgaatcactgttagaagcacatggcttctggtgaactgttgatttgaccaacaatcgagattacggacaaaatactattggcaaaataagattatttttaagtatgactatatcgttttctcatcgcacttcttcccatgaacccaagcaaggggatcatttatgcaacacatacctccctagacagctagccaatgaatgtattatgcgtacactttgaacgctcatataatttccctttgtgtcaaggaaaaaattggtatcggttgatttttcaaagcctaatgtccaatgaaaattctgtggaagttgcacaccttaacataaagccattcattgtgcacccgttgcccttgttagttttaccccttcatggcaggtccactttgctgcaaaaatgttttgctagttgccaccttgtgttgtgtttgattattggtgagaaccatgctatcacagtttctatttatagttaatggatattacaagttatggtatattcaagcatatcaccaaagtttctgtgacagaactctgacaatcattttcgcaagttaatttaccattgttggtttaatctttactttgatttttaccattttaattgtattttagaatagtgtgaataaaataactgtattttcgcaaggctgtcattgaccataaaattatactaccaaattagcaccttcaaaaagctaatggtatgatttaaggagttcaaatttatacccactacattgataaatccttgtcaacttttactaaaatggagttaccttggcaataatttgtttatgcccattttgacttctccattaataactggattatgggtccactgcgtttttggcgggcaagtaaatgaggaaaattaatgaggccaaatgagtgaatattaattggaaagcactcatgggctcgtggcacatatttgtgaacaaataaagtagtaaaaagccatagtaaaaagttacaagtatttgtgaaggatatcaaaatcgaatgggattctgattttggttttgaacttcgaatatgtcagaaatatattcagttgctctttctctgacaataaatggtacaacctgtggcttttcagaaataacacgtcaggcactgacaagctatttcttaacatagcgctgtaagatagattgtgcttgactgctccttgtgtcaatggactactttgatggtgttctctttttatcatatctactttaccttctagtacttttatctacatggtgggaaaataagtaaaaccaatggattgaataacaagattgctgctcttgtttgttttgttgcagtgccacttttcaacagtagcttcatgtgttatactaattccttttttttcttctgtttcatatggtttgctttatagtgactccttagaaactacattattttctgatgcttctgaacacatgctatttgcactggcaacgatggttttgtttgataaaatgtacctttttgttgcagactaaaaattctgatgtacttctggaatcttcaaatgggtctgattctttaaaggaagagaaaaaccattactatccaggttcatattatttcatagtactctttgtatttccttaaagtatatagtccaggtaaattttatatggcaaatggttgttttataattcggtatcagaaatcttatctaggtacaactctataatagtcccatcaaattaggctgactttgaacttcttgaatcatgatgaaactgaatccattcttggcccaactttctcattgaagcattgaacacaacaggatatattatgttttagcaaccaatagaaaggacgcttctgatccatgaacagacttgcacatgaattgagattaccccgaacgtgatgtcgaggatgaaactgctctcaccaaaaccagatagagttgaattacataactaggtgacctgacctgggatgtttcactagagccttttctttctctaaaagattctaccttttcttttccatgaattccctttttttattcatgtacagaaactcttttgttattttatttcagatttgcattggttaccttcatccttaatgaggtatccaaaggcataagctgaacgtgtcatttttattttgacaaaaatataatttgcttccttttatatttataggcaaggaaatcaagcgcagaaaacgacatagaagaaagcagtatgtggaccaagaaccatgcataatgagaggggtctacttcaaaaacatgaaatggcaagctgctataaaagttgacaagaaacaaatccacttaggtactgtcgggacacaggaggaagcagcccgactatatgataggtattagctggacttttatgcacgattatgatatttctatctttgcatataatatcatgttctgctttgttagtaatatgctgatacttgtatacaatactataaatctaatttactttaatatcatgaagaagtgatatattgatatatgctagaaaatattacaaaggaactagctagtctgcaaagttatcggagtaatagccaaaaatttttagaagcaccttcaccaaaacagtacaatgttgctttatcaaatctgtttgttgtctcaataaactaaggtttttttattatataatgattaaagactgttaacatcctaaaagatcaatattgttccatgcttaaggtggactactcatcattgttggcatacaaccctcaagcctgtatacatacagtataggttgcatcatatgcatattacttcaaacgccacttgcatatctgccgtggccaactgatcataatttattgtgtaggagaagctgatattttgtttgaactgactagatttgacatatcaacacagggctgcttttatgtgtggaagggagccaaactttgaactttctgaggaagagaagaaagaactacagaattacacctggaaggacttcttggatatgactcgagacaccataaccagcaaaagtaagacgagaattttaaaatttcttgtggttgtcacttaatttttccctgctagtagtcaagtacatcaatatatatatcattagtagtagactataacatactttttgttcatctgtttgtcttcagaacaaaggaaagttggattaataaggcgcaataagacggactcgctggtaggacagagtgatggtgatactgagatgatcaatggtggcggctcatcgcactcggaagatggagatgctgagacctcagcatcttaattaagactgccaccagagttcatggacagccagattgggtctttcaacagattcgtttcaatgaagacataatttccatttaggtttttgttctctcaataattaatttcatgtgcataagggccctgatggtctgataaaggttaggctagagaaatcatgccatcccatataaagttggagatggtccattataggaacacatttctctgagcaaatgagcaatcatgtatagaaacaccaattcctgaactgtgtatatctttaccccaaatttctctacatgtaactagattacacatttaataaagaatttatttttcctttcaattactgtatctttcattctttcaaggaagcatgatccgttacatttatccattaaacattatatgccagtttctagatgacattaaaccttttgtttgttcccctcctcgctctctaaaaattgtattgagtacgagaaagcaaaattagcaccatgatttggccattgtcttgttttttacccccaaattatcgtttacaccacaatttcgtaccagcgtccatccctctgttcatacagacgtgtaagtctgaggccaaccacaatttcgtaccagcgtccatccctctgttcatacagacgtgtaagtctgaggccaaccgaataatttatctgtatctctactacttaaaaaaagtatgtagtggtgacggtgaagccaatcctaacggacacatgtcctatgaaaccattggattgggacagcagaccccatcgcacgcgactcgctttcctccgccgcgtggctcacgctcgcgatccaacggaaaatgctacttttgtacgatttttatacgcgatcgttacgcggacggcgcttggcatcttaacgttacgtggtgcatgcgtatgttgcagcccaagcccatacgcatatactcattattttgttttgcctttttttctctgtatccaaataaatataaaccatgccaaacattggctcatacatgaacatttgctgcatcttatcgacttatcctgatttgtgccattggaaatttagaatacttccagctaggggtgatactaccagggtccgaggtgcaaggatcatatatactccctccgttttataatataagacattttgactttttgcttgcactgtttgaccattcgtcttatttaaaaaaaattagaattattatttattctaaagtactttaaacacaacttttagttttttatatttgcacaaattttttgaataaaacgagtgatcaaacattgtaagaaaaagtcaaaatccattatattataggacggatggagtatttgtaaaactaggttcatgtcaaaataatttacttaacttaagctaggttacatgataagtgttgagcgacagtacgagtatataagattgattaggaaaaataaattactctggttagctgtgccaggaggctttaattataagatgtcaggacgatgatgtgatgagcttggggttttggatatgggccggctcagcgttagaagaggtccagtgtgggaccagaacttgcaacgttaatcagcgttatgagcctagaagagaaacgtttcatcgtacaaccgtcgtaacaaattagtcgtacgtatagcagcgccgcgatccaactggcgacgccgcgcctcccactttttcaccgcgccccgctacacctccaccgccggcgccccttggcccaaatagcagcccgtcagcccatcaggaagaggagaagtggaatgcctcgatcttttctcggctcatcccgtacgccgctactcttccacgtctctttggtttccatacgccgtgtctcccgagaacatctcgccgtcgccttccccctcgcttggagaacggcagtgggtcacggctagggacgccgcactcactggctgccggccaacccgtcgctgatcgtccagtccaggggcaacagccagcatccggccaaactttcacaatatcagccacgaataagtccatcaaggtaacaaataatgcttcatctatttatttttcaatcaacttcactggttatagacaaaactaattggatgttatttttcatattgtaggattaggagtccagtaggtttcaatttgggttcttgagaattggagtaaaactgtaaattggaggcaaattgtaagtcatgtaaactgtgattttacttgaatgaatgataaaaaaaatatacaatttcaatttctggaacgcaatgatagagcatgatacttgatttttttttctgtttcttgttaagagaaaacaaggatggtggatatttagcatttgttaagaagaaattgtttaaggctgaaattgttaattgacatagatggactctgctgagaccgggaaagaaccaactgagattttagccaatacagagataccagagcaggtcaatgactcaaacatcacttatcaaagaattgagtagataaaaaacatctgtgcatcagaacacaaaaaaaccaaagaaggaacatgtaatccaaattatgcggcaaggtacttctattttctttagaaattatgatgtattttcttttgttcaaatatgatttatttttgaaatcttccgctatagattatatttgcagcgaagaagatagttagctcataggttatgtgagacaattaccagagagacaaatggtcgtcgacatcagtggtgcctttctttacatatatgacatggcctgtcttttttatgacagtacttatgttaatggcgatgtaactacaattatgtttagtatgcataccacaacatggctaaaaataatctaattgtttttttgcataggttataaatgcttatattcattgtatatgggaagaaaaacaccttactaatagagatggtggaaaggtatttttggataacactattatttctagcattcttaaaagtgacggtgcctcaaacttaggtcacaaaaattataaggatgatactatttgcggttctatgtcattgaatattgctgtagcattagctaaaaaaattgatgggagataaaaatga

SEQ ID NO: 61007 - DNA, 23366 bp, Oryza sativa
ctacagcaatattcaatgacataaatcaaagaaccacaaatagtatcatccttataatttttgtgacctaagtttgaggcaccattatttttaagaatgctagaaataatagtgttctccaaaaatacctttccaccatctctattagtaaggtgcttctcttcccttatacaatgaatataagcatttataaactataaaaaaaaaacaattagattgtttttggccatgttgtggtatgcatactaaacataattgtacgtacatcgccattaacatagctactattataaaaaagaaagacaggccatgtcatatctgtaaacaaaggcagcactgatgtcgacgaccatttgtctctcaagtaattgtctcacataacctacctatgatctgattatcttctgcgctgcaaatataatctatagcggaagatttcaaaaataaatcatatttgaacaaaagaaaatacatcataatttctaaagaaaatagaagtaccttgcagcataatttggattacatgttccttctttggtttttttgtgttatgatgcacagatgttttttatctactcaattctttgataagtgatgtttgagtcattgacctgctctggtatctctgtattggctaaaatctcagttggttctttcccggtctcagcagagtccatctgtgtcaattaacaatttcagccttaaacaatttcttcttaacaaatgctaaatatcaaccatccttgttttctcttaacaagaaacagaaaaagaaatcaagtttcatgctctatcattgcgttccaaaaatggaaattgtgtattttttttatcattcattcaagtaaaatcacagtttacatgacttacaatttgcctccaatttacagttttactccaattctcaagaacccaaattgaaacatactggactcctaaccctacaatatgaaaaataacatccaattggttttgtctataaccagtgaagttgattgaaaaataaatagatgaagcattatttgttaccttgatggacttattcgtggctgatattgtgaaagtttggccggatgctggctgtgcccctggactggacgattagcgatgggttggccggcagccagcgagtgcggcgtccctagccgtgacccactgccgttctccaagcgagggggaaggcgacggtgacatgttctcgggagtcacggcgtggaaaccagagagacgtggaagaggggcggcgtacgggatgagccgagaaaagatcgaggtcttccacttctcctcttcctgatgggctgacgggctgctatctgggctgaggggcgccggcggtggaggtgtagcagtgctcggcgaacaagtgggaggcgcggcgtcggcagttggatcgcgagcgtgagcgacgcggcggaggaaagcgagaaaagcgaatcgcgtgcgacggggtctgatgtcccaatccaatggttcataggacgcgtgtctgtcagggttggcttcaccgccaccactacatactttttaagtagtagagatatttttatggcccatatttatggaaagattttgatgtctggagatatttatcttggtaatgatttatgtcttggtttgcataatgaattcaattcttggaatggtgtcaaactgtcaactcagtatcactctcgaatggtgttaaactatcaactcagtatcactcatcgatattcatcaggttctttcaggtgtgcacctaaatatgtttttttttgaaacctaaaagaaagtgtaaatgttggtcctaaagtgtggaaatgtttcttgggctactttgatgtagctaatgagctatgaagagtatgtcagaatatgatccttttaatgaacctcttttccggatgttttactaagcattttttttaactctctcgattcatctctgaaaaattttataggttactggccctaagtttggctcaattataaattggtttttccaatattcggtgcgacttccatagttgaggaaccacatatcaaattatatgtttttctaaaggaacatgcaatccaaattgattaggtcgactttttaaccatttagggatgcgatctttaccactttgtgtcttgcatttgcatatggaacatgtcttcatttcggattttttctaatcatagaagatgggacgtagtgttgctcgatcagggccctatcgttattgcgaagcaaattaaacagctgcagtattctgttctacatgtagtatatgaaaatttcccataacggaaggggtattagtcacagattggactaaaacctacataaattttgtcaaaagcgaaatgatgttatagtttcccttaaaacgtgatttcgttctgatctaagccactagaacgggatcggttatctttaatgggctaaaagcctcatctctttcaggtataatccccgtcactaagcaaaggtcactgatgtgagaacatatctcaatcgggcacaaggccatcacggatgaaagtcatctcaatcgggccaaaaacagtgtccgtcacagataagtttgaccaagcaaaccgagtcaaaccaggctaggaaggagcccgtcacggatgactaatctcaatcgagcacactactaagcccgtcacggatgactaatcatctcaatcgggccttaagataaaggccgtcaccgctaggtttaaccaacgtgttgagtcaaaaataatcatgggccggacgaattatctctatcgggcttatagttatagcccgtcagggatgactatatccctatcggtctaaaggttgagaccatcacagatggctctatctctttcgggcctacttgaaatgcctgccagtgatgagtatatccaaaaaaaaattgttttttggctagtctcaggcctttgctagccatgcctgcagcaaaaataatagaagcaatatacatagtcccattcccagcaacccacaattcccagcatccattcacatattctgtcatagcattcattcatccatcacagcattcatccatcacatatttatgtcattcacatcctatttgctcttcaaaccgcctacatgcatcaaaacctgcaaaactgagttataaatttaaacaagtttatatgtaattagaaatgcaaatatttacataacattgtggaaaattgtgttacaaagaatatttacataaatccaatgtttgtcgcaaacattgcaaatgttcaaccattcagagacgagctagctggaccttgactctaaacattccttgttttgacaacatatcatctagtatgaattctgctatcttatctctaatgatatcgaagttgttttccgggatccttgaaagtttttcatgtatgtgaggcgccaagttagtctacatacttggcaagttttcgtcctatgtctataataatcaatggaagcacacacctcaaggtcgagcaatgtcaccttttttgcgaagctcctcatgttatgccagacatggaacccacactggtcgccaacttgttgatgcattgggaagtcttttttgtgaccgagtgtgggatgcccttccttatgccacccgccttttgccacatattggtcccaggcgttgttcaaagcagcttcaatcgccgaccaatcgcatatgtcttttttgatattggagttaaggtagtataccaaattccacttccgcactatgaccaaaagaatccaatgacgcctgtgacattaataaattgctagttaagttttaaaaacttaagttatatgcgtcgcgcatttgattctaagtagggtacacgcttactgttgattgtaggcgcacataatgaattccttgtcttgatggtaccataagcagtccttgatatattctaccatgttggctcgatcgctgtttataattgtctcgttgatgacagctagatcgagtaaggcaacatggggtgcatgacgacagacatgcttccaagttaacctagaaacaagacaagaatccgggtaagcgatagtatatggatagtgaataccatagctcgtatgcaactatacttataaggagtagcacttaaagaggatggtgtcgatcgaccgcaccctgtagaggtcccatagatctttgaagtctatggcgatgaaggcttcaggcccgaggaatggctgtctatcatagtagcccgtcatggaggtctctctattcttcctccttgcgttggacctctccatgcagtagccgtgcaactccttgcatgcagggcccatcttcactaacacgtcatctctgaccaatggcatgtctaatgtgaattctgtcggaggcttaggatgagctgatggcgtcttgccaagatctagcttcttcggagccagaagagtcccttgcacctttcctattgcttttccctttccagcagcttttttgagtgtgtcaaggtggggtggagaagatttcaccctcttgctccttttggcaggaggagggttttaagcctctgcattaagctcttagcatgtcctaattttggtgcagatttttcatgcttgcatcatattttaagaattgcaaaaaccccataccgcgtagattctagagcatgtagcagtcactcttcatatttttgcatagaccagtatccagtagctaaaattttgccaatttaccagtagctacccaacttaattaagaaaccctcacatttttcctagaatttttgcatgcctggagaatgggttaaaaattcgaacagcacagatcaacctgtagtttcagaactgcatcatctagtttagaaattcattacagataaatatatgtgtctaaaaattgtaaatcttataccataatgcggggtgtaaccagggcatccttaggcatgtatttaaccaagaaatttatgcattcacatgttgaattaaggttaacctattgcataatagtatgctggacagaacatgataaaataaccataacaccatttccgagttcctaatgagtttcaattgaaattctaattggtctatgcttccaaaggttgtagatgtctactgtgtggcaaccactaggctattccggaggttatgaggaaggatcattgcctcacatcttgtggctcatgctgcaacatcttggccataaccacccaccggagtatcatttcttttctcttgaacggagttcatctctccgagcttatatggctgagctgtgtatacaaggattttggacccatgaatcacccctttactttcaagcttatggttgggatgcaccctcagcaatgcatgaggccgcatttcaagcgattgtgtattaccgacaccacaggccagggatggatgggttctttcactattttccaactcgtacaaatcaagcaactgccaattactatccaggtcttgagggaaacatgagagagattgacactccacagcttttcttagctggcctagtttgtgctatggatagatatctcgcgaatactatggctgagttgcgtagattgcaagctagagtggtcatgcttgatagacgaatagaacaacttgggcatcaagggcactttgataatgccattatttatgtgaatcatgaacttcagcctcttactgagaccttgcctcctcccgtgggcgtttattaaaacataaacactagagcccacatgagagttggtttccaccgcaatcgtcgaaccatgccagaccctgcacttgttggatatccggtgttgctgggaccattctacgcatttgagcggaatgggagacaataccatttgaccatggccactccgtcaaccacggtgcctcaatctcctatcgaattctcccaagttccatagaatggtgtactaaaggaaaaatgtatggggtgtaactttcatttctttttccaaaagatgcatgagacgacaccctattatgtaatccttctaatggtaaaaaatttgtaacaccgaggcatgaacttggtttcttatgaccattatccaattctatgtatctatgatcacttagatcctttgaaactgatgtactggaatgagacttatgctccttttggaatgaattgcttgctgtccagaaatttgttttatgcaaatatgaaatggaagacttgtaaattcagctataagaaatcattcctgtgttctacatatttagggtgatgtatatgtcaagtctttgcacaaacagctcatatacttgtgtaccttgagtgcaggatgacaaatactcgctctggagctcactctgcagaccgtgccgggggtagtcgacgtactgccaccactgagcagcatgacgatgaaccgtcccttgtgcaactcttagccaatcagaaccggctctttgaaagaatggtggcaaagtctgagaacatgggggctgctatggcacagcaggctaaccaagcaccttccaagttggcagatgttcagcgaactcatccgccacatttctcctttgtggtgctccctgtgtatgcggtccagattttccagtcttcgggtaaggacagttaggagaataatgccccttcttgccgcaattataacatgcgacattatcattacgagatgcatctcccgcagcttgaactgtgcgaggaacttgacggactatctgagtttgtggacgtggaggcacatacatctgccgtggtggctgaggcgccatgggacgaaccacaggagatggagcaagacgaggccgagtggagctgctgccacttgcaaatttctttgcagcccacttgcgcttacgatcttcaacgacttccttctcacttgattcgacacgaagggctttttcaaccagtgacttcatgctagtgatttcatgagcagtaatagcatggttgagttcaggtgcaagacgatctctgcatagctcaaccttctttgcttcagtgttcatgtcagcagcgacatatctacccagatagttgaagcgttccatgaactccatgaaggtcatgtttccttgcttcaagttaagaaactctttctttttgatctccatgagaccaggagggatgtgagcagatatgaatccttcccagaaaacagtccaattgttaggctcatcagaggaatgagagtcttgtatgtctcccaccaagcagctgatgctccttgcaggtagtatgcagcgaatgtagccttctctacaggatcacactggcaaagatttagcttgattttaatatcacgaagccaatcatctgctgcgagtggatcagctgcagaggagaaatgtggcggatgagttcgctgaacatctgccaacttggaaggagcttggttagcctgctatgccatagcagcccccatgttctcagagttcgccaccattatttcgaagagccggttctgattggctaagagttgagcgagggacggttcatcgtcatgctgctcagtggtggcggtacgtcgactaccccaggcacggtctacagagtgatcaccggagcgagtattttccattctgcactcaaggtacacaagtacatgagctgtttgtgcaaagacttgacatatacatcactgtaacgccccgattttcggtcgggattaaaaatcaattaataatgcattttctagaaattcaataaaagttaaagtaacttaatcaagtgaaataatgggagaattaaaattttcccttaaaaaaatcattggccgaaaatattttataatattctttgggtcctaaatattctctgaaattttcccgtgaagtttcggagctcaagaagtaattttaaagtcacaaagttcattaaactcatttaaataaaaagaaaaaccaaattaaatccctttcctccctttttgggctcggcccaactccctccctcctctttcccggctaggccggcctccctttcccctccctcggcctccctcctatcctccctcgcaaaaagtcttttttgcgtcccttcctctctcccttcgctgacaggtggggccggccccttcctccggctccaaccgccgccatggccgcctgagcctccccacgacgctgccgtttccgccctccttctccaccccgcgcacgagtccgccggccgtgggaccccgccgccccacgtcctcctcatcccccacctctcccttccaaaaccgccacccacaccccacgatgccgcccacgccgccggcggttgccgccccgactccgcctctcccgggctcggtccgacctcccctcccctataaaaacattccccgcacctccctctccattttcccctctctcccgagccctcctgtgcacgaaaaccacgccgccaccgtgcacctctcgccggtgatcctccagccggccgccaccgctgctcctgccgccgccgctccgcgcgaccgccatcagcggcttcgccgcgtcgtgccataccccggcatcccctccgcttccccattgtgtcgccgaaaccacctccccacggcgctccctctccccaccactcatcggcgtgctccagccgccgcctcccgccgctcctagccacctcaagtcgtgccgtcgccgccgctcgcttcgcagcaccgaggagcacctcggccgccgcttttcacgaccagaatcctgctgaaacacggttcccctcgcgccggtgagcatccgccgctctttctcacctccggctggcgattcccgccgctgggagcccctatcccattcctaacctttcccttgtcctccccaggtccttccggccgccgtccgccggttcccgctcgcggaacgccggcggccgccattccgccttcgtcccgaggagcgtcaacgccgagcttccccgtctttccccgcccctcgtcgccgtgtcctcggtgagctcctcctctccctcctagcgccgtgcgccatcacttccgtgcgtgcgtcgccgccttgcgcagccgccgctcgccgccggtggcctttgggcccggcgcgtcgccgcggcgctgtcgtgtgctcggccggctagcttgccgccgtcccgctcgcccgtgccgctcgaccccctggtcgcgccgctccctcgcgtgagccgccgccgccgctcgcgtgcgccgcctttccccacgctgttgctggccgtcgccgccgtgccttggctctgccgggccggctttgtgccgcacccgtgcccctggccgccgctcccctcggccgctcgatcggctcgggccgatttgggccgtccacgtggtggacgcgcacccgaggccatgtgcggacttggtccaccgtgcgccgcccctttgtgccgctgacgtgcggggcccgcgtgtcggcgccggcctccccttgatgacgtcagcgcgtccctattcctctgagaaattaatcattaattgtgttataaattgtatttaattctagaaattcatttaaatggctcaaaacttctaaaattcaaatctaattcatatgaactccgaattgagccgttcaacttgcaaaattcatctaaaattgagctctacatgttttttttactttttatgtactgttcccttagtgtttattagagtttttccttgttttgtgtgccagcgtatagaatccgtcgtttcggaagtctacggtctcgaggaaaagagttcagaagataaaagtgaagaagcaaggcaagtcacacatcccccttgagcatgttgatccaaatttataaatgttttattgtttgcaaataaatatgcatcgttttactaattacatgggtatagggtttacctatctgcttgcttgtaccatgttatttgatatgtgtcctttgtcaaccttgggtgataaatcgactagcttatgttactttgatgacctagctagaactatatgcttagcgatgcttaattaccactagctcagtagatgggataattgcagtattagacatgttagtattatgatgagctacgtgctcgagacatctggccatgtttcatggtcataattatccaactaaaatacgactgaatagcgggttgtgggtgcatggttttgctggtcgcacccatggcaattaaggaccggttcgcgggatgcactagaagacatacaacgcttgccacaagcgggaatgggtaactgcctgccttgaagtgtagcttttctctggttgacgcatccaggcaagggtgggcgtgatggagcagggcgggccctgcgacggcctctgtcgcttccggattcacctagccacgagaggggactgtccgctacctgctgggggcgggggtgaagcctgaggtgtggtgtgcttggtcagagcgggttatatgaagggtcttgtcacaatcactcgacatggtgacgtgtctggccgggcacggtgacatgccagtggattgtgtcttgtgggtacagttgtgcacctttggccagagtaaaactattcgaatagccgtgcccgtggttatgggcgatcgaccagaatcaccgtgattagtctcacacttaataaatcgacccaatgcactgtagttcaggtgggtttgttgggcctgttcaacgtggtgtagcgttgaccagtggagatttaatattaccttaattactcaactgttttactgtttgctaaataaagtgttttacaaccgcctttatgcaaatagccaccaaccgtccttgtatccccttgcacgtctgcatcattggtgtggcttgctgagtacggtggttgtactcagccttgctattattttcccccttttaagaagtgtagtgcttctgagctaaagacaaagttagaggaccaaggctcagaccccagttgagtttttgcctgtggagtggagctgaagccccgctaggattgcctttttcagctgctgctgctttcgtttcggtgtgaggactaagtgcctcttctgtaagtattttacgctttatttacgtttggatctgtatatttacttgtcgttttgtgtaccccggctggtcctggacagggatttaatacacaaaatagtctggaaatttgggctaaatttatgggcgtgacaatcaccctaaatatatagaacataggaatgatttcttatagctgaatttacaagtcattcgtgtcatatttgtataaaacaaatttctggacaacaagcaatttattccaaaaggagtataagtctcattccagtacattagttccaaaggatctaagtgatcatagatacatagaattggataatggtcataagaaaccaagttcatgcctcggtgttacaaattttgaccattagaaggattacataatagggtgtcatctcattcatcttttggaaaaagaaatgtaagttacgccccatacatttttcctttagtacatcattctatggaacttgggagaatccgataggaggttgaggcaccgtggttgacggagtggccatggtcaaatggtattgtctcccattccgctcaaacacgtagaatggtcccagcaacactggatctccaacaagtgcagggtctggcatggttggacgattgcagtggaaaccaactcttatgcgggctctagtgtttatgtttttataaacgccattgaggaggcaaagtctcagtaagaggttgaagttcattgattcccataaataatggcattatcaaagtgcccttgatgcccaagttgttctatttttctatcaagcataacgactctggcttgcaatctacacaactcagctatagtattcgcgagatatctatccatagcacgaactaggccagctaagaaaagctgtgaatttcaatctctctcatgtttccctcaagacctggatagtaattggtagttgcttgatttgtgcgagttggaaaatagtgaaagaacacatccatccctggcctgtgatgtcgataatacacaatcgcttgaaatgcggcctcatgcattgctgagggtgcatcccaaccataagcttgaaagtaaatgggtgattcatgggtccaaaatccttgtatacacagctcagccatataagctcggagagatgaactctgttcaagagaaaagaaatgatactccggtgggtggttatggccaagatgttgcagcatgagccacaagatgtgaggcaatgatccttcctcataatctccggaatagcctagtggttgccacacagtagacatctacaagcgttggaagtatagaccaattagaatttcaattgaaactcattaggaactcggaaatggtgttatggttattttatcatgttctgtccaacatactattatgcaataggttaaccttaattcaacatgtgaatgcataaatttcttggttaaatacatgcctaaggatgccctggttataccccacattatggtataaggtttacaatttttagacacatatatttatctgtaataaatttctaaactagatgatgcagttctgaaactacaggttgatctgtgctgttcgaatttttaacccattctccaggcatgcaaaaattctaggaaaaatgtgagggtttcttaattaagtttggtagctattggtaaatcggaaaaattttagctactagacactggtctatgcaaaaatatgaagagtgactgctacatgctctagaatctgcgcagcatagggtttttgcaatttttaaaatatgatgcaagcatgaaaaatccgcactaaaattaggacatgctaagagcttaacgtagaggcttcacaaaaatctggtggcctttatatgacaagcaatctgtggttaaaaacaaatcaattccatcctgccccatactaccattttctaggccatcaatgaaaaattaaaattttgaatttaactttggaaaggagtaattagccatttatttactgaaaagttttaaaatatttcaagtactaacttgaatagaatttgtttcattcatttcctagtcttttctatgagttattacttttttatttatgcatcatccaatcctatagaataagatgtggtttttaaaatcaaaacaagattcaaaggaaagaaatttatccaaagagggctaagaagtaataatatattagattttgcaaaaatattcttagtgaggatattatcctcaaaatattttcttttgaagccttgctaccattcaatcttagaagggttcctgcgtcggtcttgctctgataccaatactgtcggaagcactccaaacctcttattatatttgaaggatgaatagaataactcaattcttccatcaaacataataagacattcaacgctccgagagaaagatacatgagaccttgctgggcctttagcctgccagtcaacttcagcccagatgtgcctgtcaagccactcgatggcagcgaccagatgtgttccacattcaggatacttgacacaaaatagctaaagatctacatgatctcaaatatctttaactcatactcatgtttaatatgctcctaacaaaaagaacactctaaacactttcatccaagcacatgatatctctaacataaggagttctaaattctaagtgttagttagaatcatacaacatagtacttagatacatatggccgaccagccaaatagctaggttcgcggaagcataatctacccaaaagatctttcatacaaccgactagggtagaccctagtaagaaccatcctagaagaacgaaacatcccctgcgaaatcctcctcctcaggagtgatctcacctacaaccaattctaagcatacaacaaaacaacaattcatgcgaaatcatcctcctcaggagtgatctcacctgcaaccaattctaagcatacaacaaaacaacaattcaagcaagagtcagtacaaataaattgtaccagcaagcaccaagcaaggctaatacactacatgcatggcatattcaaaataaagcttacattggatattttcagcataaagcatattttgtttgcaaagaccattttcaaattcagatttctttttaattaaatttcagcaagcatacacttagcaaatgggcatcaaagtagatgttaatcacatataacatagctccttattgccttccatggcagcaaggacataatccacaaatcacaccacattttgaagtttaaattcagcttatggaagaatagaacacaagtctatactcatgacatattcacacgccgctcataaccgcaagcacggctaatcgattagttttaactctgcagagtacgtacactttacccacatgatgcgatataataattatgcaaagcatggcatgcgatacataagtatccgatttattactcacaacaaagcccttccaaaattcatgatttagccttacaccagtacgatacgtgtttctccatcctaagccatattcgatatatgacctagaaccgttaagtggcgggcccacgccttaaacttaacgccgtggtggcggacacgacgggaacccaccacgtggcataataccgttgtattggacatgcttagtcacctaaactaccacatcagggtaaataggaagctcctctgaattattcgaactcatacacaccggcctaccagaatataaggctaaaccataaataatttactaagcttgggctatcccatactagcacatgtggttgtactatatacgaaatgaactatacgaagcgaactgacattgagtgaagtccccctatccgcacacaactaatcaccatatgtgtaccacataaggcccaaacctaaaatccacattttctaacattttatttaacaaatatcacattttattatttctatccagaccataaagtagatcattttatatacatagttgagccctggctaagcattttcatagacttgtgaccgcaaacatcataattaatgtgacaaaatgaattgttcctaaggctaggaataatggctaaggtcttttgtggagtttaggtggtaatgcaagttaaggagttgatctaataaatttttacaaagttttagtgaactagtgtataatcaacatgcacattttgcaatccttttcaaataacctccaaatcataggttcaatgtgatcaaagaggggaggtagcttgccttgctcttcccctccttgctcagctacgaagtgggtctcctcgtgattcgactgcgaatcgtctaaacatacatatgcaaaatcaaaattataaacatacataaaaatccaacatgctctaaaatgaatgtttttcatagattaattgtgttatgtgttacattgatttttagtgaaataattttcattttaacagttttcatttaaaagtttcaaatttttaaagtgtcttcatattaaatatagacctacatgcatttcggatttttgagacataaatcttcatgattttgtttagtcgaacatttttatgatgcagagcataaaaatatgattccaaaaaaatttagtttgtaaatttcagagttagaatgaattttctacaaatttctaaaattttaccatttttcagttgataagaaactagttttgcattttctctatttttctcaaatcattatctctctcgggtccaccggtcagtgactatatttttgcgcataagtccctgggttctcaagaaataggtcccgcagcctctaagcacgtgctccaggattttattcaaaaaggtgcttaagttttaagttattaccaaatgagtaaatggtcccacatgtaaagcgtctgtttacccctggagatttttaaatttcactaagccatgcccttgctcttgacagagcagaggagcagctctcccgcgagcttcccgacatcgccggcggtgaacagcggcgattcagttcaagctcccaaaacaaaaggtgtagaggacaaccgtacgaacctataggtagcttttttgcaagttttggtggtctatagcggcagttaggatgttagaagcggcggcaaagcacagcttgcacatgcatgccatgatagagactcgatctgtttgtgcatgtgtttgctgaaggtcctagggactaccagaaagctcaccaagcagcgaacacggctcagcacggtcttggcgatggagagctggtctggcagcggcgcagcggctacggttgtcgttggcggtacacctccggtcttgatctattcaaagagaaggcatgcatcgatttgagatggcacaagacagatttaggcgaaaaagcttgcgccgaagctcaccagagaaggaagaagagaggaatggcgtgggcggccggagttggggaagaagatggagatctcccaccatggttcaccacgtgcctattccttcgggattcttggtcaatgggtgctggtgaagatgatggcgagatggcttgaccaatggtggactgtggaagccgggcgacgagcaaaggcgaagcggcggtgtccagaacgcgacggcgttccgagttgacgtggtcgcgttcccggagattggctgcaccaaatgaggcgttcttggtggcgttagagagggtagtgagactggattagagaatggaaatggagctcaccggttagcaatggcgtcgaggacttctctcgccggtgccgagaatggcgcctctaaaacgtaggctctcttgaaatatccgatgcgatgccttgagagaagaatattggagacattgcttgacttttagcctgccagccaacttcagtatgagatgtgcccgtcaaaccactcgaaggcggcgaccagatgtattacacatttaggagactgacaaatggctaaagatctacaacatctcaaatatttttaactcatactcatgtgaatctaaattctcaggatgtgcactagattcacactttcatcttaagcatggacgtacatagcaaagacatttaagacgaaagggacttagagacttacatcaatttaatagttaagtaggccgaccggccaaataggcatattaaagaacaacggaagcttgactacccaatcctcaagcacaccgactaggggttcactccattaagttcacatcctagaagaagcaatcgaaacccgcattcacgatacgtgttaattcaatagcacgaaacctttacactacttaatttctagccttgcaccagcacgatacgtgttcctccatcctaggcatactggaaataatacctagaacagttaagtggcgggctcacgccttaaacttaacgctgtggtggcggacacgacgagaacctagcacgtggcacaatactgttgtattggatagacttagtcacctaaaataccatgtcgggataaataggaaattcctctgagttatccgaactcatacacaccggcctaccagaatgcaaggctagatatgctaagtagataaatcagcttaggccatcccatactaacacatatggatgtacgaataactttaagttggtgacacaagtttggtccttacggacttgggcaaacactccccctatcggtatgcaactaacaccatatgcacaccacttgccgcccaagtctaaaatcacattttacacattttagttcgcaaatactcatcatattgattttattccagcaaaggttcacatatcaaagtcacattttaattatagatggaatgagcatttgcatatttctaagcatggctaagcaagtagttgcatatacattatatataaacccatttgagcacaaggaatatactctaaccatttctaggggtacaaactgcaaggatcacaattattcaaggtagggaatgcagaaaaaaggtcatataccataacaaaaatttaaatatcgatatagtctaggtttgcatgcaattttgcaaacaaatattttcattcctcaaaccataggattcaatgtgttcaaaggatgggaggagaacttgcctgttcctcagaaatgttagcacctaagtaacctcttcactgtttaggcaattatctatataaagtatacgttatgcaattaaacactgaaataggcaaaaatccaaaatgctctaaaatgcatgatttgtgtactgtgggtaggtactgatctaacatgaatttaggtgaaagaatttttattttatctctttttatttgggagttattaattttagaaattactcggtatagggtaatatttactaggttacgtagtgaaatgtttttgtaaagtgacttttattatgtttgacttctctggagtgtagagatatattttattatgtttgacttccctttggtttcacaatttttggagttatcatgaattttctatgtactctacaagttataacacgttctaggcatatagtttctatgtgtatgtggctttggaggtttaggttcagaacttgttccatcttgctagtgatgtataaaatgaatgatttagtcaatcaattaaattttagttcacaaattttagagttgatattactctactacacattttgtaacttagggaatattctatgttaatgacttaacatatcaacctagagtttgttacacgagctatgttcatctaggttttagtgaatgaggatgaatctatagcttgtctagtctaacaaattttagttaggtttaattagagctagagtgcgtctatatatatatacatacctatgttttgcttaatcaacactatatgattagcacttgttttatcaaattaaggttcagagctataatttgtacaaaaagtgccacattatactttactaaattaaatttcactccttgctgactccatagaaacttggttcactctatatggactaaggatgaattttctacaaattgtataagttaaaggctaccttacgttggttattccttacataaatttttttagaggctttcattatacagtatgcatataattttattgtataacatggaagtataggttttggtgattctacagaacctgaacttactcaaaaaggagttaaaatgaattttatataaacttctaaagttcaccttacacaaaactaattattttgaagatattagttttagacgtatttggcttaaagtaagtatataattttatttctcctatctagagtgtgcatgttggtgaatctgtagaacttaagtttgttcaaaaataagttgagatgaattttggttgcattttataatttgggtatgctttatgtatgatttatcttggataaattttagagacaaaccttgtacagtgtgtcaatttttatgtttctaaaataaatttcataactttgtgaatctatagcaactggaatcatctcaaaatgagctacatttgattttatatggattttacaagtttgagcatttttctgcagaaaatgtaaagctttagtgattttcccttatattttcagattttaagttcatggggtccacatgccatcctctgctaatatacaaaaaggcccctatggttccgaggaatagaacccgcagtccaacatgtgtctatgccacagtttataaagagtccccatttttctcttgtattttcgctttagtcctttacctacatgtcagtgagtgaaatgtctcacactttagtccttacactttatcgaattcgtgaaagagatccctggcttattcctgtacaggaagcaatacagggcagcggcttggccgagctcgccggcggcgattgactgcgatttacgcgtgttagagtttgtgtcgaatatgtgtaggtagtcggttatagtttagaacttgaagttgtactaggtgtaggactagagtaagagtcggactctatcctaagatctctcataaatagaggggtgtgcctgttgtaaccgcatggcgacttaacatagcgagagggagcggctgccggcagcgaccggccgtgagtcgttgtaactctgatacgctgtatatgctggattggggaggagcgcccgtaatcagtgccccggagatgtaggcaactccgttatcaaatatcgtgcctcggtgtcgttatcatgtttggatctcctatggcgtatgtaggcctcggctgaactccgttatcaaatatcatgcctcggtgtcgttatcgtgtttggatctcctatggcgttttcttccgtgtttcgtttggcctacacaacccaaaagactagtctgataggtgagaaccgcccccaccttttaagtcgtgctcccccatcatcaattaccgatgtgggacccgtcacatcaacccatgtgaccccgaagacttgttacctggcctctccaccatgtgacccatggaaattgtatcttttaagtcgacccgtcacatcaacccatgtgaccccgaagatttgttacctggcctctccaccatgtgacccatggaaattgtttagaatgatgtgggacctgtcacatcaacccatatgaccccgaagacttgttatctggcagatttgttacctgcctctccaccatgtgaccccatggaaattgtttagaatgatgtgggacctgtcacatcaacccatatgaccccgaagacttgttatctggcctctccgccatgtgacccatggaaaatgtgaccccatggaaattgtttagaatgatgtgggacctgtcacatcaacccatatgaccccgaagacttgttatctggcctctccgccatgtgacccatggaaattgttccgggttctaaaccttgggctctgataccatttgttagagtgtgcagcctggcccaccaaccgtgggccacccaggtcacattggttctgctctaccacaagcccaattggagccacaactttaggtcctgggcctacacaaccaaaagactagtttgatgggtgaggatcgcccccactttttaagtcgtgctcccccatcatcaattaccgatgtgggactaaacccaacaacgcagcggtgcgaccagaagcaaaaagatgcagcaggtcattgcgaagctaatggtggtaatcttgctagctacggtggtcgtaattgacgacggcgttggtgcgagcgaaggtggttctcggcatgctaaggcatgtcgagctccggctcgtttctatgcgaatgggtgcatgcatgtgtgtctactgggttcttgggtactcattgaagctagacccgcagcttggattggtctgaacatcggtgacagtggagaagacgacctggcagcaacggaaatcggcatggcgacggcgtcgacgttccttcggtcttcgagctgccaaggacagggggggaacggcttagagggaacctatagatgctctacgagtgaggaatcgcgccgaagctcacccgagagcgaggaatggacgacgatggccggcggctggacttaaggtaggcgacgccgatctcccttacgttgcggcattggctgggattcttgagggatttccaagaggaggtcgtggtgatgatgatggccacgggttcgcccggatttggtcccggaggccggcgcgacgatggtgatgcagcggtggcactcggtgcgcgctccagagcgtcggagtgcgcggtcgcgttcctgtttaaccgctgcatggaatgggacgaaattagatggaacggagacggcatcaagagtagattgaggaacgcaaaagaagaggaaacgagcgcggctccatggcgttggcgacctttgtcttctcggtggccggcgatggagatgagggcgacggagccctcagtttggtcggctctggagtgaggagtggagatggacgacgcggctggaagagtggagtggagaaggcgagctccgcgttggacacgtcgaggccacgcgtcgagcacgaccagagctcggtcggctctgattcccttcgctctctctctctgtctctgttttcttgtcggctgagggaggttaacaagtgtaaggacaagccagtgagattgtcatgagggatgggtaggttcttgactgaaaatcgattttcagttatttacaggattatttcttttcccatcttcgttagttcttatattaatttatggtgtagataaatccatgtggattttactggaggtaggtgaatatacctagtttttattttttttgggttgcactaaaaaattatgtgtagtttgctctcagaaaattagagaaaataggcttggtgtaaactagtttataaatttttaggaggtctaaacagatgaaataaattctggaaaaattatatttattcatgataaatggcctttcactcatgcacttatatgcagtttaatgcgtattttggtgagggtatgttttagccgattaaggattataattagcctactatttgactggtttgactgatttatttgaggtataaaatttagttattaaattgtacgaaaattagagtgagttgtatgtgttaagtagagcctacatgaattttcccatgattttatcttactcaaattattttagataattagcaagacttatctttatatatgggttttcctcctcataaatgcatctagctatttataaaaaaatatatttggaatctcttgacctaaggtgaaatcatttaacatcattttcatgtctttataattatttgctcaagagtggtgtcgaggagagatcctctctagtgggtggtcgtgagaccccctttgtgagtttggccgggggagatggcgcgatgatcaagagcgtgcttccgcttgcagtctagccgctagattgctacctagcctctgtgaaagacaatggattatataggttcgggccgctatcgagagcgtaataccctactcctgtgtgtgggattatggttaacttttacaagagattttgagctctaagggaaacccagctgttcttcctcatgagctcaagttgtctgagagtcatccctttttccggtgggcgaggtcctccttttatagttcaaggggataccacatgtgccgcctatacctacccgtccgtgaaagggggacccaccttgcctgggtcagacggccgtacgtgccttcaaccagaagcaaggtggtcatgcgtccttgggtggggtccaacgccgtcccccgcctgacacgggggagatccctgttattcaccattaaacgcatggagactttgaaggctcaccatgcgcggagggcgctcctaggaacatgctgatgggacagggcatatctgcccccactccgcctgacacagagcggaacgtgggggcactgccacccgtcccatcgtccgcgaccagtcaccgaccggtcgtgctcgattgacaggggtcaatcgagcggcgccacacgcccaccaacaccgcattaaatgtggcgcgggacggttggggcaccgtgcattgaaggcacggagcagtgtctcctgctctgcctgctctc

SEQ ID NO: 61008 - DNA, 5588 bp, Oryza sativa
gccacgtggccagacgggaaggcggcttccctctactgtgcgtacccccgggcccatatcaccgacaagtggttataggtttgattagtgaaattttatcttttatttatgctcatgaaacctaatatgcaatgccaaccaaaaatccaaatgcacaagaaagactcaaatcaaaacatgtcttatgcaagtatgcatgcttacacttgtgtttgcatctatgttataggttaaagatgaaaaggttttaattttttcttaaattttacttcagtaaaagttgggttgaccacacctaagttaaaaatggaaatttctggctctcaaaaaatggaaaagttagcttcctactatttttgacaagaattccttaaccctagaatttgggtatgttaaggggggaggtgcggcctgctgtcgacctccgtaccgtcggcaccaaaatctgtaccgtattgcaattgcagatcttcatctccttcctcaacgacaggaggggcagatacaagagttggagggggatgccgcagcggtggacgagaacttggtgctagcctaggagttatgttgatctgaatgctatgcttgggccattgaataaaggtcccacgtgcagctccaagggtcataatctcgtcatttggtgggtgcgagagagtgaagctaacccaatcgagcttcactaagtccacttgaattttgccatgcccagctagcagctgcgccccatgcattcgggtctctggcgttggcttgaacgcttgaccctctgcggcaggaattgcaaatgcatgtgtcaccctaacaactagggtgcatgatgtgagttcctgagatacattgatacgtatccttagaatatgttagaacgtattgtggtgctaagacaacaaatgcatttatttcttggttttaccgttatgtggtccaccgcggtgggcccttctggttgttctcccgctgcctcagttgatgcgcagctgctacgcctctgcgtggggctcgctttcccttaagcatgtctccacccgagccttcacttgcaacaacttctcatcgaactattctctgagctcttctctaagctccgcacgaagttgttccttaaggcgtgcatatttctgtgcctttgaaagcttgtgcttcttgtactgccacgcgtattggggaaacccaagcttccagggaacactggatccaattccccttgtccgtccacggtgttcttcggttcccaacgctttcgtgaggacgtcatcctcgcgactttgtgaggagacctcttgggaggactgtttctcaacagtcagttcgacctgtggtacagttaggatgaattagatgaagaatacgatataacctaatgaaacttattctatgtgttgaacttacgattttctggtacaccgcttgatcttagggatttaggaacgaaagtgttccatcactattcttcttcacccttgcccttgcccagtttcttgcccactgcaccgggatatcaccaagcacttgcggggtgttagattccgcagtagcttcatcctccttatcccattccgcctgtttccccgtgtagtctctagtgcgaagccggtgcgggtgaaggttctttgcctgcagctccctataggcctcacttcttgctcaagacttaggggttgatttggcagcatggaactcttcccacacgacccgggtgatgaacgggtatttaacaaatggttctgactgggcagggttgaggacgtagtccgtgaccagtgcggttttgaaatttttctacaagttccccatcttgcggatagcctgccgcttgagtcttgcctaggcctctgcagggtactcgaagctttccttgaactgcttccaagcctcttctttttctgcctgtgggaccagaccgatgtggtcctctagaatggtgaagttccgcctccctaggactccgcatatcgctgggaattttttgacagctttcggaggagccgtcggaaatccaagctcgtccacctctgttatggtgtacacttacttaggaatcctattttgggtcctaggagcccagctcgaagttgtcccactagtagtcactgacattggttcgccttgctgcgacattgcctatgtaactgttgtacgggaagaaagttttaaaaaaagtactaagcacgtatatcttcataaactaggaactacatgtgtattctacacaaattcacattgtattccctgatggtttgatagacctctatgtcgtacctgcgttcgcctcatcgacagaacacaagcatggactctctacaaggttggagcagaggagaactcggcctcgacatcagtgtcccgctcgaacttgctagcgacattgatagcaagttcgagcgggatactgatgtcgaggtcgagaccccctctgctccgggcttgagaaacattgatgctacccgtgtgtgcaaggggtgcgaaggggtcactggtcaccaccctgcccctttctcatttctcccccaaaacgaaaatgctagggtttgttgctgctgcattgctcatcgccgggctcgacctcggccaaattcaggaggaaggagatgggcgggaggaaggagaagacccagagaggattttacatcaggaagctcaccgtcgcccttgcctcgccatcgccgatgtcgcccccatccattcctcggtgtccgcgctgccgccacataatccctttcgcgaccgacacctccagcgcttcccatcggatctggccgccacgacggtgacgggggcgaccagcagcaaccagcagcaacaaccatcgccaccatgacgacggtggcgagcagcagcagcaaccatcgccaccacgatgaccacagggagcggcgtgccggtgcggctagagagtggtggagcaaaaggagtggcgagcggtgggagcgatggatgcggtgattacgatgacagcgaccagtcgggctcggcagagcaggctgccagcggcaagggccgtgctcggcggcgaggagtgagagggtcactcttttttttttctaccgttctcattctctatgccgtaattagtcactaatataagatatactgtgtaatagtactacgaactccactacatgagctcaaataatgaattgttttacccagaaaaaaagatcctcatacatacggttcatacaaccaaccaaacaaactctcctctaaaccgtatctcttgtgcagacaaccaaacaacatctcatactagccaagctagactaatgcaaacaaccaaacgactgcatgtgtatcccattaattaggataagctcaacctggataagggagatgagccaggctagacagatacgagcaaccaaacacacccttaagtactgcaaatggttaatcaccttgacatttctcttgcataatgccatagcaacggctcgagccaccttgtcaagatttcctgcaagaataacttggtctgtccttgaggctacactattggaaaccaccgcagctgctaggctgctgccctgccatccacaattctagtcctcaaactttggctgctgctgatgaagataatgttctccgtttccattgagattacgtgcctgttttcattgatttataaactcatattcttgtcattttcgtggccttctcaggccaaatgtatatatgcatgattattcttttttctcacctggtttaggagtccaaggctgaaaactttagcacctcttctgtcagcttcatgtattgcctttccaatcaagtcgttgatagctttattctccctttttaagtggtactacacaaacaaattagatgcacgttcttaggatatactactctttgtccctgcattctaattagcataatcatcattattatgaatgatcagatattaattcttacatggaaactgtatcttggtatggcccatgtctgcatgttgaggtttttatctaggacacttctgtcgacagcaaatggagaagaactgaacgcccaggtacacatggcgatgagccatgataggggtgacaagatggttatcatggaccagttactttgattgtatcctctagcagcaaacatggagaatccgggcctcagatgataaatggattggaggtcggtgagatgcgtgaggtgaaccacatccagggatttctccttactgatcttgagcatgctctcgtatagggtgctagatgatttatccatggtattgtagatataatcgtagaatggcatgtaaagggagtaatttgtgcggaactgcgtgtggtgaagagaatgaaacctagcagcggaagaccaaagttcaaattaagtagaaacgattttgtaatgtgcatgtaatgtaagtataaacaacagtttggaatatcgatagagatcaagaaggaacatgaggtacttacgaaggggtgtacataaggtacttgaggggagggaaacatttgaagagataattgggaaccaactcaaaattgcagtggcccaagttgttcatgaagtctatgtagaatatgtaaattgcatatgcaaggatggagatggttccagtcaacaagcatgtgaccactgggattgcaaaagtacatcataggccactaactctgcaaatggatggacgacagctgaataggaataacggaatgatcatattagtcattgataagctcaggttgagtaaccaaaccccaaagaattaaattgaagtgataggctcgtgtctaagagagcatgagagttttttttttctcgaatacgtatgagagttgcatatcattgcattaaagaagaagaagagaggtgtccaagacgcaaatacaaagaaccaaaaagcaaaacacaaaaagagagcaaaagaagaacaaagcacctcaacaaggttgtcccaacaacctaatttaacaagtcttgttaactaggatcaataatcaacgaaaacccttggctcgtctatgttagagtgtgagttgtgaagtagtttgtgtttggtttgtgacatttgtcaacaaagcaattacatcagcaaaagtgcatgtcacctcgtggttgcagtgacctaagtagcatcccaagaacttgagttcaaatcttcatagaagcgaatttcggattgggttgtttgaggggctaagttcctaattttaaacagccccactccggtgctttctactcggagtagaaagaaatctgggccattgatcgtatttaattgtagggctgagatctagttctactcccaccagtattagtggaagtagaaatgtgaaagggtgtttttgttaagggaaaaaaatcgcgtaggggtattatcgtattttttcagtctcttactcaccctatccctatccgattcctctcgcatcatcaccatttcaccacttcccgtcgccattcccctccatccctgcctccgtcgccgtccatctccctcgccgcctccgtcgcctgtcctggtgtctgctccccctccagcgccatcgccttctccgctccctcactgccctcgccgccttctcccccgccagcgcccctccatcgacgtccgcctccccgcctcccccgctatc

SEQ ID NO: 61009 - DNA, 3459 bp, Oryza sativa
cattattggaaataatgagatattatgattgggtgaaactgtcttggccatctaattggagtatttgggagaggtgtgtgcactgtgaagtcagcctgatcgtttgattcgtagttatctccagtcttgggcagcttaatctggctccaagttggcagcaagcagtccctgttctgaactgttagccgtacgaaatcaagattttgttctgaactgttaggcgtacgaaatcaagattttgtttgggatgggatcgttttcggcaatctcttcaactctgtatatcacgtcgctttttatttggttaagttagtgggatttggtcggattttaactctcacggtgaggaaaattggattttagtggagtatccttttcagccctgttcatattttgtttggaggaattgtcagttctgctcctcagctatcatgggagctttacatttaatcttgtgaattaactaatataagctaacaacattatttaagacatgcgtttttagaaatcggattgttttcttcgtagttggtttttaacaactaaatctggtccatacacgtttctttctttatttatgagtactttcgattgcaataataattaggcaggtggtttgcttgcacggcttgcactggtgttgtacttttcttacgttgttgtcagcaagtacttgcgtttcttctttcgcaatcttcttcgacttatttaggttggacaaattaatttccgtggcatttatactagtcactgttattcaatattcctaataatcgtggattgctgtaccttactccatgtaaatttgttagccactttttatctcgggatagagataaagatggtaaaagaccaagttgcccatactagtaaatcattgatctgtgttgaatatgctcttctatgttccacacagatttaagcagcacttgcgcatgcatgtatgcgaattcaaactacaaaagttaaaaatcctttactgtgtgtgcgtgtgcaccttacaataatcaataaagtgaaaaatcaaaacgcaccttacaactcttgtaaggagggagaaatgtacagcatatagttatgcaataaactacatattggttgtaagttcataaaattgcttttgcagtatcggattactaccagtttgatgatttgcttactgatgaagagaagacacttaggaagaaagtccgtggtattatggagagagaaattgcacccattatgacagaggtatgttgttgctatacatagttttcatttgttaatcccctgcttcttttttttttttgcaaaacatatatatggtatatcttctaggactagtacatttttttcttgtcgtcgctggatggtaactctcccttgggttgactagctgttgtgttacagtgacagttgcctgctcgatgtgtatcatgtcataactataaacccctatgggctttttacatatgcagtactgggagaaagcagaatttcccttccatgccattcccaaacttgcaactcttggcttggcaggagggacaacaaaggtatataaaatactaaatcatctagtacttatgttttacatttgactgtaaaatttcaccagtacgctcgttgtctcattgaaatttgatccttttccttgaatttatcttggcgttacagggatatggttgcccaggactctcacttacagctagtgctatttctgttgcagaagttgcacgggtggatgccagctgctccacatttattttagtacattcctctttggcaatgagcacaattggtaaagctataacttattcagatgattttgtttgaaatgtgttatagactgaccaagacaactattttctgagctcactatttttgtcctttcaattttctgtgcaaatagcactttgtggatcagaggctcaaaagcagaagtacttaccatcattaacgcagtttagaacaattggttgctgggtgagttgcattctcctatttatgtggttagcctttgtagcttttattatagtattcaacatgctgttttacatattgtcatcttaagaagaatgggtcttcttgctgtaggcattgacagagccagattatggaagtgatgcaagttcattaaggactgcagcgaccaaggtttgaaacatagatatcatgaaaattttaacttctaagtaaagaaaaatatctgaatgtttctgcacaaccttacaatgttgtcatgttggtttttaccttggtaggtgcctggcggttggcatttggatggccaaaagcgttggataggcaacggcacttttgcagatgtgctcatcatcttagctagaaattcagatacaaatcaactaaatgggtaatcatcttccgctggactattgttgatatcattttgtctaccactgtacacatgttaattcgaactcatttctatgcccatgaatgtgaccactcataattgatatggcaaacttcctctagatttattgtcaagaaaggagctcctggtttgaaatgtacaaaaattgaaaataaaattggactcagaatggttcagaatgccgacattgttctgaataaagtatttgtccctgacgaagatagattaactggaatcaattcatttcaagacataaacaaggtaacaaagacatctcttttgattgcgctaatcctactctgtgtcagtcaatttgaatacactgccatgtgcactaacctgatttttacttgctgaaactttaactaccggatcaggtccttgctatgtcgcgcattatggtggcatggcagccaattgggatatccatgggggtcttcgacatgtgtcatcggtgcgaatcaccttcttagttcagtctttactagtttcaaattggtaccacctaatatgtattgactttattatttaccattggataggtatttgaaagaaagaaagcaatttggagttccgttggcagcttttcagctcaaccaacaaaagcttgttcgcatgctagtaaacatccaagccatgcttcttgtcggctggcgcctgtgcaagctgtatgaatcaggcaaaatgacaccagtccatgctagtttaggcaaggtttgtacaaaatcacaatgcacttagaaaaatggcatccaccttatgattgtgcgctgttcggtttgatttacttttcgcttgctttcttcaacatctcactgataatacttgaatccaggcatggacatccaagaaggctagggaggtggtttctcttggccgtgagctactgggtggaaacggaattttggctgactttctggtagcaaaggtaaaatgattcagatttttttttcttttttggtaacataatctctttggacttctccaaatccaaacatgataggtttgattagaaagattaaagtaattcttaagattttccgacgggcacgtctttaccgcagtacgtacattgcata

SEQ ID NO: 61010 - DNA, 3362 bp, Oryza sativa
aaaaagaaagggttaattggatccatgccactgtaaatatgacaaatcagaaaaatatcattactattcatgaaatcgggtagatgctactccaatcttctaaaattaaaaccataccactccatcacgatttccgtcctctccgtcacatttttcgccgtctccctcttatcttcgtctcggtgcctgaggaggagggcatggcggcacgccgccctcaccggcgccgagctccatgagggagatgatagccgggcttcctctcttcgttgaggtggttgcgctgagagcagacaattagggcgatggcgcaaagcggctgaaacgcgcggtggcagcggagagagaaggaaatcgttgggagaagcggccagggcatggcgagctcgggctaaagttgggaaaggaagaggagacccatgaatttcgtttttgcaatcaatttaagaagaagagcaactgggaggtcgtattcgaacgggaggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctcttcttctccggcgccggtttgtccgtcgagacgaagacgaagacgacaagaagataacacggagacggctgaatgtgacgaaaaggacggaaattgtgatggagtggcatggttcttattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaacttactgtaataaaaaagaaaagaaaactactaaaactccagctgcagcctgcagaaacatgccgtgcccagagaggtgttctctccgtctcagacaacaagcaagcaactaatcaaagccgccggatcttccgattctatttcaacttgaaagagcaaaaacaatcaagttctccgggggattgcattcggtgtttgggctctaaccctttggtctgtgaaattgtgagtccatgggctatggcaatcttactcttggacttgaacaagacagacagctatgggctttgcggtaaggaaataaaagcccaacccaatagtctaacacggatacgatcttttggtttggaataagttcatcagaggtcccttaattttacgccgaatccgattttcgtcctcaaacccaaaaactacatacaactggtccctgaactattaaaaccggtgtaaatgaggtccctcgacgtttttgaaggttgttttagctgacgtggcgcctacatagctggtttgactaggtctacgtcctacgtggcattgacgtagcgcttacgtgacaattatatcatgaaaaaataataaaaaccatagccccacatgtcagctgcacacaaaaaaaattaaaaatagtggggcccacgtggccccacatgtcagcctcactcctcccttctctcttcttcatcctcactctctcttcttccctcttccccctatctctctctttctcttcttcccgagcagcggatgagcgggtgggcagcagagcaggcgagcgcggcgagcagtccaagctccggcggcggcggctcgacgtgcgccgcgtcggggctaagggagtcggcgacgggggaaggaggcaagcctcgaccggagagaggaggcctccggtggggtggtgggcgcctgttgacagaaaacacgaggcctgggagatctgcttaactccagtgcaggtccaaagctcgccttcggatgtatgagcgtgccagttgatttgatcctgcaatcaacaagagatagaacaaagaaaccgcaattaatcctataaatgatagccgatcggctagatgccgatgacatattatttatttcaagccgatgtcatgcgtacatcgatcggcaaatatcaataagcaattcagaactaaatctactcgatcaactgtagacattaatgatatataatccttatatcgggatatacttaaatcaagtgattgggatatatcggtcatcttgccgagacagtataaatcacttagatcgaaatatatattaatagtaggattatatacattaataacatagctgatcaggtagacctaacatgtatcgggtaatacttcgatacaactctatactaagatattaaag

SEQ ID NO: 61011 - DNA, 1683 bp, Oryza sativa
ctcatcatcgtccatggttacaccaagatcgctcaacttgtttgccaggccactgattttgccggcaaactcgtcgattgactcggtgtccttcatgtgcaatgccttgaaatcgctcttcaaggtttgcactcgcgcctttttcacacgctcaacgccaaggaacctcgtcttgaggctttcccagacctccttggcagtcttcttcttcgcgatctgctgcaacacgtcttcggggacggccccgaagagacacgcacgtgcctgcttgtccttcttaatgtccacggcctcatcggccgcgggctcgatggcatcccagatgccttgcgcctccatgttagcctccatcttgatcgcccaggtggagtagttggtggaggtgagcactggatatgggagcgacacgatgccctccctcatcgatcgcgatgcggagtgctcgacgatggccatcttgttgaagcgcaggatcttgggcataaattggctctgataccaattgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacatttacccccctaatcttggcatgcttcattcagagaagagttggctcctcatcacttgacgctgcggcaaggagcgctatctccttcttcttctttttctcagggcactcatacgcaaagtgtccaagttcttgacagtagtagcacattgtcttggacctgtccggcttcttgacgcggctgcggccaccgcttgtgtcgccggacgtgaaaagtagatgctcgccattcttgtcatcacgcttgcgtatcctttcctcgtatgccttgaggcgaccaattgcctcatcaaatggcatgctgtccaagtcagagaactgctcaattgcagcgatgacatgcagaaacttatctggcacagaatcgagtagtttcttgacttgctcatcatcgtccatggttacaccaagatcgctcaacttgtttgccaggccactgattttgccggcaaactcgtcgattgactcggtgtccttcatgtgcaatgccttgaaatcgctcttcaaggtttgcactcgcgccttcttcacacgctcaacgccaaggaacctcgtcttgaagcttttccaaaacttcctggcaagtcttcttcttcgcgatctgctgcaacacgtctt

SEQ ID NO: 61012 - DNA, 1983 bp, Oryza sativa
ttgagtttgagtttgagtccaggaaggaagaaactgtataccggtgatgaatcgtcgcgcaactggcggctggtggtggtacggggaggctttgcaattatcgggcgactttgagacttgagatcacgtatccacgtcgttcctgatgacctgatgattccagtactcgtgcgaaaaaattttcgttgggctgtgtaatttttccgatgttcaggtcattgagggttagtacaaggcactcgagaaaatactcaatatgtccttgtaccatcgccattcgccggttcaccaatcaccatggccgttggacttgatgagagagtcagacgcgtctgcgactcttcggcggcgagacgtggcgggctgtgggggaggaggggcaccaggctcgatgggcctcactgaatctaatgacacataagtgccacgttagcactacgtggtacaacgataaaatcaatatcgtcacgtaggtgctacgtcagcgaaaccatcctccaataccgttgagggagtcaaattgcatcggttctaaagagaagaatcagattccatcactcgaagggagtcaaagtgaacttattccgcgatctgcgaccacattggtttcacatggtagccatctgggccatgcaggacaagggtggcgttgcatccggccggcccacgtggcccgttatagctttttgtctgcccgctgagcttttcgggctggcccatacagcccatgccttctttttttttttaactcccgcatgccttcttttttttgttactatcaaactgtctgtttgtctctgtcaactgttaaccatgagaaatgaaaatgatacacgcacaaaaaaaaaattctgacaaactctttacaaaaactgatttggaaaagtgttatcaactgatcataagaaaaaaaacatacaggtagtacttcctacaaaaaaaaaatacaggtactcaaacgatacgttcctcttggtgtcatgctctttgaagatttctgaaagataagcgttgaaaaagcattggttaaaccttttctttctctgtgaagaagaagcagtccgtgtgcagactttgcagatatggctgtttaaaaataggtgatgggagagaaacggcaagaggttggatgtgtcaccaggtgtcaactatggcctcacagttgcaaccatttgacaaggtctgtctgagaacatgagggccttctattgcccggctttctctgatggcgttgtcttgtatccccttctatctaccaaacgccattcttggccgtttcaagcttagaaaaaggtatcaatcttctctcctcctcttagtttgaagacatggaaagctttcgtgtgttcatgtgttcatggttgatggcggtcaagcggcgatgaattgatatcactgggttctaggtatgctgtctgttcgtccatgtcctttcctcaagaaattcgcttgcctttgtgttcgtgaaaactcttgttgctgtaatgatcaattaaaagacgatcatgatatatctgcagaaacatgaactaattaagtgattttggtttatatcttgagtactactattagttttatcctttacatgccatccaattatcaaacaaacagagaaacatcccaagtcccaaccttattgttcttgtataaacaaaaagttctaggagtaggagtgcaaaggtattgacaggtgaaaaagttttgcagcataaatagtaatcaacaaggccaaaaaaaaaagataataaaaaggtggaatcaaattagaaagccaatggctccagaacgtgcaaggagtgttttgtcaggtcaaacaattacaaaatcctgaatatgcccaggaaactggttcacaaaaagaaggcataaacatgcagtttaacctttgcatgtctagctagggacattaaatcagtggtgaacatgttgccaaagtgccaaacaacatctaaatcttcgagggcaaccacagaagatcaaaac

SEQ ID NO: 61013 - DNA, 10248 bp, Oryza sativa
cgatatatgcaaaatctacccaaattgaagctcgaattttgaccatgcgcatatggatgactaattaattctcggcattaagaggttagctagctagctaacctggagacttcctcctagagggggcctttgaggacggcttcccgaaaggcgacgtccatctccgaccggatcttgagcagcgccagcgtctcctgccgtggccaccggttgcctgcccgcgacccgctccggtcgccctcctcgccacccagcagcccgttgtgctccagtagctcccgttgagctgctcctttgccgtcgcctactccggcgacgagcggctgctgatcggcgacggcgccccccactccgcctggctgcttcgctcgcctcctgcaccgccaccggctgcacgcggtcgatgagcacggagaggagcagcgacatgttctgcttcaacgtgcggagcgccgggcggatgcgggcgtcggcgacgccgccgacgtagagcccgtcgtagaacgagtggtgcgagttgagaagatgaggcggtacgcggcgacctcggcgacgtgtccgaccgcggagctcgcgatcacgcaggaggagctccccgccggcctcctccccacccgccggcggcctgcagagacaagattgagagagagagaggaggaggaagggagagaagatggtaaataaagggtgatgacgtggcacgctgatatgtggggtccacgtgagtcccatgctgactcaactgccacgtagattaaaaccaccgaataacctcgggtgatcggttttgtatagttaagggatcccgcatatttggttttgcggttcgagaatattttttatcccgatgataagttcagggatcttcggtgcactttttccactagacccttaaatgtaatctaattctaccgattcaggccagccctaaagtgaaaaccattttagcagttttgatatattgatagcttgttttatttagccagctaagattgtaagccaactacactattaatagattacgtcacctattatttatttcgtttggttacaaataaaatatccgttatgaacaaggttcaatccaaacccagatattaatacctgatgagaaaaaattgtagcagtcgataaaatagctagctagcatgcggggcgaaactagggaggggcggagggaggcctggtctcccacaaagttgcattcttgcttagcatctgctaatcgattatctaattacatgattagttagtttaagcatttttcgtttaagcttccctttattcttgacgattactgcatcctctatatcctgagctatgatcagtagaagattttacatgctagcacgttagatcaagcctacaacaagctaacacgtgcaagaaatctttaatactgatgcatgtagctaattatataccgtatgcacataaatataattttgtatggtctaaatataattatatgatttcctatccatgtaaaaaatataatacttgaaatttacatgtattgtgattattttttaatagattattgtcatttgatacatcttgtaattcgtttatcagatatatatggctaattaaaggtttcggcaaccaatgttgggttatattagcattggaagttttctttggtagttattgttgggagcttggtgctgaccaagtaaaacaacactaacatgttagactaactgaggggctggttgacagtaccatactacccattaattatagcctcctccaatatatcggtgccaacaaatcatccagtctagctagcaacgtaatcaacagtgatcatctcatgtgtgtagtgttagctctaccataaccatgtaaatcgacaatgattggcctatgtaaagtacgtcagttaacaagtcaaagcttaagcgagtcagaatggtgagccaagcctatttctccattcagctttctagcacgacttggcttgatcttagttagtcttgtgagctcagctctagtacatgataacgtatactttaacaatagttttataaaaatatttttaacaataattttattaatttttttaagttaatcatattaaataaaaaggtgaggagtatttaacattagggataattgcaaatataccactacatttcacacttaatttgaaatagccattaaaaacatgaattgtaaatttgccactgaaattgatccaccgtgcttctacgtgccattgccatctaaactggtgcaattaagaggcaaaaaataatacataaaactagattgaaaatgacataattaattttcccatcttcatttaaaaaaaaatcttcttccaacttacatagagtgccactactaatttattctttttttcttggcactttataaatataggacatgaatttgtgtttcgcatagggtctcgaattcttagggatggctatgatgtcaatgttaaagcagatttacaaagtttacagtgtcaataccacatataaatcttagcaaatttactatatccatgttataggaaaattactatgccaatgtagtaggaaattgaagatttttgttattcaaatgtactatgccttgcttttgttctctaactcctcagctagtagctaggtgaggtgggaggaccagatagtaaagaggagaagaacgaaggattaaaaccaaaagaatgaaagacttttttatagggacatgaaagaacctttctgcaatagatgtttctcgatgggaactttatgatattttgtgtagataatataacggctaaaattttgaaatactagatcgaacggtctaggttttgccatcaacgtggatgcatgttagaaaaggatcctcctttcatttaggggatgcgccatatctatagaggatcaggttgatggtaactcatattcgaaaaatgtgtgggacaggaggatggctaggagtgcctattcaacctcaataaagatagaacatttcaggactgtaactttgcaagtgcatcagtaagaaaaagatcgtcctaccctttgatcaaaggcagagtttattaactaaaagatacgcatgtatcatatggttggcatgcaccaaaacttttggttgaagcatcacacttcagctttttgcaaataaagggtggttggcaatcgaaggttctctctctgtctgctttgttcttgtgttgtaaactgaagggtctcctgtttgttcacatgcggattaattagctggctgagcttaccctacatgtctaattaattatggaatatttctccttgaaaaataattgagttcataatcgagcctggacacgccaacccactttgcccccacacatctgatttatcctatataataatttataatactggcaacttgtatattctctagaaaaaagttcttaaatatatttgtcaataaatattactgagtaattggctctgttgagaaaaacacatgtagatcatttttatattttctctggcagttactaatttttataggattatgcaaaatatttgcacatcactacatttctctactattataaaagtggagtcatcctccttccatatttcactgcatgcagcgccgtttaacatgtctaaccactggatttaatattttatctttaattattatcatgattgacggagctcgtggctcctcaccgggagaccgcgcaggcccccctttgccagttcggccgggggcttagggtgaaatctcaagctctctctctctctgtatgtggaaagatcgtccgtcagcaagaaacacgagacaccggcgatctatacaggttcgggccgctgagaagcgtaataccctactcctgtgttttggtggatctgtgtatgaatgagctacaagtgtgagctgacttctcccccgttctaagctctcaatctggaaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagaccggtcacaaatcggtcattcttgtccaccgcgtgtaatcttggcaacgtgcatgtttgcccttcttcacacaacatcttgcttgtaatggttaggatgaagcctggcatatatcgatcggggctagcgtgtcatctctgggatgtaacacgctagctccagccggggacgagtgcctagaagctctcgtcttgacaggatggggcgaagcgtgcgtctgaccgcctgtcgccacctaacccgtgatctgaccggtctgtgactggtcacagaccggataaaggaacgcgccgtactgcgctgcatgcagcgtgacacgcctgaccagactgcattaaatgctgttaggtgagcacagctgtgctcacttatcccatatatgtggcgcagacttccttaagggggtcggggtgccccggccctcggggccggggcaagcgcaacccgaccccccctcggggggaatcaggaggagggcggacacctcaccctcgggcccgacgtccccgaaggtgccaggccccgtgggcgattgtgtctgcctcaagcctctagtcatgatattcccggtcccatatcaccgacagtagcccccggcgttatgccagagcaatttcccttcccaagggaagcggtcaggtgtgacgccactcctaaagcctggtgacaggtgggaccggtctccgtagttgggcaaaatacccaacggtctcaatccatgcacatcggtattgataactttggttgtccataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggtaccagattacccggggcggtccatcttcttcctccccttcgcaatggctgggctggtcccgccattttctcatttcttcatggatgtcctggagttctacgatctccagatggcgcacctcacccccaatgcggtgatgacattgcccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagcgccgccggggggaacaacctgccccaggagggggtcgtgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggctttgccaaccagggtacgcgaggcggaatgggctccgcactcgccctcatggatatcagcaagaagctcaacgccttgtttctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtacgtttggatctcagagatccaagcaatcaatctaagggagctaggaacgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgaggggtccgtgctagcctcgggtattgaggcggtctctggagccggggtccactctgccacgaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccataagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccatcttctgcgccgatgacctcggggtcggaagacgacaggagcggccttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggccataggtgcggcctccccgcagtggcctcggggccttcctgagggtcgggggcgcccagcaccgtctgacgagcggggagagggccgactccggtcatcaggggccttaggccaccgttcggctcgggggcctctcctccctgcctgctcccgggccaagtcggcacagagtgggggtgcgcagaatgaggattgtcctcatcgcgctccacaaccaacgctgcactaactacttggggggtcgctgctaaataaagtagcaggggctcatttggctccggggcgactagaaccgggggagagctgagatatgcctttaactaagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacgtccctaagtttgctgggggggcggatccgctctatagctcgtatcttctcggggttggcctcaatgcctcgggcagagaccaaaaacccgagaagtttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattttttaacccgaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgcggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccataaacttcaccaacgcgggtctccccaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgtagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgctggggatcctctagagtcgacctgcaggca

SEQ ID NO: 61014 - DNA, 7164 bp, Oryza sativa
cgccgtcgcggttcacccctcctcatcaaccgccgcccccttctccaccatgccggtaccgctggtgtccacctgcatccgccgctcacgtcgttttcctccgcgccactagcaatcccgcgttgatctcctccaagtctccctctagcaacctcctccttggctagtggtaagtaaacgagtcaaaatttcttactgttatgattttgcagataaaggttgtctgttcttcaatccattgcattgtattttgattatttgattgaatggttgggagcagggtcagtttgcaagatggtggcatgcgcgaaggggatccgcatgccggcgaaggggttatcggtgttcaggtgcgacgttgaagtagatgcacgtcggtgacgtcgacagcttactgcattgagtcaccccgaagcgtaaggtttcatataccgctccttctcaaatggattcaaatatgaactataaatattatctcaaaaaggcatcaatgtttgggatccgtcaaatactcaagtagtatctaaatgatttaataaggggaagagagcatagtaaggtaattgtggtaaatgttcgacagataatccatttatgtcgtggttggtagtagtggacgatctttaatcttgctcagttcggagttgatcaaaattccggctaagtcctgtcgaaatgttttcacatccttctgcataatgtaaagggagtgcattttaaatcgtttttcgaaatgggaagcactggtgcaaaatatgaatagaggtcgttgtagttgcctgtatttgaattcctgggagataagattcgctccaatgctccatgaacttaagggtgtacaggccacacgagacgctacaagaatttagtcgttaggctaacacgtttccgtaattgaataatgtgaatatcatgtggaagagtttgagtcacccacccatctccttgctttggcaatttttggactttgttgtattcccattcggtaatattgaaaccaggccaatcatgttttaactgtgggtgttgattctctgtcccgtgtaatcccctctcgatagctagcagctgggaagttttgtgcaacgttggtacggtaaaaacatagcaaaaccgatttgaattatacaagtggaagtgtatcgcttaccacacgccttagatcgggtcgatctttactgattggctttgcgagcgaatatagtatttgcacctcacgtcgcttggcgttaagaacggctaggtaccagtgtgtatctttaatattaattaggaggaaaatctgcagatgttcaacagtaagatagagtcataaattgaattagccattacatagatagcttaaataagtattaccatgtcaaatgctagatagtcgcgtgccatatctctaatccatcgtttatctcgaggtttgcttgcttcgacatgcgctccctctacatttagtagacctgttttaatggccatctctaggaaggccttgccatctcccctgattcctttctcattatagcggaggcattggatgtatgcattcatgacctgaatttgaggttagttgagttacataacaaatataattataaaagaatagtaggcttgttaaataggcgaacttacatcatcatttaagaattctggttgtgttagtacattcattcttatccgtttaacctccacttcttcaatatgcaccatcactttgttatcctccgtattattaatgtaggtaatgaaagggtcttttttttagtcaactctacgaaggtaggacaaattagtaatagatctgtagaaatgttaaatggttaggcattaccttctgaattttttaatggtgtctggccattcatttttttcttcttttgacctcgtaaggcgttctttggtgggcctttgtctatgattttttggtaagatcttccttctcgatgtacactagaaaagggtaagtcaaatcagtaacacacaaacatagaatataagtaaaaaattatggatgatgtagagagttcatacattcagatatttcattcggtgtttggttgttttgtttcctcttcttttcaccccgtaattcgtctgtgtctggcatgttagcttctttatccgtttgcgcttgaaaaggaggaaagttagtaccattgacatgagcatatgtaactattaaatagcataatacctattgttttctttgtctgtgcttgggttctgattatgtccttctttttaccccttgtttcgtagatgaagtcagtccgattagtcagtttgtatgttcttcctgtaggacctgtaagcctcttcctgctttgattgctctggttactgttgtcctgttaggtaacaaagtgcacgttagtattatgataagttgtagaaacgttagcgagagaattaaaattcagtttaccttcgtttcacaagtcatgtttacattttggtttatataggactcttcgttatgatttgatacatgctacctgggatcaatttgttcttgttcaacatcctacaatagcgtcaacctttttttagcggtgttacgtaagtaataatgattaatagtctagcttatcatctttacctcaaacacatgcgtagtatcttttcgttctaggcattttgaatcattttccatgcaatctagtatcaatgatcgcatacgtggccaaaaatcctttgtgaaatcgttgaaattatcttgtaaagtttggatactttcttgtaaagtgatatcggctgattgttcagtggatgttgtagagtgtacttgaatagcacaagtgagaaaaggatgtcaaacatattttgttaaatagagttcgtattaaaaccccataatatatacctcttcaaaagtgcatagaaaatcttcattggtacgtgcttcgagtatatcgctccaatatttccgtttttccgttttttatagatatattcttgcacggttcaaaatgacagtagagtatatcgttccgctatttttccatttttccgttttttgtttacagataaaaggatggacaggtaccgatctcatttacattcttcataatctcctttctccccaatctcatcttcctccgtgtgcatctcttacttcgtcaacctcatcttcctccgtgattgcaatatgtctggttcctcggtatatcccgaagcagattccgccgttcaggtatatcccgaagcagaggtgagtgcatgttcatgtatacacttgtgagttctgagacgtataatagacttattaatcttcgattactagttgccagcaatggtctatgagtacttcggttactgcacatcttatgctgcctagatgttatcctttttcttttccctatgaatagatctactctctttgcattgcgtgtactgtatcttagattcattggttgggtccaacgcactttccctggcctttatttagctcggatcctgtttacattgttttcaagcaatcaatcaccaaattaaaacagatctgtaaaccctgattacatatgcgatcgacttttggtcctagtcatctggctgtcacttaattgtttacgatttggggataattttcttttctaattcattagcgatgagagcgccgtacattgttgagagactatcattaccatttgttgcactggcaatttgctcaagtatatcgacatattatgttatttcttatttaacctagtgcttaatttgttactgtattttttgctgtcttctgttttttctcttaagtatcaactgactcaaaaacttgcatgaataacctaaactttgaccacaattttcttaaccattagtccacacaaaatgtttgttgtgaaactaatttgccatttgtccacgtttgacttttgtaacaaaattttggagtattttaagtttttattttattttttcttttaggaataagctagattatagtatgttgtttcgtattagtaaaacttattattaagtcgcagaattcaacagccaccgaaacaacatcatcactacgacatataatccgtcaaaatcggtcgatgtcatgtgttactagtcaagtttgttaattggcacaatggtttatatgatgatgaactaagccgttgattttttttccttcttaaatgcagcttgatgatttaacatgtggcgatgaaaatatgttagccatgtctaatgttctaaagaacaaaaaatctgcaaggctcaaaaaccttgtgttggctagaaattcattttccataactgtatacaacataaatactttgtcaaatcttgtttatgttggaagggtacaaataactgtggatggtgatggccgtcatattgtatgtaagtgtgtcattacttgttttctatttctgttgctacaaatctgtgtactctataccttaacttgatgctattatatttgttggtatagacccaaggaatgcaccaacggcagaagacatagctagtggaaaggtaaaaaacatccattttataatgaggacggattttagggactggcaggtatgtagtcatttttatataatattgttaatggtctcctcttcgatttggttgtccatattttaattcaatatgttttaatcttgtttcacatttgtgggtagatgatgaaagatgtggttgtggatggcgaagagctaatgcacaaccctcagctcaccacacatggcaccaatgccagcaatacgtcacaggatgaggaggcggcggccaccaccacgtgtgagaaaatggagatgcgggaggctcaccacaagttgaaccgtagtctcttccaagacgatgacaaataattacattcactttttttttacgagaaacagcatgagaggctcctactgtgatatattaagaaatataaggagtttatatacatcaagggaaaaataaaaaaagtaaaaattaaaataaaaataattacaaaggaactaataacaagagtctagccatgattgaaatgggggtctgtcttcttccttcactctttgcataagaagagtggaattttccttaaaggcaaatttccaacattgagagatattgcaatattgtcaaaaatgtgagcatttcgtgatgaccatatctgccagcacaccgtgcctattacctcaacaaagaatggccggttcaatgcatgataggctgactgaatcatttgcagaaattccaaatcctcatcccagttgatacctaggagattccagcatgacttggcaaaaggacaagagaaaaacaagtgtaccatatcttccacaacccctgaagtgcacatcctacatgaggggccatcttggacatgcaattgcctcctttgcagcatatctcgagtgtttaatcgatccataaaaaggagccagagaaatgctttaactttcattgtacacttacttttccatatcgaggtgattgctggatgaggggagaggtgggcaaaaaacaaatcatagaccttcgttgtcttgaaagttgcccctcaggagtaagaccaaatgtctagatgatcagtgagattgatattttccaaaaggcgtgaaagttcagtgaattgctgtaacgcttgagaggatagtggcaaattgaaattttgtcacatcattctgaacataattttgtactgtgatatcctcattgatagcaaaggagaataatgttgggaaagcattttgatgtaggtcttctgtccatgggtctttccaaaagagaaccgaatctcctgtgtttatctgaattttactaacccctctgaagattggtattaaacgaaagatatccttccaccaaaatgatcctctttcctgcagggcatgcggtggcaccgagttgttactatagtatgtattccaaatgagcttcacccagggcagatccctcttattgtagaatttatccagatgtttcattagtaatgcacagttttggaactccagatttatgatacccattccccctcttttttttggtttacaaactttgtcccaggctgctagggacagagatctagcatcaacttcactggacttcctccaaagacaatgccttcttgctctgtcaatgtgctcaattacttttttttgggattttgagagtgcacatgtagtaagttggaagggaggaaagtacagagtttaccaaagttagcctctgcccttggttcagaaacattgttatcgctgggagcctcctttccactctgtctataaggggcgcaaagtctgcaattttaggcttagttgttccaacaggcagtcccagataagtgaagggtaagtttccaatttggcatccaaaagtttcagccaggatctttgaattttcttcagatacgttgatcggaatcatacatgatttgtgataatttatttttagtccagttgatgaagcaaaagactgaaggatgccctttaagcagaaaatctccttttgactggctttcatgataataagagtgtcatctgcatattgaattattgggaacttagtatcaggttggggaataggcagggagaggatgcctatttcgggagctttgtttatcattgattgcaacaggtcagcaaccaaaacaaagagaaggggagagattgggtctccttgtttgacacctcgaaggcatttgaaagtctttcctggcactccattgagaaggacagaagttgtggaagtggttaggatatctttaacccaatttatccaagtgttagtgaaacccttggctttcagtactgtaagaatggctgagtgttctacagagtcaaaagctttctcaaaatcaatcttaaggataagagtttctctttcgctttgataacattgatggatatattcaaaggcccatgccagacagccttggattgttctttgcttgataaagccatattggttttcatggatgagatcgaggatgactgcttgtagcctttctgccataattttggttagaaatttcgtgctagagctctggagtgagattggtctgtaatcatctacagattcaggtgatggttctttggaacaaggcagataaatgagctattcaggttctggatagaaattttctgtccaaagaaatcatgggcaagtttacagtaatcttcagagatgatagaccagccttttttcatgaataagccattgaacccatctagc

SEQ ID NO: 61015 - DNA, 26072 bp, Oryza sativa
tctgttggcattgttcttatcactttgtcaatttcttcttttgaaggcattgttgacaggtctgataagtgattagaaggatgatagaggtcttgcagattgattatcatttgataaccatttgaggttcccattctggcttgaaaacagcttagaatgccagggccttctcctggtgagaggtgacaatgttaccatcatttagtgttaaatgagaaaacttgttctgtctgaacctttgcgttgccgcagcatggaaaaatttggtgttgtcatctccaaatttaacgcacagaattgtgcaccttttcttccaaaagatatttctgaagtgcagaagtttgagcacatgttttttagcaatagtcctgaaattccattcttggatgaacagtggcctgacctcttcaattttatccaacatatcaattgcttcattggagttttggattaattgatttaaatttgacaaccttttactccaacgtttgaggcctcttcggacatttttcaatttcccattaataactatcccttgattagttgctctgactgggatatcccaaaaaatcttgacaacctccatgaaaccagtcatatcaacccaatagttctcgaatctgaagatgattgactttggtatagaggtttcaattgaaataacacatggtgcatggtcagagacacatttgttcagagcagtgaccattgtgttgggataatgagttgtccaggagggcgaagtgaagaaccaatcaagctgttgaaggagaggctgactttgcatattactccatgtgtaggttctgcccttgagaggtaattcttgcagtccaatgttactgatggcctcattaaaaatcatgatatcattcatatcgccaccaggcaagtttctattttgcattgatcgaatgaagttgaaatctcccatgagcagccagttttcatcaggttggataactatgccatttagccagtcaacaaaatcatctcgtaaatctcctgaacacggcccgtaaatatttgaggaaccaaatttcattgcttgatgctgtggcagtgaaatgcatagtgattgcatatgggaggctgctaattaaagtgccagtaaataggtgactgttccaaattacaatgagccctcccgaagctcctagagaaggatggtagcaaaatttatcaaaccttttaggggcaaacttccttatatacgagtgatcaaaatgctcccttttttttcttgtaaacagataattgcacaaccactttcttcaatcttttgatgaatagccagccatttctgatctgagtttatcccccgaacattccaacacaggatattgcaatttctatttcgtgaggttgtattcatttgggcaaacaaatttatttaggaagcagggaagtaacacatgtacttcataagaaactaaccataaagatatgatgtttttcatggagctgccagtcatcactcagaaccataaagagaatctaccctgtgacaaagaaatagtcttggcccaataaaacacaaaagacccataaagttgaggataacaaccctgataaggaccagggcaagaaggctaagcatagccaaaacagaatttaaactaatcattcttgcgctggaggagcttgtcttcagccacttcctcaggaagcatgccacatttctccacgcctattttttgcagctgggccactgggatggctggtggaagatggttggacctgtcctccttgctgggcttgaaagctggcaccatcggcttcaccttggacttctttttagggacatcacaagttagatcaagtttctcccccttgtttgcaaaccttgggcttcttctcagaccctcaacagagagctgggcctgtttcttctgcttcctcactctcacaggcagggaaattatttctgtcgaggcagagctgtagggaagagctcttgcgacatttttttccagcaatagagattctttgacgcttagcaggactttgaatgcaccaagggagcacatagggaatgacaacccagttgatcttgacggtgttccatggaatcgtttgggtgatgcattggaacatagtggggttcacagccaacagaaggagtctgaatactccaaatgcaactgcataacagaacttttcagggaacctgaaaaaaggcagttcagggattggcaagctgtatgggactatctgaccagatggctgcttgatgatctgaacagaggatgaagattcaatcattgagtaatcattgaaagagagggacagctgtggttcaacttcatccagttgattctgattatcctgatccatgtcatcaattccaccattttcaccatcaccttcagggttggcttgttggagttgtaggtccagttgtaactgttgtatctggtcttgttggtcttggataacttcccaaatggctggggcatcttcatctccaggcagcatatcaacaaaattgcctgtaaacacatacgggtagaaagtccaggattcccctacacctccaagctctgcagtgtgccccatcacaattttttcaggcacttcatgagggacagtatatctaactttgacaagaaccctacccaagatcctgtccgtggaatgccagcgcataagctttccaaacttattcacaatttgctcaataatggaataggttcttagcctcaaaggaatacccaaaatgatgacccatccttctctattgtatggtctgtttcttctgttagcaagttgatcatgtgggataaaattggcttgcgcgaggttttgttgcatgatcggaccctcatcaaccatagcatctctgtgaaagacagactgaaattgaactatacaaagggccagggggtagcgttgcgccctaatgaccgaatgtgacagaaatgagtgacaaagtgaatgatctcattgatagtctggttcactaagtgctcaggaggttggggctcaatcagaacaacagcaaactcttctccaaggttctgagggatggactgaacagtgaaatctgaccttggtattctggcaatccatggggcttccacattggcgccaggaggaagaaagagctccggccgaagctcagcatcagtatggttcgccatgttctccgcccaggcaatgggagagaccaacaatggggtggtgggttttgggggaggaggattactgggaggaagcatgatggaagggcgaaaagacgggggagacgaggggtcctttccgagcaaagcaagattagtttccttgtcagagccctctcccagacgcaaatcacgaagcttctctcgccaatgggctttccgctttacttttttggcccaacaaaaccgactaaggtgcccatagttgtaacaggcccaacatcttatttgatttttacaagccgagactaaatgatcaggaaagagacagcgggagcagatacccggatttgttccctgcaatcactgcaatcctgcataagccgtctccgaagaaatctaagatgtgagcttcacattgggaggatattttttcaaaaagttacgagatgttcatttgtcaatgagatgttttatttttaatattctaagttagtttgctcggatgttcatttggaataagctagttgataaatatttattaaatgatactctatttggatatttattaaatggaactctatttggttattcacgtgtgagatgcctttggttcagtgcacaaatattgcacctttggttcagtgcgattcttctttcagtccagcagggttgcattcattcccgaacctgaaatatgaagatttccgttcaaaaattggctccaacagagtccctagcgaagtatgtggtgatgtatttcctatagggtatacaatatatataatttttatccagaaaatatataaacgtgttcaagtaaaacaactggaataggatcctaatttcatcatccaggaccaaatttcagaaaccaagcagcaagcagtcaagttaggacacaggaggtagttcaattgtgtaattttctgaaaatggattaaatcgatctcttctgtatttctgtaatgtttctgaaaaagacatcttttatagttctaaagcatttcagcttatttgcctctgtacacatctaaaataaattaagtgcctcagtttcagagtgtaatgcatatgcagagatggccatattcaggaagacaggtttgatctgctataaaagagtatccatctcacatattcataatcaagctataaaagattatccatctcacagattcataatcctcaaaaagggttacttatgcactgattcagggttttatgctcttccatacagtgtgacagtgtgtgtacgtataatttggaaaaacaaagtgcaggtttcaggatgaatgcccaaatactgaagaccaaacatgtggttttgcaggattcagtttcccttaagtgaaatgtgtctcactaattaaccaggtgcttaacattcatacgtgcctcctgaataccagatcaaactcaagatagtaccctctgttatttgcatataaagatggaccgaggaggaagagaaggatatgctttctcctgcatggagggagaaggacgtaaatgtcatgcatagtttcatgtgtaaatgaagccacaataaatggagccgaaaatcacctttcagcctttggcactgttcaagacaaatcccacatgtgggcatcatggatatcaaaaaatgcctgcatgaacaaacaattttatcagtaaggttatttcgattttttgtcattaacgtgacaaactgagaccctgtttagatgggactaaaacttttaagtccctatcacatcggatatttggacactaattataaatattaaatgtagactattaataaaacccatccataatcttggactaattcgtgagacgaatctattgagcctaattaatccatgattagcctatgtgatgctacagtaaacattctctaattatggattaattaggcttaaaaaaattgtctcgtgaattagctttcatttatgtaattagttttgtaagtagtctatatttaatactctaaattagtgtctaaatacagggactaaagttaagtccctggatccaaacaccacctgaagagatgctgcaatatgtacatgtactatgaatgttacacacggtatgaaagacacaaatacatccaccatgaaaaaatagcgtaataactctgaacaaaactcagcaccaaaataaacttccattttatcaagtgggagtactctctcgacttccagggatttctatgagaagacaaaattgcaacctctgaaccaggaacagtaatatatgattcaacacaaattgtataagaaagtttagtagacaactttcctaatccaaacgcatgcaccagggaaaatacttaatatgcgcatcttgagaaaagattaaattaatccaataaaaaacaatgccattaatacaaaagatacaaagtttgtgaggcacaataaccttattggttttttgtgtgcaatgtctcacggaatggccttcgtctctttgatggagctccttttgccctaatctcatcaggatcacagaccctcttctctaatggctagttactagatgaaaagtgagttggcataggagcaaaatctccagccacgatgttctcatgggatgacgatcctttatccaaaatcccatttaagaaatccatcgctttttctgtctgctcagggttcctagcatcactacccagatttcggaggctacgaaaacgaaccatgtgttcagaccacacattaggatcggtattcctgtctgacctaaatgccgccattgctcccattgtccacctatccacgacacaacaacgagggatggtgtcaaaaccaaggaacttgagtacaacaaatatgtgtgagcaagggatgtcttcgcactccatcttccggcagtgacattccacaccttccaacgcctggcctttaaaagtaaccctcacttcatcccacacctcattatcgtccttcaaaccaacaacatacagtgacgaaccatcttgattagtcccacttatgacttcgagtccagcaattagccatatctgtgcacggactttcttgaacacgattgttgtgaatatacgggcagtgtctttctccaatgggtcggcgtctattctacaaaaagggatcgaattggtacacttagcgtccaactgagcctccttcttacgcagacgttgtatgcacaacttaacatgtttgactaagcacattagtgacatatttctcttcagaagggtgtgaagctgtgagttcagtgactcactatgttggttgctgcgcatacccaacaagtatttcacatctgtataggtagcagcccacttctccctaagtcggtacatcagagcgatccattgtccatttcccgtgcctccattctccttaaaatcagcccaacgtctctcgaactcctcctcatccatactctcataaattaattttcttagctcatcgagttttggcttacgaaggtgacgactcatattctcctctatatgccaagtacacaatctatggtaagcacccggcattaccttactgatagcctttgccattgctaggtcgccatcggtaattaatgattttggatgcacttgacgtattgcctccaaaaaagtctcaaggagctaacagtaagagttgacagactcattggatagaattccgcacccaaaaattgttgtacttatatggtggttaactcctatgaaaggaatggaaggaagattgtacttgtttacccggtaagtgctatcgaaaataacaacaccaccaaaagcagcatagtctaaacgagattcaacatctgcccaaaacacattcctaagacgcccttcctcatctgtggtgtatttgaagaaaaattctggatcttcttcttgcttccttgttagatatttcaacacatcttcagcatcacgacccttgatattcttcatctcgtaccgagtaaagaaattataaaggtccttcatcacaaaactaacctcttccgactcatcgtggttattctccataacctccatgattgaaagggcgtaaggccactcatgcgaagctcgatcgcttgggctttcttagaatcagtcatcacacgatgaactcctaaaaaagcatcatggtcaggatttgcaagttcgagcgtatgttggttatcaaactccttaacaaaccacatccccttctgctcgttccgctcaatctcaagcttagctaagcaaccacagcgggtcagtgcccgtggctcccttttccactctgtcctctcaaagtgcttcaactccctgtactctttacatgagcatacgaattgcctccatataatctcaccgtccttccgcttcaagttgtttttcctcacactgaaacccttaccctttgcatagtctaaatagaatttgtaactttcctcctcgctttaaaaaaccacagtacccatcattttatactcttcctgatcctctaggctcacatagctcgaagtcattatgtcagacctcacctacggaaaagtaaaaaaaacaaacagaacaagcacccaaatataaccttacgtcctttatacctcataagaataaaaaaaaagaacaaccgtcgcctgcataaatacattgccaatccaaagaaaacacgggaaattcacattaggcaattcagttactgtaggactgcatataatatctgaggttcataacagggcagagtaaggatgctgattctataaataatctaaatgattacaagcttacttgcatccagcgcttggcactcaacatctaagtctccaaggtaaaatgggtccacctagtactgtaatacaatccttttaagtctgcacttttggggaaaaacatttgtttgggaaaagacaaatcatgattgtttaatttatttttcactattgttttgtgggagtgggtgggtagttcacaatttcatctatccagttcaatcagtgcaccttcacattcagaattcaaatgggtttgagaaagttctacaaatatgtcttaataaattcacagataaaagaaaacatcttttacaaaaactgcaagaaataatttcatcgcaagtgtacttctgaaatacatgaatttctcaagtgatttaaagtgcattgtgttgccaaaaaaatatattagctaaaacaaaattaaaccaagacatgacacattaattgtcaccttgttttcttgtgcagaacaaaaaccaaattccacttttgttgggacctaactacacaaactgttggtacatagaaagcttgcccaaaattaaagattgaccagtggaagtaatagatgaagaagagtacctcactaaacacaggatgacaggaacgtgtgacttcttcccagcatcgtcaagcagcacctgtagtgatcaacccctgcaaggcatggagcaaaattgaatcacacctgtagtgatcaacacatgcactaataaattaatacaatgcactactactagtactgatgaactagctggaaatgctggatgcattaaccagttgacaaggcaagcatttgggagaaaagatcaaagatcaattgcacaagatatgatttaacttgccacctttgctgaggtttaatgctagacttatcagtaacacatcaattgctgcaaactgttttgagtggaatttgaagtgacaggtgtatttcatttgcagctcgagaccaaaattattgttcagttttctttcaaaaaaatattgttgttcagtttcatcgtttatgcttacaactcaacatacaaaatcgattaaatatatctcctattcaatttaacatcagctagtgtagattctctagtatagttatccatttacaagcaagttgatgcatttatagaggaaaaattcagacaagttcaccactgagtagaggaaggggaacagaaagtcaggatgggggtgggatgggaggagtggatacctgatgatttcgccgcgcccagctgctggcagcgccgccgcctgcgtcggacagatgcgacgcgccgcgccaccggccgcgacgccgcctgccgggaggaatacccgccgggcgcacagccgcctgccggtgcctgcctccgaccagatgtgaaccgaagggggagggtggagagggcggggccgacggacggcgacggagggggcgagggagatgtaaggcgatggagggagcggagacggcggcgagggtgggcagggcgggggaggcggacggcgacggaggggagcggagaaggcgacgcaggcggaggagacggccggcaactaaggaggcggacaaggcggcgacggcgagcgataaggacggcgacgaaggcaaggcggcgaggccaggggaggaatagcgcgacagagtccacacctgcaatgcgaaccgatgcgaacatcccataccaaaattacccataaaggatattaggagattacttaactaccctttaaaataaactatacagattaattctactcggagtagaatacttcaagtatattgcaccggagcatcgctgaattttaaaaggctgcatatatccgattggatgtagagtccgggtaaaaaaacccttctctaaaaaaaaatacagctgatttattaaccttgcaattttcatttggagagctataaatcgaaaccttaaaagagttgaacaacctcctagtagccaagtaattcatgcaagaaagcaaagagatgtatcttacaactgattggctcagtgacgatggaagcatggtggtgtgagtggtagcgagagtacagggcatgatggtgcagtgcacgatggaaccagtaggatagaaactcaaccgggccagcgtgcatcaggaccattacaagggcgccgtctcttctccttagtggcattccttgcccgagtggcatcaacaggaggactaggtattccaagtggctgttaagatgaaggtatcatccctgcaaaacaaaattaattttcttggtttagatttttactgaccatttgtctgaactcaaaagaattaaagcatacacgaacttggcatgtccatataaaaaatcatatatagagatagaactagaggagattttgcaggtgagatacatatataccagttgttctcacgatccactttgctcgaattcaataccacgttctacaatccggcgccgattgccacgggcatccatgagccgggagatggttagccagacctggctatggagaatccttagcaacatgaaaggaagcacactgaggtaggccacatctttctctcccaacttcttggcagtggccattttgtggcatccgtgaagcacccatggagccaggggcggagctagagcgaaacaacaggtggtgccccttgcttaatttactctattttagattgagtttaagctaatacggctgtctaagtttgtattgaggggtgcatacatggtgaaaatagatgaggtagagctaaaaaattttcttgaccggattcctgggcaccctgcattagcacatgcatagacagcatccacgcatgtttatttcgtttatgctcatcttagcatagaatcattttttctctctctacgtaaattcatgtactggttgctaatgaatttgaaaaatcactagcagatcatttgaaatggaaaattatgtgcagaccatatgtactcccgagaacattgttacctttaggtttccaagcttttgccatggcgattcagtacaaaaggccaggatttgtagccatttttctctattgcctttgaaggcttgcggcttaagtgttctcgatctactagtactactgaaggggctgctgctacagcgcatgattgctcaaagcagtaagccggcaagctctatatataacatttcgtttatatagcaccagataggtaggaggatctacgattctttacccatggaccttattaacaaatcaggtatgaagaacgaagtacaaaccagccccaataatttagatacacaaactaacaaattcaatgcactagtattgaaacaatttctccagacatccaaaagagatttccgcgtgcgggcctccggcccgtctgctcggaagtgtccgcaaaaatcacaatttttccatgcgggtggcgcacccacatgcaaaaataaaatccattggtgcttatgtcgtccgaacgcaataacaaaaaacagaaaaaaaaaagaaatcgcaaaaaataaaaatgcgcgcccacacggacccgtgggctgctggatccgggcgggaccgtccacccgccgcacgccctccaccggagggctcctcctaccaccgccgtcgggctcctcccgccgctgccgccatgctcctctcgccaccgccgccagatccacgcaggggacagctatgcacccctcgccgtcttcgactctcttcggtcaacgttggctctgtggccgcttctctaccaccatgcgccaccggccgactaccaccggctgctgcgcgcccaccggctgttgccacttgcccgccgtctcttaatgctaaaatttggtaagccccaaagtcatcatcggcctagagccagtatcagcttcacagtcctgaaatcgaccgatggatattatgaaatgctactagttggattcttgatggattcggtcaaagaagtttatctagaagagatcgtgttcaaggaggacgtgtcttggcagtttatctattaattaggcagatttagttagttttcttttatttttagaaaagtgtattcagcattcgatcaggacttgtgtttttcctttcatcttaaggaaaatttgaattgtgtccaatatagactagcatctacctatggctataaatatatactcatgaggtccttgtaatttatctctcgatcaacaagttgggttgcatcggcttcgatctccgatgagggttaaggcttgttatggctgtttgtatcgacgaggctagggccacgacactctaacattgttgatgtaaacacctatcttagttaatctaagtcgatgtctcaatttattttgttggtgatagttaaattgcttcatcgatctagattagctaaagtattcaccactctaaaaatcagtcaaaagcttgattatttagactttatgcttcttttcatacttagtgttgcatcaattgagtttgacctattaagttgtgcttagaataaaaaaatactaacatgtgtttgattggcaatacgggtttatcgggatttcagccgatgagttatctggatgttgcatcggcttacaagtattacatacaagttggttttaaccgattgcatcaaaggtttcactgattatctaatcttttggatttaatgtcatcggaagaccaaccgatgtatgcttaaccttcggatcaaacaattattctattgtatcattattgaccgattggtttctattggattatagtattatttattatattattaccagccgattgtctttatatcattatttacttaagtgtcagaatcttcattggacatatatcccattgttcaaaaccctattgacatcggcgggtatcggcatcggctagcattgctatatcggcttattggctaattggctttttgttcttcaacttatacatcttgtcagttgcaggatcaaactgactggcacgttcgcatctcataaatattttggacctgtattggaactaagcagatctctcaggccgttgtattcgttgacttagtttgtgtcaacatagatctggcaccatcgaccgagcgtggatttttcatcaacactgccgcgtgcccgccggccagccgctgcctcccgagaggggaatcgagtgacagagaggagagaaagttctctcctaggagagagagaggggggaatttgagagagaggagtatgaggagaggaggtgagaaaaagaggagaggagataaggatgacttgaaaaagaattgtagcgctaagagggaaagagaaggtaattcagacttttgggcggaccttcaagaggtcttcacgcgaaaataccttttcctgtgtggccgtttaagatgctagtgtgaaaaatagccaaattttcacatacggctcattaagaggtctttctgcgttaatatatttttgcatacggaccttttaaggagccgtatgtgaaaatgtgggttaatttttgcagatgcgaaaacttatggtcggttctacaatatatcaaggtgcttgttaagaaaatcatttgtgtggagtagtgacggtggcagtgggggaagattaatttgcatcgttttcacgcaatcgatgatctttaatttagtcaatgcatcattaataatctatggatagggttgacgcagagggagatatatcattggcaggtatcaaatcgtagcaatcagtttaaaacagtaagagcaatctagaggagaaagggaagttcagccgctttagatagctgctgctacctaattaatgatggggggcatggccggccgcattgccgacgaagcgccccatgccacaggaagccggtgtcactagaaaagatacttctacatgtgacggcttctaatatgtctagaaatagcagcccatcacatgaaagtcatctcaatcggatcaaaaagtacccgattgagttatggtcgcacatacatattagatgggcataaaacttaagcctgtcatggataacacctatcagtgacgagccgtagtttagacccgattgtgataacattccatatctcaaacgggcctaaagttacggtccgtcacagatgaccatcatctgtgacgggtaccaactttagacccgattgagataacattccatatctcaaacgggcctcaagtgacagatgaccattatccgtgacgtgcaccaacttgagacctgtttgagataacaactaggcccgtcacagatgactcgtcagtgacgggctatatactaatgcccgattgagatgacttaatctctatcgggcattaactaaagcccatcaccgatgagtatttttttatttttcatgtgaaatgtttatatttgtaagttgaactatagcaaaataattaagtgcagtataataattcattttatgagtaaaagtaattttacgggtagtaaatgatttgaaatggaaaaaatgtcaacaacaaagttgtataacttatcaagatttacaatttttagtttgttcatttttctatataacattttttgaataatttgaatttgaatttaaatttgaaaatttgacaacttcaaacaatattttcaaatactaaaatgatttcaattgaaaatgtcatcaacaacaaagttgaataactcatcaagatctaaaacttttatttttgttatttcttcattcaacaaaatgttagtaacattattcccaaattttacatatgtgttataatttataaaccagataagagatatgtcatgtttgtgaacaatgttactatgcactttgtcgtatgtagaaatgaccaaaataaaagttttagatcttgatgagttattcaactttgttctcgatgactttttcagttgatatcatttagtatttgaaaatgttgtttgaagttgtcatatttttaaattcaaattcaaactgttcaaaaaatgttatatagaaaaatgaccaagttgttgatgactttttcaattgaagtcgttcactgatctaaaattctatttgaatttctcaaactttgaattttgaatttcaaattgtttaaatagagtcagatggagaaatgacccagataaaaattttgcacctcgatgagttctacaactttggttttggtgacttttccaattgaaatcattttataaccccaatttttgtttgaagttgtcaaattttgaaaattcaaaatttgaattgttcaaatgaatttatttgtacaaaggaccaatacaatagttgtagatatcaatgagttatacaatgggggatgtgaatgaatgtatatgaatggggaatgttggggtgtgacattctcgcctagggcttgataggattaatagaataatcataccaacatgttacagctatattttcggaagccgatcttcaaataactttgatgttaagcgttctaggcctggagcagttgagtttcgcgatgggtgaccgatcgggatgttcttcttgggtgcacacgagtgaggacaaaaaagagtttcgggatgggtgaccgatcgggatgttcttcctgggtgcacacgagtgaggacaaaaaagagtttcgggatgggtgaccgatcgggatgttcttcttgggtgcacacgaatgaggacaaaaaagacccgcctgggagaggcgggacggcatggcatggctaggcaaaaaataaaatttagtttttttgattatactcatctggcatggcatggctagccaaaaaataaaatttatttcttttcgattatactcatatgtgacgggcattaacttatgcccgattaagatgaggatcatatgtgacgggctatagttaatgcccgtcacatatgactaatttgtgacgggctatagttaatgctcatcacagataagggtcatctgtgactgacgggcgctagttgtggcccaattaagatagatcatctatgacgggctatagtttgactggttatctgggtcaaagctatctgtgacgggctttaattaggggttgattgagatagattcatccgtgacggtcgtttgcccgattgagataaatcttcacatctgtgacttctagcctgtgacggacgccatgcccgattgagatggggcttaccgccctattgagttgatggtatccgttctagtgtgtctccacctctgtgatcgccggcctgcggtgagccagtgaccatgcatggacaacgacggagaaagcggctggaatagcttaggtgcggtagccccaactacaactcccaaacagagccgatgaagccgctctccggggccccaactcccaaattaagtagattgtaggcaaaaaaaaaatggaattaactcaactaactggatggccctggcgccgatccaaaattatattttacttaaaatttattaaatagctatctctggttgtaaagacttagaaagaccaaactttatcatccctatgtttttaattttatagtttttaaaagttacaacagttgatacctcttacttctatcctctttctttatttgcttgttcaatctaccactatttttatttattctccatggaacctttaaaaattggaccttatattttttagaatttatctcgttgggttttatttttataatttttagaagtccgtcaaacgctacaactatactcctctacggctcgttcactacgtcctctctttattgtgattgggattttaaaaatcgaccataattatcgtttgggtttatttttttttactttctataagtcctgtcaaaccatcaacggctttatcactgtactcctctatggcttgttcgttgcctccctttttttattgtcattgagattttaaaatcgaacatgattatcattgggtttgttttttttattcttttagaaatccaggaacctttaaaaattggacattgtagtttctggagtttattgtctcgttaggtttatttatataatttctacaagtctcgtcaaacgctgccactatactcttctacaacccgtttgctgcctcatttctttattgtcaatgggattttcaaattgaacataattattgtttgggatcatttttctactttttagaagccctgccaaacaattagcggcttcactactgtactcctctacggctcacccgttgcctcccctctttactgtcattcggactttaaactcaagcgtgattattattagggtctatttttttttttactttttagaagtcccacacacaaccatgaccgtgttgcttaacggcttatctgtcgtcactccttttaatcatcattgggattctatttagggttttgttaatagtttttagatgtcccatcagccatcaccactctactcctttatagacccgttgcttctcccatctttattgtcatatgtcatctgtgttctagataaaatatttttttttgaaaattccatatttttcatccaatatttttaatatgtaaattatattcctacttgaactcttataattatttttctatttttgaaatttattttattttttatttgtaattttaatttatctcgtcatctgttctagatagtctcttcttttactagtctttattttctattacaaattttagttatttataaattgtattcctcattgaaatcctattttttattctattttgtattttatttttattttattttgaattttaattaatcttgtattgtgttatatatggactattcttttaatatttattgtatttatttcgaatttcagttgttttaaaattgtattcctaattgaactctcttttttatttttcttagtttcgattttattttatttttatttataattttaattaatctcgtattatgttcttatgtggactcttctatcaaattactaattttaaattccaaatttcagttatttttaaattgtattcgtacttaaactcttattttcttcttataatttctaattttattatttctttattttttattctaaattttaattaatcttgaatatggggttattatttggactctttttgcaatattgcttatttttaattccgaatttaagttatttttaagttttattttttacttaactcttctttttgatttttcccttctagttttgggttttattttattttttcttccgaattttaagattcttatacgtactcttcctccaatattgcctattgttaatcccgaatttttgttatttctaaactgtgtttctatatagactctctttttctttttcttcaattaatgttggaatttctagcatcctcaaatttgcctattgttatattgttaagatgttttaataatataatgaattcgtagagttacaagtctttgcacaattcgcctctgctatcaatactataaacctctctcgagcaccttcttgggaagcttttttttttctgagtaaacgtttgataaaccacttacaaaaattttaagactaccattcaaaatagtattatgggtaaacactccaaatcatttgttcatttattatgtactgtctatatccgtaataactacaccctagcactttggaaggtaaattattggagaataaaaatgactttaataccctttcaataaatgatgtggctaggaataagatggaataagctagactgatctactatgaaggtttttttattttttttgacgagaaacagtaggagaggctcctactgtgaaggtttggtaaacaacttattaaaattttaagattatcctgtgaaacaatattatgggcaaacaggattatttcttagagtattatctaacatatatttgtctagtaatacttgaaaaataatctccagcccatagctcattttgatttaaatatatgttgcctcatttattctattaggaacctctttgaagcattataaaaaaacgattagcagttcaggaaacgtccgtgttgaaaatgaagaagtagaagatgggaaagagaagtatacaacacaaccttaggttttccagacattaagttgttgtttttggaatatagtgtttgatcattcatgctattcaaaccctatttaagtttatttattttgttgtggtaggtttcatcactaagatactttaatcaagcttaggtttcttgcatagtcgcacttatttttttaataatatgaattttaaacatcatgtaaaaaaatgaacagctagcatcacatatttaaaaatagggagtagatgatttggtggagaggcatgcggtgggatgaaaaatagggggtgcatacaggaggaaagatatatgttgcttaggctcctttattatttaggcttatgcttttatgatgagttttttttatgattttatggtttataagctggtagctgctttgaatcatcaaatggaagggttgagttctaactttaatttacactagatgatactccgcgtgttgcggcggacaattcgtgcgtgcattgcagttataaaatttcaatgtataggaatgagaaatattatggacctgtaaaagcatctcacatatatatgaaaaatgaaatacttccttgtagtggtttcttatagcatactatattaagtggtcaatgaatgttgagttatgtcataatcaatgagaaatgataactgtcgatatttaatgtctatttaatgaagcttggaaatgatccaataactcttatttagcgggtgatgtggctcaatgcatgtttagtttttggtgccaactatatactccttccggttctataattattgacattttagacaaggttgaggtcaaacttttataactttaaccatcaataacataaaaaatatttagtttaaagaaactagaacaatatatatagatttgtctttcaaaacactataataaaagtaaacatgcatttatttattgtgtatattataatagaaaaataaggtcaaaagtatattttgtaggccgtgtcattgtccaaaatatcaattaaaatgaaaccggagtcccaattgatggtggttgtttcctctaatttaattgctcatgacaaagcgcacgtataccacagtcccacttctgatcgcacgttggcactgagcactgggaagccgttggggtactgaggaacgaagccgtgtgaaatcccaatccacgcgcgacatatatatcctgtatgtcgatcgtgcatcgattggagagatgtgcgggagtgaagatgagtctagctaggctggtccatcaatttgggccttctttctcgtagattaaagaagtttcaaaggtgtatatttgatgtcgacattgatcaaatagctaatataatgttgatgacgtggtgaattgagtagtgagtaccaactatatatgagaaaaatagctaataaaacctaatttcataattagacttcattagatgtgtggtggcttggggggtaagatgagaacatacaaatggaggaatgcacgctatgcacacaaacttactgtgcatactccatacacaccaactagcaatgtcacagaaatttgtataaaaaattagacacatactttcaataatattacacctatgtttgaaatattatcttcaaattcattatatattagtcgcaaaaaagataaaattctgatagatttttactctaacagatttttcattttttgtgacggctaaaatataatgaatttgaatatgagactttgcacatatgtgtaataatattatgattacatgtccatttcttctagaattattttgtaatatttgttagttagtgtgcatcggaagtttttgtacataggatatgttcccatataaatgatagtttgtccatagaaaacagtataataaataatttagaatcatattttgtgcttcgaataaccatcatgtggccatggatctcatttatttaggttcaatatagacaaaaagttttccagacttttctaagtaaaatataaatgtaaaaaatataaagtaaaatttcagctatgttttatgcatttgaattttaaaattcattactgggtaatattattttaaaaaatattagttatagattggacaaattataacctacataaatttggtctaaagtgaaataatgttagagtttctcttaaaatataattttattctattttaagcattgtttttgtatgcagttataattatcttgcttctataaaatatttagaaaaaattgctacaggacatcattttttaatatttgccctagaatgccataaaaccttggtttcggctttgcatactaagcttttgtggtaattcgctaaaatatattctagcggtctaaccattacttttagctatctggctcaacatgagatgtaaaattgtggaaaggtttttctcggttgtagacaagaatgttgccaatatgtgttcctatggaccaactgggagctttacgcatttcgagttatagttgcattaaatccgactggctggtttgtggccaccggcgaggctaatggcacgaatttctactcaatcggcgccaactgggaagagcggaggaggccagtggcacatgaggaggaggtcggtagcgactttgactgaccttgtacatgatattttatttgcgagtacatgtgagacgcatgtaagcactcaaacgcacatatcacattatattcatgttcatatacacccttatgagtgtgtgctaacacatctaaaagaattggaggtctagaaacacgtaacatgggtacacgttttaccactgagcacacctatgtgtgcatgaactttgcaatattacatcactgggaactatgagtactcaggccatgtataggattttaacctagacgagcaggttccaccacaaagaccctaaccaaccttttgttgcacaaaatttgcttagatgagcccgatacccataggtggagcgagaaacaattaaaactagttgatatcccgcgtgtttgtgacatctcggcccagggcttaataggattaagagaatactcataccaacaagttgtaattttttttccggaagcccatctccaaagaactctaagattaagcgtgcttggcatggagcaattttgagatgggtgaccgatcgggaaattcttcccgagtgcgcccgagtgaggataaagtgtgcaacacacgtatcgacgaggatgtcaatctctcttaagggggagaatactcataccaacaagtctagtctgtgagggcagtctatgacctggtcacacagcacggacgtggccaaggagtggtcacacagcatggcacatgcgctggcattggacgcatggacgtggccaaggagtggtcacacagcatggcacatgcgctggcactggacacacggacgtggccaagagggaatgtttgtgtccaagagggaacgttcctgagttggggttgatcgacgaggacgtcgatctatcttaaggccttaattggatgaagagaatactcataccaacaagttgcaacttcttttccggaagccgatctccaaagaactctgaggttaagcgtgcttggcctagagcaattttgagataggtgactgatcgggaaattcttcctgagtgcgtagctgccggatataagtgggcctgtcttgggagaggcgggacgttgcagcgttgcagcgggcacactataaaatgttcttagtgcataaaattgatgcaaattggtcactgaatcagcattcaaagaaaaggagatttacactgttgtgatagaaatgcgcataaatgttcgtttgaacatatacaattgaatcaggaaagcaaccccaattaatggtacatggtattctagcgtgctgagctggtcgatttgctgaattgctgtgaagatatggtaggtgtaaaaatcaggattagcctcttggcaatatgatgaactgagtaagttcaaaactttataaaacataaatggtatctcaccttcagcagacttgaacctttaagcaaagctactagaactgcaactcaatcctaggaagtagcaacatggctgccttcatctcatcctcttgataaagctaggctacatgtaggccatatttatagcatctctaacctgtattctaagaaatatatatattttgaaaccaaattcatactgaaatttgtggtttgagcttgttaggtgtacaccacatttgagaaacgtggtgtactttgcccaacatccattgggtaagccctttgttttttatttcaatcaacagagctactggttaaatattttcaaattattaaaactttgcagaatatacattttaaaattattggaactttgcaagtgtaggatgcacgcatgagctatatttgaagcatgaaatgccaatgataggatatcgaaagaaaaggacgggtgcacgcagcatgaccaacaaaggataaggtaaaaaaaaaaacgcatgccagtaaagtttatctgctttgatgagagtcctttttgcttggaagactggtatgacaatcctcgcatttttccccatgtgctggaacatatattccttctatctattaaatccatagcacaatttgcataggtcacaagcagtataatcttcttttaagaaactaaaaaatagtcaatacataagtgtaggactaacaatagttgttccttctttaagttagcaaaaacaattcatcaaaaactttcagctcgatcctgcaagaggaaaatcgtaggcaatgctcaataagtaaacagaagcaattcacatatacataattgttatacaaattggaatacaattggaggatacataaacagatttgaaaactttagttacatgtagtatactaacctttcatgctatgattctcttcatctgctcaattcaattgggggatatgataggacatggttgactcgaaggatgagttgtgaggatggtgaaaggtatttgttgtatgttatgttgcagaagggattgaaagagggtaatgaagggtaataatgtggatcctggtgatctaatagattgtgacagtttctgctgtaattgctgaaaaataatagtaataggggacggaaggaggaggcgaatggacaggaccaaggcgattatggtattgatagtttggggaataatgaatgaataagagaagggcatgaacgattctcacttggattgccgatgcggctagttgagccgaggggaaactgacggatccatggtggctgaaccggttgccctcccgaagcgtgcacggtgctggcgaatacgccgcatcccaaaccgccgcgtatgccaaaagggcggaagcatgtgcagggtgggttgggccaacagaaaaaaattgatgggaagctggcccaagatatcaacctcgttcatctggaaacacgcagaccaatccaacggctgaaaataaacaataatgtggcgtaacatggtgcaagttttatagcaataactcctctagtgggtaccaactatataggaagaagggatagtatggtagtgggtggcaatagtattagtttgagtaaatttgacaaaacaatagatctaaggacgtaaaccatagaactatagatttagcgcaaaatttatcataaaactttagatttaaggtgttgtgtcatcaaaccgcagattcagtgatgaggttatcatataactacataatttcaaatttagatcaacaaaaatattcttaaaaaagttaaaaaattgtagttatgtgatacaattgatgttaaatttgtagttagaaaaattccaaataccccctgaactttgggtcgaagtccgtctagcaccctaaacattaaaactggacatccaaccctttcaacttttcaataacgttcatattatctcctaaggtggttttggatgatagttttgcatgttttggaagttcaaacaaaataacttttaaataactaatataacatatttgcatatcatcaattgtaagtcatcaatttatacttatatagtgataccataatattaataaagtttagggggttgaatgtccggttttaaagttcagggcactaaactgacttccatccaaagtttagggggtgtttgaactttttttttcctttgtagttttgtgatgcaacgccataaagttgtaacttcatgaaaaattctctctttttttcatttctaaccagtagtgtagttatacacattcttaaatatgtagttttatgatgagaggtggagagtttttccttagttgtacacaagaatgttgctattatgtgttgacatggatcaaatgggtggtgcataactgatcaaaagttacgtatttcaagggataattgtgtcgaatccagttggcttgtatgtggcctctagtgaggctattggcatgactttctacttgatcggtgccagcttggaggagcagaggaggccagtggcacacgaggaagttggcagcaccatgcgcaactcagtgacagtgtgaaggagatcagcagtgccttgactggctctgtacaggatatttcaattgctttatgtacatgatgtttcatttgcaagtacatgtccgacacacataagcactcaaacgaacataccatattcatgtccatatacacccatccaagcatgttctaatgcacttctaaaaaatttagaggtctagctgcacgtagcacgggtacagattttaccacgaaacacacctatgccatgctatgtataggacattaacctagtgggcatgtttcaccacaagttcgccaaccgagcttaacttaagttggttgtatagaatttgcttcaatgagcccgctagccagtggcgaagcccaaaacattaaaaaaattatatattggagagtggaaatatcattggtgtctattttcaaaaaagtccaagcccctacttgcatcccccttatctctgcccttaccaccagcaaatctgcttcaatgaaatggtataggatcttagactcaacttagtggcaagtctagcttagtcttttctagcaaggatgattttcataagtttgcaaatcatgatagattatatttcttctatgcatgtactaattccttagcttgtgttgaacccaaccatagtgttggagatcggtactcctacaacagagaagagaagacccccccccctcccgagatttagccgaggggcaagtagagatcgagttcatatggtgtaaacactcaaacaaagaacacaagcaaatatataggtttatgctgctcgagagcgtaataccctacttctgtgtctagcactat

SEQ ID NO: 61016 - DNA, 848 bp, Oryza sativa
atgcccgcggcgagcgagcgctcgaaggcggagttgagggcggcgtgggcgcggtgggcgacgggcatggcgcgcgcggcgtcggcgagctccgtgaggtacgcgtgccacagcttgtaggagcccgggagagcccgcagagcgcgctcgtagatgaccgagcgcttcgccagcggcgccgagcggatggccgacaggtagcgcgtccagcaccgtagccggaacggttcgcgcaggacgtcctcctcgtatggaacgtcctccggcgagatcatcatcgccgccaccatctctctaactcttttgactgatgaagggccggtctatcttctcttctcgtctcgtctgatcgttgcgttgcgctggatttggatgggcgattgtcgacgaggcggcacgaaccccagatttatagagaaggatgaccggtacgagcccgagtcggtttccacttccagcattccgcgtgaacgccagaagcccagaagtcggtgcccccctcggggttgcgaacaggagtcgtactccgactcgctggcccatgttccccgttgccccgctcgtcaagtcgtcattgggcagtacaaatatcaaggcaaaagccctgctaatcagctaatgtaaaatcttattttaatcttatcttatcttaatctatacctacacctatacctatacctacttttttaattaaaaaataagctaatttttcatccgtcattaaaacatgggcccacgcgatatttcaccactaagagcaagtttaatagtatagctaactactagctctaattcatttatagccaatctaacagctcatttatacaatagttatatactacactatt

SEQ ID NO: 61017 - DNA, 682 bp, Oryza sativa
ggttcatgtcatcttcatttgacaggatttgtttcttattgattaaaactaaacaaatttcaatgttgcttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactgcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccgggcagtggtggaaagcgtgtatgtacatgtgatttttcattccaaatccatacaagttgtttgctttgctccattcattgtgagtttttgcaggggggaagatcagatgctatattaattgtgacacc

SEQ ID NO: 61018 - DNA, 1471 bp, Oryza sativa
ttacaccaagtgctagccactacaaactaaccaacctaggactaaaatttgttgataatttacacatgacaaattaaagtagtaatctgctagttcatgaaccaattaagcatggttaagtaagtcatgcatatggtacaaaatggtaggttatattgtaatcatcatagttgatttgatcaagctagtgaagattacgcgaaaaccatcaataaatacttgacacggtaacataacacgagcccatgatagagaatatatatataattcatgtctttcttgcactttcttaacagttcatgctattatatatgctagattttcaacatgcacgtgcaagttcataattataaacacgttcacaaaatgtgtttaatttcaggtgtagctgtgttgtactgcatctgacctggtcaggactattaattactcaggccagccatatacgactaactacacaaaagagatgaaatgttcagacacatgttttaactctagtcagttagcttatctgattgattaatcatccatccaatgagctcaattgctaccaagaagcttaagctagcaacccaatcttactagctaatgcccacatatttacactaatgaggagtaaaaataaatcagctgttctatacttaatcatgcatggttataattaatctttattttcttaagcatcctaatctctcggtagttgggacagatcgaatagcttatgcttagcttggtaaggatgaatacgaaagcatgtacttctgaagagttcgttttcttgtcattcccatctcttcttaggattggttgcaagtccctgtcagtgctggaaataaatctcatgccttttggacattaaccgattgatccaaccgtgcatgcacactagctaatgttttctaacacctacgtcatcatggaaccctaattgagcttgcagcatacgtgtgttaattagttctttcaacttaaaccaacctgctgatcgagtcaatgtgccgtttgacgatcacaatttgtagacgaatgttcatgttagtattcctaaattacacatgctattattctagatgatggataatatttttactaatttgtatctagcaatactttatccatccaaaagtcataaatattttctgtttttttttataaataagatggtcacatatttgtagtctcttcgtgcatccaaaacttaaatggagatattgcatttatattttgcaatgctagattaaattgttaatcgaaacccgagcaactatcttaatactaattggttacatacatgtatatagtttcttagtctttgttacatggttaatttcttcttagtcttggtggcaaaaagaaatatgccttggactttttttatagagggggtatatatatatatatatatatatatatatatatatatatatatatgtatgtaggctcataatatggacaaataatattcaattat

SEQ ID NO: 61019 - DNA, 1940 bp, Oryza sativa
  unsure (1)..(1940): unsure at all n locations
atccagtacaattgttactatcactgcaactttagcagttgcaaggtagctgatggatcaaaaatcagcggctcagatcattagaaaatattgttcacgaatcactgtagcaattttctactgtagcgtatactgtgcagggggtggcagagcaaatccaagctgttggctgcatcgatccaacggtcataatatgctatcactgctaaagttgcagtcgttattacaactgcattggatctcaattcataggaagcgcgtgccagcaccaaggctgtaaaagatgacaaaaaaaatggcgacagcttgagagtgatgtttactactacggttttaaacgtatgacgcttttgacgttaattatttgttcttataaaaaaaagtatgttactattctctccattttttaattacctgacatcactccttcaaaaaaaagactggcgtaagacattgttcatttgcaaactctgatttgccttttatgtggaaaaattatagatatataagaaaataacatactatgtattacacacattaaacataaccatgaaactttcatttatcatggactagtcttttaagagttattaaatggccaaagttggaatagtaatagttaacgtgaacaaatatttgaaagcggaagaaataccatttacttttgtagtgacttatattttagaaaaatattttttcagtggtttctttgttgtacccattgaagtatgatatttgaattataagtacgtactctgaaacaaatctttgatgattttcatactatatacgtccattcttccaatattaatgtttgaaattatatgcaccatgcatatatttaccctgttgcgctgatccactacaatacatatatgcagtcttcatcagtgactatgacttttctacagagaaaatggagggatatgttacttttcgttaagaaaatgaagtgcattttaatatgagttccatagagccaaattaaacctagttggttcgtgccaatgcgcaccgaatctctcaccaactgagctcttgagcgatagtgatcgattaattttgttgccaccattatcaaagctagtctataatgttctatcacttggaaacctacgtttcaaagaaaaacgaaaaggtgacacacgtgtccctcagaggaccaccaggcaagcaacacaaagtgatcaccaatgcattagcactaatcatagagaacccaatgtggttagtccactgaatgctcatgcattgtggctgactagctacaaattaatatacgtagtacaatatatcagttggaggctggaagaaaaagaacagcctacagctcatcagtgcggatagctgaacactctgatagtctgatgtatatgcatgattcccaactttaccagccgacccattatcatcctagaaattggcgacaccacttgatccatagaaatgattttatgatataggaatcgaaggccatggcgaccattactgtcgcaacatgattcttgcatgcgtagctccccttttgatctatctgaaaaagataggtttaacaagagctaaagacggtggacaattgaatgggatgggtgttgttgagcagataaggctagctacatctacatggtcatggaatggagcacttgtctaggctagctctagaagagagcattatagggtatatgcttgttggattgattattggacgagcggtatgcatttgggattctgaagcttatattagcacggtcagcgttacatttttctgaaagtctgaattcgcctcgttcacgaagtgccatttaatnttgcagtacgtatgcataaatgatcagttcgtcgatgcatgtatttccgagttcgattgatgctacgataattattgacagcctgatctaatacttcaatccctaggggtttagacagagtcggntaagctg

SEQ ID NO: 61020 - DNA, 722 bp, Oryza sativa
tttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctaggattggggtgccatggtcgtcagaagcaggaagggcgtggaaggcggtggtggttccagcagctccctacgagttgattgacttattattttttaatcatttacatgtgggatatatatatatatatatatatatatatatatatatatatatatatatgttttaaatttctttgatgattgggctatcacatgaatgtcacattagtaaaaacgaccatcaacattgtcaaggagtttttttgcacggggttttagtggttgctaaataaaatccgacctatattggggaccttttcaaaattctaatctgcttctatctaaaatgataaggtggttaagttgggcttgaaagtcgaactcaa

SEQ ID NO: 61021 - DNA, 1136 bp, Oryza sativa
tttacaacataatcgtttaagtcgcaaagaaaataaatgtaaatgttttaatcacacattatagtttttcgctaatacgctatttggcgtattttgtgcatatagccatccgatgaggctatcagttaaaagaattgctcctacaactgcagatcagaatctcttgctgagtagtacctttctaaggattgttaaaaaaaaaaaagcttaatccatatatgttcatttaatcagcgtgtaattgacaagcaagcagtagcataaatttccataacaagctagctaatgaataggacatctaaacaaactaatcctaatcaccatcatgctcttattagttcggttcggtcacatcgtttttaaatccgcacccgtttgtttttgcgtgcatcatatctcttcattcatgtttcgttagtacagctgcaatctgtgcgtacttatcagtgatcaatgcatgcatttgagtgtcactccacgactcctcagcttgggatcagaataggtgacgagaggttgccgatcattcggtatttcggtgcagtgagccagccggacatacaacctctgcccacatgtcaattgcacacagggttcatagtcccgagcggtatcttaggttataaaaaaatatattggtaaatcaataaaaaccaatggaaatcgaagaagttttttttttgtcaaaaaatcaaattttagtttgattttttttaacttgactaaagaaaaaacgagtgctttgtgctatcgtggtagtccagaaaatccaattttcgcgtaaactagactgatttttgttgggattgtaaacgcttgcacctaatacatatatattactgcacaacagcatagcagggcagaggcaagactaaggcagcttagacttgagcccggcttacctccataaatatgcttaaatccttttaaaccattacatatttttctagaaaaccaatatcctattaattgagccctactcgagcgctaggcttagaaaatttttggctccaccgctactacacagaattccgttccgagccaggaaccccttttcctgcatgcgcgtgacgcacaccaatcatatcacaacactaaaccgagcaaaactaaggcccaaaaaagaagcaaactgg

SEQ ID NO: 61022 - DNA, 14479 bp, Oryza sativa
tgccgcgacgagctcgcttcctccctcgcggcgctcccatctgccgccctctccgccggtacggcgcgcaccgccgctcctctccctcccacccgccggatggagaaaatggtttggcggcggcacggagctcctggaagacgacgacggctcgatccaccaatctaactaatttgcatgtattttcctgatgttagtgaggtctctagagtggtacaggtgcaaggaatcaacgcgaggctcaccgaagcagcgggaatcgaaaattgatgccggcggccggagttgaagaagatggggtcgatctccctcttcggcgctccattcttctcggttcttgagggctattgattgcactgatgaggagaggttgttggcgcgaggatttgatctgcggtggtccacagcggtcgggacggcgacgatgtcactgcggcggccgccggatgccatcttctaaagcaaaagaagaaaaagaatgaaaaagaaaagaaaaggatagacaaagagaggaggggagcagtgaggatgacatgtgagggagcggtgcgcggcagtgccagcggggggaagctacgcgacgaccacaacgtcaccgagctcgaccgccgccgctcctcctctgctgtcccacttgagccgccgcaacaagggccacctcccgccaccgattcctcttccgcccacaaccgccggagccgtgcctccaccgctgcgcgccgctccctcctcttccgccggccgccgcgtgccgctgtctctccgtcgcctgggagaaaattgcatatctaccatcgcataagattggcttcgtagaaataccatcacttaaattggcttcgctagaataccactcccaactagaacggcttcgccaaaatgccattttggacaaaaatgaccctgcatccgtctcttccacctccggcacgagcaaacggcaatggtgcgcagtgcagtagtgacgggtgagatgaggaaaggtcgacggtggtcttctccgacgagttcgtccgcctcacctagctgcgcggcccccaacgccttcagtctccacgacgcgccgcctccgtcgccgacgagttcgacgaatcatccccattgccggcgagttcatctgctgcctcgacgcaccgccccatcctcaacgagttcttccgccgcacctcaacgcgttaccctcatcgccggtgagttcatccgctccgctttcgtcgccgatgagttcggccccatcaacgttgatggcatcggctacggcctcctcctagcgcggcgggcaggatgaaaaggtagggacgacgaggatggcagcgcccccatcgtcgccggcaaggtggcaccggtggctgccgacgagctcctccggcattggaggaagggagaagaaccagggtcatttttgtccaaaatggcattttggcgaagccgttctagttaggagtggtattctagcgaagccgatttaagtgatggtatttctgcgaagccaatcttatgcaatggtagatatgcaattttctcgtcgcgtggagagaggagagagagatgaagataggggagatggggagagagaaggaagaagagggggttgagttggactgacatgtggggcccacgtgggtcccaccattttttattattttctgtgagactgacatgtgggacccacgtgggtcccaccatttttttttattattttctgtgtgagactgacatgtggggcccacgtgggtcccaccattttttattattttctgtgtgagactgacatgtgggtctcacgggttttattatttttccagattgaattgccacgtaagcgccacgtcatgccacgtcagatgaagactgggtcaagtgagccacgtaggcaccacgtcagctaaaaccgccatcaaaaccgctgagggacctaatctgcaccgattttgatagttgaggggcctgttatgtctggttttttggtccagggacgtaaatcggattctttgacaagttgagggacctcagatgatcttattcctcctgcggaaacatgtggcttttctgggccgttcagttctccacatcaaccttgtctctcgtaggccgaggccctggagaagtccacatctcgcgttctcgtggacgcacgccatcgtggaaatggaggactaaaagcaaacctcggttggtggcccaggcccagctgaaacgtcctgaagtgagggcgaatccttcgccgtcacaccgcgtcagcgcgttgtctcgaggcaggtatatgcaagggtggaaggcaacgggtgctctttgatctgatgatgccgctagctagggctcgccctacgcgattacggatatatagaagtatggtctgcctctgtccatgcctacttattggtatgggctactttggcctatccggtcatcggctaataatgtatggagggggctagctacctccatggaatagaaacggtgtcatattccctgtaaccgctctggccatctcgtcaagtagcggctggccagattgacgataacagatacgttggcatcgtccctagttcatggaacctatacaaccgaacttaatcagctcaagtttggttcatagctcgaggggtgccaatcatttgtgcccaagtggaaactcgccgaagttgtaggcgtaacaattcgagctatggtataaattgcacaggacaatattgccacaacgcgaccagtgttcatatgatgtatgaaacctagttaaaactatgtttggcatgtgtgatattatacggggttagtacgaaaacggtactagctagtaccatttcgtagagataataacattccacgattccaaccatttctttgtgacccctattactccacccatgcacccctcgcaagtcgcaaaccgtccagacatcggcagcgccaacatggctgcaggcccctgattgcgccgccagagtcgacacgagaacccgtgcggcatcacgtcggtccgggcgaaacgggggtagcaatacaatgattgagccccccgccagcggcacagccaaaaaagtctagccgccgcatggccagcccagcgcgtccccgtccccgcaggtcgctcgccggaaaacgaccgcgcgaggaggaagggcgcgcgcggaccgaatcagcgaagaccaacgagcgcgcatcgacaagccccctcgtgacaatcaactgctctctcgatcgagacgcggaggcgctgttgcacgtccacgtacgcctcgctcgctctggtctccgcgcagaaacggcgacaccctctcgcaaaaatcttttcctcccgtcaggatcagatcgaccgtcgcggccagtctctgatatcgatcggttggtcgactacgacgtggctgatcgactgatgagataataagagaatccccctccgcgcgcgcgttacgcgagtgtgcgctcctacaccgaggaggcaacgagacgcggatgtggtatgggtggtgggtcggtctatcgacgactcggtgtatacgatcgttgatagaaggtttgacaaatgcggggcagaggatgaatgaaagccagggggcgagcacgcaacgaacgcaacgcaacgcagcggtgcgtgtgggccgcagcacaactaccacccagatgctaacatgatgcatccgttgcttggatcgggccttcgcttcgggttggctgccttttgataacgacccggttgaatcgagcgaatccactaaaattatcgcaaatggagatggtggctccattattggacgaaatcaattttagacaagcgtccaaacacatatgtggtgtttaatacaaaccaaatcgtacatgaacaaaagaggaccgagtggagtgaaaaaaaaaatatggaatacgcaacgcaggacgtacgttgccagcggaaagtagacagtaatgcgtttgtctgaaaacggatcacattttacgtgcacacaacgaatgatggtggtatatatgtagattaatctagcaaattaaatttaatacagcatcacaaatagaaagttacacaagaattataaacaccgtaaaaagttcgaaatgtgccactaaatcctttgggcggttcacagttctaacggccagagacggggacttgagccggcgtagctcatgtgccccctgttgttggccatgccctgcgtacgtatgcgtgtacctcaccattgtgattaaagaaattatgtggtggttaacgaaaggcctctgaaattcaacgccatatatttatgtacaaggctcctttgcaacatgtagcaagttgacagtgtatagtattaattactcccgttaatcatcttgcagtacgactgtaccctgaggtgtacgtacagtacacttgtggctgacaatcataccaacggctattcgggcaactagaatgccaaaactggataggtgtgtgagcttgactgccatgttataagttgacatttcccgttagtgaaggtgacctgcataaaaaaaaagtgaaaaagatataggtaaaaaatgccgctatgtttcctcaggcctcatcagctaccatgcgcaggacacgcctgcatgggtcggacaactatagtcaacgacagatcaggattaatctagacatgagtagcactcattggacgtgtttcattttttttatcctctagttatccaattttgattggagtcaactgagtaattaaccaattagttttaggccaatcatacaaaaaaaagtaaccggaaatcaaggtcagtgtcatatattttagctcctcttataggattactccctccgtactcgcgaaggaagtcgcttagaacaatatttaagtcaaatcttgagaatataaatcataaataactcttaatttgttgagtttgaaaatgtaaaaaatatatgaatagatttgtcttgaaaaatactttcataaaagtatacatatgtcacttttcaataaatatttttagagaaataaaaaaatcaaagttgtgttttggagaccgtgtcgctgtacaaaacgacttcctttacgagtagagagggagtactatttttgcttggcctagctttaatttgctgatgtgtttgcacaagtgaggtcacaaggttggacagcagggacgtgtatgtagctaacaaactaacactccctccgtccccctaatataaaggattttgatattttattggtactgtttgaccattcgtcttatttaaaaaatttttaaaattattatttattttatttgtggcttactttattatccaagatactttaagcacaaattttcattttttatatttgcataaattttttgaataaaacgagtggttaaacagtgtaagtaaaatattaaaatcccttgtattaggggacagagggagtagtacgatactgtaatcctatttacaatggaaattacaaaactctaatcagtgccggttagtaaggggttgtttagattgaagacaaaataaatcttactaaattttggcaatgccaaaattttgataagttgacaatattaccaaaattttaacatgatttcttatgtatttatcaaagtttggcaaaaaaaacactaaatgtatgcacatctttggcaatcttatgaggagaatcatcggtagaaccgacacttatgggcctccttggctcaaaagaaaaagaagccagctcatcaagcccatgctccgagcagcccgaaccctcatctacctgttgacgactaaatttggtaagatgtgaaccgggtttgacattgagatcgaggcggattcgataaagagatcgattcaaagaacagagtatgcattggctgtgaaggcattggctgaagtgtgcatcggctgggatggatcggacagaggatagccgatacagccgatggaggtgatgcagccgattccaatgaaggtggtttcagggctgtttctagactcgttcaaagtatttcatagagattgccacgatggggataaagctcttggattaggcaattgtacctattaattaggatatttcgtgtaatttccttagagatatgtttgggcaaaagtttgccgcaaagacttatggtatcttagagtttgttagagatgagtgtcgtgtccggcaaggacatatcttgtatctcgggtataaataaaacccgaacccatgtaatcaataaacaatcgttcaatacaatctcggtgcatcgccacccttttttactttcgtttatttcgacgagttcttactttcgggttgagctgcatcgattcgattttcaactagaggtaaaacttgttatggcggcttgcgttatcggggttaatgcttccatctttatgacactttaaccctgtttatgtaattcgtcgagttatcatatacacgttgtaatctatgttggtcgcgctatataacttgttatcggttggttcttattgtaggaaagcaatcaatagagttatgttttgttattgatctagattgcattgtgtatctaccatctcttgtaggttttcatcatctcgcttagatatcatatttgtctttatgcttaatgctgcatcggttgagttcgatctattaagtaatatctacaactatgatatctggattgttttatgatcatcgagagagatagtatcggggtttcagccgatattacctgatttagctttatgttttatatgcttaattgatatgctgaatctgcctgttatattaagatcttatcgcaataaagtatattaggcttctgtttgatatattctatccgttttaatatcttaacataaagtggtattggagtactagccgatacatgctagatctatctgatcagctatgctatgagcgtttataatcttcacgttaatgtatatttcgatctaagtgatttatactgtctcagcatgatgaccgatctatcccaatcacttggtttgaatatacattgacagaaagattataaagcgttaatatctatagccgataaagtagatttagttttactttgcttatttataactgccgatcgattcacatatgacatcggcttgaaaataaatgacatgtcatcggcgactggccgatcggctatcgtttatggatttaaccgcggtttcttttgtctttatttcttgttgattgtaggatcaaatcaactggcacgctaacaaacctaaaggcaagattttggacctgcactgaagttaagcagatcttccaggccagtgtgtatttttcgcatcaacactacccccgatccccaactttagatcaagaatccacattcatttccctgatccccaatatcagatcaagaacatacaaaataaaaaatccccccaattcacaaataaggatcaacttcatagtaatctcctaatctatcctgaataaaaaatgtcacatatcaaaagaacatatggtgagttgagaagtccgtccatgcgtagatctggctgcacccaagggaggaagacacaacaaccagcagcccaagtctcccatgccatctcccaccgtacacccaacctcatccatcgtcgcgcttgagcccttaattgccaccaacttggtgatctccttctccttcgccacattggctagatccgggatcaacaacatgaacacaaaccaaataacgttgtcgaccccattggataagaaaatagcaacgaaggttctgaccagccaaccggatccatcggcggggaggccggggtcgccagatccggtgtccccggcctcctcgctggacgattcggtggcggcgatggcgcagctcttgtgaggatgcatagggagagaggacaccgacgctttgtgtcgaagcttgtgcttctctagctggaaggagtggcaccacccttttgggattcaggtagggagcgggtgcgaggaaacatggcaattggcgtcgcgcgcggataaacgagggctgcaaaagactatggtttagatagatttaagccactcgaaagtgtaacaccctactcctatcttcttgtttggattccttgttgccatgtatttaagatgttggtgtacttctgttctgaggctctgaagctgatttctctttgtgtggaggctagtggcattggtcctccccttataactataaggggataccatagtccccaactctttacacatgggtcccataggagttggtatgtttggtcttgttgcacggcagttggcgaagcccactatcgactccgaactagcatatcggtcgtgttggcaaggcatagagtggcttctctccacccctttgctccttcctttgacgtgtggcttagggtaggtgatgtggacaccttggtggttgccgagcctacttgagcattagaggctaggtggggctgtactacagtgggctggaactggcaacaagtcaaacgaccatgtcgtctgatagcccccatgctcagtgcctttttagggtgatgatggcttgtcccaaggtcggcatacgccatcttgtcgtccatcgtcccggacgcacgtcaggttggtatagattgttgctatcctgagcacgtggggaaggtggcagatgtgccccgagtacagtgcatgaggggccgcactcatgggcgaacgtgcccggagcataacccacagtagggatgaaaacggatcggaaacggacggaaactagctttatcatattcgtttttatattttttttcggaatcgaaatcggaatcgaaaactcggatacggaaattaaatagaatattattgaatacagatacggagcgaatacgagatggaacgaatacgatagcgaatatttaccggcatataaaaagcccctcaaattaagtttcttgatcaaggaagagatatcacttattattttagttcaacatctctaacatttatatcgtcaattttgtagacggtctcacaaccgcatgtgaatatcgattttcatggttgttcctctaagagatccatatgcaaatatgattatcattttctattctcaagaccttttactagatgcataacttacttgccattgtataaattggagatgttatttattttacttcacattttcaaaatttgtaatatttgttttatactttaaattctttcgaatacaaatgttataaactacaaagtggtagatcctgttgagctctacatctttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaattttgatataaagtgtgtcttcatctgattccgtatgaaaaagttatgtatatatacgtgtttttttctaaaatttgctcaatgtctgcggatatccgaaaaaaattccggatagtttccgaccgttttccgattctgatggatagtacccttactgtattcgtttttgtttctgagaaaaaaatccgaattcgtttccgaatacgagaatttccagatagttcagaccgaaactatccgaatccgaaaaatggtctggacggacagaaactatccgaaccagtttcatccctaacccacagaggccgcactcagaggtggacatgtcgcgagcagaacccctagggtgttgcacccgagggccaatgtgcttgagcacaactcatggaggaccacacctaggggtggatgtgctcccaagcacaatccatatgaggggtcacgcttaggagcaggtagcaggtacgtttcgacttttgagaaactagtaatggggatcttggttcccgtttctccgacactttgaatgggagagtcaggactcaggagttatactcagctcaatatgagaggaagggagagcgaggaagtcttgggctggatcgatatgagaagcggaccaagtatggacttacattaaaaagaggggtttggagttagtgaggcacacgactcggttcatgagtccagttttctggctggtctggataaaaccagtacaaatagtttgttttttgggttaatcaacaaaaccgagactaaaaacataagtgtcgatttatatttaaaaaacagtacataggtaggattattagtaccggttttaaatttaggtgttacgtaagggcttgaaaggcatgaaaagtttcatatgtatcaattttagatgaatcggtgtatatgagagcatcccctattagatgcttcatagtagtggctaacgcaagaaatgaagttgactgctcccttgtaagaagcaagttcacatggcttataccggcgatgattgagttagccgtacgtacatgcgtttgctttattgatcgagcccggacgaatcgaccgatcgactcgattcttgcagcatttgaccatgcgtcccacgcgcgccagcagagagacgttttggctcattgcaaagtactatctttatttcgatcgttctccaagagtacgcgtcctgaattcctgatttaacacgccaaaaaaaaatctccttggttaatcgataaagtccttgggttatccaaaatagagacgctattattattacattattatgcgggatgtaaccggtatgaattgatcttctgaaaggaaaaggctcggctttacggaattgtgatctattactctttggatttcactgtctacgctcgctgttgttctttttatgtgcacttaaaaagtgcgatgcgtacatatcaccgacgattcaccggtatcaacaagtgatcctgcatgccgctcgtatcgcttgttgctcgtattgatattcctttatgttagaagaaaaaatcgcttgttgctcgtatatatgctaatcggatatgatatgataagcccgtaattaaggggaggcatcagcagtctacttcttatagtggagaggtagcaacttgactgaccggaaagagattcttattcatgttgacaaattctcaataagggtggttttcaccgtgggtccgtggcccatacacaagtcggattcttagtacagtaaagaatgataattgtaggatcgtaaagggccttttccaccccaaaagctagccattaaggtgagtgacttccctacttatatcttagttcctttgcccttccacaactaatgtgggactattcaacaatctcccctttcacacattggtgtctctcagcccttcactaccctttcaccgtatctgggcccccaccggcccacggtccatcaggtatacgggccccgcaggcactcacggtccatcaggccttcacacgtgtccgtcgggccagagatgttaacctagcctggctctgataccacttttaggatcgaatcacaagaactaagccaaccagagggggtgaatggttggtatatccaaaaaccgaaaacttttagcggaaataaaagttaccctcgaagtcgatggattgcggtctgaccgaaggtattgcgccggtctaatcacttgatgaacgtcggtctgaccgatgtagatcgatcggtcgaaccgccgagacgcctgccacgcctgtcgccgccgccggtctgaccgcccgtatgccgccggtctgaccgccgcttgccgccggtctgaccgctggtagatcgccggttagaccgccgaaacccggtgaaacacaaattgaagaactcttaaagtagatgacgactttattgattctctctgtgtttacaaagtgcaccaacagcactccttacaaaaatttcgactaaactcgaaactctaactcaaaagctcaactcaattgctcttaaaagtaataccgggaagcctcacgctccccctctatttatacccgaggtaggtagcctaaagccacgaaccaaactcatactaagagtcctaaacaccttaggaaaccctctagtataagaaagaaactttacataaccaatcgtaccaaatttggactccttccaaattcgactccgcatcccatacgcacacaataactccatcgtatgccatatggaatctccatcaaccacgtgcatcaactctagcctaagtatcccgcatgatctctgactaccacggacgtcgtcttatccccaagccgactcccggtccgtcaccgcaaatactctcccgaggcatcgattcacctacacacgaaataaacaaagaaaccatattccgagaccaagctatctccaacttgactcattagtagcaaacaacagtattacatacgtatagtattcatctagaagtcataatcatgaaataatcacggatatccaaacaaacaacccgaaaccgaaactgacacagtgtcggccggtctgaccggcatacacagcccggtctgaccggtcacatgaaataatgaatcctgtgatcacctgtgaaatccaatcatctccaaaaccacttcgtgaataaattccaaataacaaaaccaataatctccgatgcccaattgttcatcacataataataaccaaaaacacctttgattttacaatctcccccttgatgaacacattggcaaacctatcaaaaatgttttggtgtttggaaaaataaaaacaaaagtggtaaaaagcacacttcgtacaaacgtacacatcgtgctcaaaaatccaaaagaaaacttctcccccttttgaaaagaaagaaattcccaattgaaccaaaaacatactcttctcaacaactcaccaaaattcaccttgcttctcccaaaaatccaaaaattttcacatacttctcccccttttgacaatgatttcatcaagcataggaattatgttcattaatgttcaagagcttaacatacatatagtatatcaagtcatgtgttgcaataaaaagaagataaacccatctataatataacaagcatgcattaaagtataaccatgaaccaaagattttacaattaatcttgaatcaacaatcaaaattcatgatttcatacaatttataatgcaacatcttaacaagcacataggttgaagaataaacactaaacacacatacctattgcatttattactctttctcaaataacctttagcacaaaataactaagagaatttttttttcaatttttttctttgcttgagcctttttgctcatatttttctcttttattccgggtatgtccctgtcgtcaagactgtttctagggattcggcacccattattttgctcacatcgaatacgtcgttgtcgacaagactgtttccaaggattcagtattctttttttcatattttttattctctttttcacaatgagcaattaaagctatttgaggaataacaagtcaataaagcatatatatatatatatatatatatatatatatatatatatatatagcatttatagatcaaaccatatgctagcatcaacattgcatatttacttaattcaagtagaatttaagtgtcatgcatcatctcccttaaaagtaaaatctaaatctcatgaaaagactagaataaatacaagctgtgctagagacaaataaactttcaaagtattgctagcatgcacaagaaaataccatatgtataaacaaagctatcttttatcaatttttctcattgtcatattattgcttgataaaagcatgaggtacaaactccccctcaaaccatgccaaaaggatgaattattcccaattcaccacgaagaaaagcaaatcggttagaatccaaaggtttagtgaaaatatcagcaatttgcaacttggtgtccaaaaactgcaattcaacatctcccttctcaacatgatccctcaaaaagtgaaaacgaatatcaatgtgctttgtgcgtgagtgttgaacaggattcttagcaatgttaatagcactagtattatcacaaaagagaggtactttctcaaaagtaagaccataatctttcaaagtaaataaaagccaaagaatatgtgaacaacaactagcagcagcaacatattcagattcagcagttgattgagcaacactagattgtttcctagaagaccatgcaatcaatgatgtaccaagaaaatgacatgttccactagtatttttcctatcaattatacaacctccaaaatcagcatcggaatatccacttaagcatatagaagatgaagtagaataccaaattccaaactcaagtgtatgattcaaatacctcattattcgcttgaccgcttgacgatgtgaagcacgaggagaagcttgaaagcgtgcacacaaacatacaacatattgtatgtctggcctagaagcagttagatacaacaaagatccaatcatacttctatattccttttgatcaacagcttcaccatcttcatcaggatccaacacagctgtagaaccaattggtgttgaaattggcttgcaattctccatcttgaaccgtctcaaaagatccttcgtatacttcgtttgatgcacaaaagtaccttgaggtgtttgcttaattt

SEQ ID NO: 61023 - DNA, 19944 bp, Oryza sativa
cgggactaaagattgatttttagtcccggttatttgaatcgggactaaagatagcgatctttagtcccggattcgtagtcccggttgaaaaaccgggactacagggtggttacgaaccgggactaaaaagcatttctccaccagtgagagaatcatgctgggactgcaactgttggagccggagaagagaatcatggtgggattgcagctagagaggagaataatggtggtattgcagttggcgaagataatccagaagaaactttggctagaatttctctaggcatgtttggagggcatattaatgcatctggcagtgcaggtggaaaatactctcctcctttggaagagcttggcccattttgattttagaatgtttggaagaattgcactgaagtgtgaaccttgatgcactcatgcaagtgttgaatgcagcttctttgttcttggatagttttgtttcatattagctagctgcaagccctctattttggaacctgatggaggctatgacttcttatgtattgaatttctatgaaactatgactctattttccatgaatttggttacgtggcatgtgacttatcaaagtaatggttattcatggaaaatttgtgtgagcttgggttgatttggtttctcagattagtgatctacattacccatttaattatttcaaatttgagtggattgcctatttaatttaatattcagatattgcatataaacgaatatccctattaaactattataacattttgaagggaaataattgtgatatggcacaaataagaaatttatattaaacaaatagatccctacagttttagaaacctaggggaagttactttacatactggatacaatgccatgtcagccaagttccctaccatttcaaatcctagggatcctttttgttccctgcgcttttacaattgaaatcgtagggcacatctagttcccggcgaataatttcccatggaagttttccctacgaaaaggcctagggaacttgtttccctactagtttcagctcattccctactagaaaaaacaataggggacatggtgagttctagtagtggtatctagaaccgttagaagaaattattttaaatgatctagagttatttctttttggtattttaaacttattagtgtgaaattcgttaatgacaatgagtttttaaatattatcttgtatttttatggtgaatgggggccttcattttttgttccacactggaccaccaaaaagtcagggccggccctttatgctacgaattttgcccatcagatttatttgatagtttatagggaaaagtattttgaacattcacactttgaaaaaggataaatgtctacattaactttttttcatccactatcttttacaattaattaagtattacctcaacaccatcaactttcctattcgctttactattcgtcttttctaaaaatacttgtgcgagtaggtaaatatgtaaggcaagtttaaggtactattttacttttcttaaataagtaattgaataaatattgttgattaaagttttaggaaaaatcaatattgtcctacatttaaagttggagactgctatatctttaggcttgcagtacgtgctccattaatattgcaataataggagttgaaaaatcacatcctttgcttctagagccaaaatatcacagttcctaaacacattgaggtagtcccctgtcgtataatcgaaaaggggaaaacccctaaattcaacccaatgtcgaggttaattacgaagggcagtatttgaaagtgtatggtttactagaaaaaaaaatgcccgtgcgttgcgacgggtgaaggttattttaattttattgttgttatatgatctagttaatgtgggagttcacttggacatatatatatattttagaaaatcatgagctgcaattagaagtccgatcatattaagttagcatgcgagttttttaaagagaattcttatacgactcttattatattttcaaaagcgaacgaacttaaaaccgactcaaatacagatatgtatttccgaaagcgatcaaacttaaaaaccgactaatacacggatgacttaccaaagtactggtaaaaacatcttcaatttttataatagtagagattagacatcatcctcttttaaaatagtttcattgttattttttagacttttgaaagttaaagacataaaaagaatttcttttcaaggaaaagaatttgatatccacatgcaaactacctgtggcttacccacgttgtgtttcttggggtcttatgacccaaaaagattattcaatcctagttaaattataccgtattatctagatgatttgtatatattaaaccctcggtaatttttttccaggttaattgccgccatatacagcacatccttagaattatcaatggggctactacataatataaaaatatggtgatgagattaatcacaacaaattaatactccatatatatatattattctacgctagaagtatcaaattttcatgcttgcacgtgacagaggaaagaacattcgggtagcttgtgcgtgtggttcgatcaatgctggagagcgacacatacatcggcacgtacactgctaatctggccgttttgtctacttgctggatgaattaattggagtaatattttttttcaccaaaaaattaagaaggggataattctgtactccctccgtaacataaccatgagtttccgtgtcaaactttaatcgttcatcgtgtcaaactttaatcgttcatcttatttgattttaaaaaactagaaagaataagtcacgcataaagtactatttatgttttataatctaataacaataaaaatactaattataaaaaaatttaaataaaacgaacgatcaaagttgaacatagaaacttacggttgcacttattctggggcggagtagtacttaattgctcttcttccggtaactgtggcagcagacatgagagattgagacattgactgatgatggaggtgtgcttgcatgtggggtgcacgcgtcaccggtgacgtacggctgcttgggtgagaaattaatcgcttggtccacaccatatgaggtgaaaaaaacaagggttagatatggttttttaagattgagcaaccactcccttttccccataaaatccaatctaatattagatatgatacatcctagtacaacgaatctggacgtgtctatgtctagattcactgtactaaaatgtgttgttatatccggttctagattcggtttttatgagacgaagtaagtactatttacggtgatggtgatctaggatgtagccatgtatgcatgtatggtttatattttggaacaattgttcacaaccatgggttaatttttgacatttaattatgtagcaagtttgtaacatctagtgatgcaaatcatagtatctgagatataatttttactctttttaaaaaattaaaaacttacgtgtatcagtacattagaaaatagaaatctcataatcaactattggaaattaaagagttgataatattgttagttttagattttttttttgttttgatctcttagtgaaaaagattgcacgtaaatattttccttgaaacaacttagtggtatatatactggcccttatattcataaacaacctccattatttacaatcatgctttgccaacgaatggaattaggatccagagtaatgttgataatttgcctgaattgcaagtttcagattgtgctacagctacatataccgacctagatacatgcatgtcaggcacatacgtacaaccacggacttacaatacctctcacctattcatttcctgtcctcttcaccaagttggttagtcaggaccacggcaaaagatctcatcggatatccatccacgcacatatcacctctcgcgaagtcgcagtaccgtatccagaaaattaacaaccatacacgaaaacctcccgaacacgcacacggcatacacaacatcaagcaccggccggtagtgagcgagccctgcgtacccgtgtgcgcgtagcgaaaatgccgctgccgcaggtggatggatggagagaattggaggagattgcaacgtgacaagagcaacgggacggtgtaccagctgcagctagctgcccgtatttaacgcgcaaaggcaggcaaaataggcaaaatggcaaaccgatcgctttggcggcgagtgagtggcagcaagccaggacagctagctagctaagcagagtggcaaatggacaccaaaaagaaggcaaaaagttagctagctccatcaagcctgctaagctccatcagcctcccgttttgttcggatctccggtatccctcaacccaggttttgcagtagctttcggatggatatatatatatatatgtacttggagagggtgaagatttcatgagtttgtttctcaaatttgtgtttttatagtataacattcttatatacatacccgtgtatcatggtaaactaaactagtattatacggtctagctatttgaacagctgtttggactcatccgtgtgcatggggtaagaagtggacgcactactcgttatacggtatgccgattatactagtcacaatcatgacgggattcgtctactctttagaatttttctaggtccattgttatcacatatatgccgacgacctattttactttggtcgtcttcaccactcatgtgtattatatttaatttagaactcatattttaaaatacatgacctatttaattttgttagaataaacctttgatcctaatattttatttatttgacaaaaaatataatcatataaaaatagtttcaaaattgaatataataatatcaattttatttaaaaaaatattattatatagtaattgttgataaatcatataacaaaataaaatatactttatattttaaaatgaagggagaatttactccacatttagatcgactagtggttattgtggcatataacatgtcgacaaatatttatttagagtatcctagctaattcatttagcatataacttttatagtgttgtgttggaacctaccagaatgtccatgaatgaaactaaaataactgggaaggtgatcgagcgattggtttggccgaacgtttcccacgatcacaagatcgataaagtttgttcattttttttcaagctttataggtggtgacggcagtgtgcactttagtttttctcccccgttgtttggttaattttgtgtggttcaacgtgccatatacgtgtttcttcacaacttgtcacgtactatgatgataaatatgtgtttttttaattaacttttattaatttccgtgcatgtggatatatgtggataaggaggaagccacaaaggcatagatgatcgagcatatctgatggaggcgatgcttccttttttttctattttttctgcttgagtgcttttttttttgtactgtaaaaagagtagtgcataatttaaagcagagccccaaaagttaggtacatcaacctttcacaaaatccatgataaaaccgtgaaatttacagccgtcatcatcatgaacgtcttgtcctacagggattccttttgtgtgaagatggttatacttctctgttccaaaataaataaattgaggtgggacatatcgtggaaggttacgccctatgcaattaatctagattggtttatttttggacggaaggagtatataaatgtttttcaaactttttgggtgcaaccttataataaggtcttttaatatatttttagattgtgcttatttcctacgatgatatttattggtagtacgatatatgtagtactacttagtaatattatatcaccagtaaacgtatcctaatcatttatgtattttactgacagtaaaaacaactaaactcccttaaatgtacaatatttgagttgatagtataaagagctaccactcattggatgaggaaaaaaaaaggtcaatagtaccatttctactacctaaagagaccaccataaaagtatactattttcttttttctattttatattataagtcatttgattttttttcttagtcaaatttttaaaattttatcaggtttaattaaaaaaataatttttagatttaatgaaactaatatgatatttttagatattgctagatttttctataaacttaaacaaacttaactaacttttaactttttaaaaaataaaacgacttcttagatatgaaacgtaggaagtggtacctaaaacgttcgtgatcaaaccttataggacgacagcgacggcgaggctaccctccctccccccccccccaccccacacacacacacatattacttacattgtggcgtgttacttatttcccatgtgataaataaaaccgatgaagcagcagagtgcacgatatgatatggcagagcactagccagttcacatccctcctccactcggtggtggcgccgcccctcgccgctgccatggtactgtacgagtgggagccacgcgggccggccgcggtcgcaatcaccgggccgaccaccgatgacgacgacgatcgatcggaaggaagctaccacgacgcatcatcaaccgtgctgcggatgcaacgcgcggcggcggcggcggcgcaaaaaaccttggccggctgccgaaccaaccgggaagctagcgggacaaatttatcgagcctaattaatccatgattagcctatgtaatgttacagtaaacattctcttattatggattaattaggcttaaaaattttgtctcgtaaattagctttcatttgtatattaattagttttgtaagtagtatatatttaatactctaaattagtgtctaaataaatacagagactaaagttaaatccctgataagatatatatatatactagtactattaatctagataaaatgtacgtatattaaaatttatagtactataatgtgtcatttcaatattatgttggagattgcaagtattggtttttttcaggtatattggccctgtttggatccaagggatattttttagccctccctcgaattgctcaaatagccaaaaaagatctaaaagggtgagctatttgagggctatttggaaataacccacccaagaggtgctaatcggggctatttcaggtggggccactgaaaaagtatcttttctccctatctctccatgggaaggtacattaaacaccaaataactcttaaaataacccttggatccaaacaacttaggactattttattagagtactatgctcttgtgctaaaaaatagctctcaaaataactatggacaagttctccaaacaggggcattgtctaggtcggataacttttaactaatttggacgagctaccatgaaaaacaaaaccaatgcgtagctttcaattccattaatactaataaagtgaaacgttatctcatttctatccatgtctataacatgtaccaccataatactgtacaatactaattttttctttgaaaaatggactggctcactcgtttgccattgtagccttgtgctcgatggttacggagacaacataagaccatgttcgatgtccctatatatggtcatatgttctgataaggatatattgacacaatatacttttttaaaaaatattgacataatatgcacatatagagtgataaggatatatttagcttcagagaaatccatatcaagtactccattcgtttcacaatgtaagtcattctaacatttatcacgttcatattgatactaatgaatctagacatataaatctacatggattcattagcatcaatatgaatgtgggaaatgttagaatgacttatatggtaaaacggaggaagtacaaaactaatagaatcagagtaatgagtggtagaataaaagatgacaaagatgtggaaaaagaaatgcacatatcttttgatgtaatggtaataaagtgaatatgtatatgtcgtaccatgttgttttcgtcaacaatgcaagctcaagcactgcaaattaaatatcatactccataataaacaattaatcacatacatcagcagtaaacttccagcattgaagcaacatattataaaaacagtttacccactcgatttttccaacctctttgggtacattcttttctcccccttgttgacaaagtctctaaccctcatctagtaaacctgaaattgacagacattaatttctactatcaaataaatacgcactcaagctccagctctcctgaagctgccatccaatcaaacaattttaactctatataaaatgagagtgaaactaggtgaaacgctatcacaaaataaactaaaaagatagagctagatttagactgctcacctacttcataactctactctaaaactcaacttatcaagttaaatttagaaactggacctccatcaatcaccattagcgcactcccattaattaatacgaaaagccacgtgtcaccatcaccaaaaatttaaggccgttttggattgaagccaaaacgcgccctaccaaaattttggtaacttcaaatagtaaacatgctagtttcgattgaagccaaacaatcagtagtgtctatacttaatttatttggtcacattctagaaacttcttcactttactactcaactttggctttatattggtatcaaaccaaacatgggctagcctactttaccctaccaaaaaatattgctagtgccaaaatttacctacattctgatactaccaatgaattggtataggctcttacacccaccacccgttaaccactaccctacccgacacgccgccggtgcaatacccccacgtcagcgcacgtcccggccccacctgtcagccaccatcggagcatgggccccaccacccccaccaccccgggtaaggttgccagcccggacagcgggatagctacgtgtagtgtaccgcgtgacgtatcacactcgcagtatatatttttgctacgtgtacccgagaagggcgggagggtgggggccccactgacaggtgggccccgcaacggcgaccttggtcgttactactacaaagaagtcgtttccctctccttttctctctctctctcatcatcatcgtcttcttcgttgtgggcgtagccaatttcgttcgccattttctccttccattttctcggcgaggaggagggggaagagctaggatgccggcgtggtggaagagggggaaggggaagaaggggaaagggggatcggcggcggcgggggaggaggaggaggggaggaggaaggcggggagcttcgacgaggcgctcctagccgggaagcagagtcgggaggagaaggaggtggtggtggtcgggcacccgctgccgcggccggcgtcgctgccggcgccgtcggcggcgtcctcgtccgcggccgggtccgcctcggcgtccagcgccggcagctcctcgctcggctcgtcggcggcgtccgacgagccgccggatctcgggacttacaggtgaggaggaggaggagtggtttggtttggtttggtccggtggtttgcaattcgttcgtatttggtaggtgggtgggtgggtggttggctggttaattagttcatcgaggcgctaaatcaaatcaagttgttgttcttctcctttttctctttaaattttattgctgaattcggcgtgaagttttcgtttctggttgctagtaataattttgcgcgcttgcttcggttcatctgccgaattgtttcggtgggtttggtgggaaattgagttcgtggacttcatgaatctcatctgtttggaggaggggatcaagatttgatttgcgaggttctttgcttcatacttttttttggtgttctactttttgggtggaattggagctgtacctcttgatgcttatctggtttgttttttttccttttcatccaggtatgcttgctagtggcgttggctctttcgtcccctggaaagtagcaccacttgtgctctaattaacccaattaattatttgtttttgggcaaaaattatttcgattcgagatggattctactgccccgttgactaattgtcttcgtcaggatcttctgctaattgtttgattttgtaatatcagttgatcttccttgatccgtctcttcgctgtatcatttgggaatttttccgggcttgctttctttggttcacttttgattttagaagatatgatttttttaataaaaaaaccatttccgtttagtgacagatagtttatgtgatcagctctttaaattagtggtttttttggtgtgtgctggctatttgtcaaagattatgtgggtttttgggggcaattcgaattgtatgttttgattgaaataatcaaagaacatttttgggtccccagtccctgtatataggagtcgatgattgcttaagaataattggtgacttgctacgaatgtgggatagtacgaagtacattatttctaacccaattattgtttcgagatatggtagctttaggatggtgaattttgctgctgtcaagtgattgctccattcataacttttcatttgaactgaagcttgttcatgtctgattcaatagggtgccagatgcaagctatgtgcttccaggcagaacgctggctattgattctcggagacaaaatcttgcggttgaagaaggacgctttttcgcaaacaaccagggtttggagcatcccaggttgtctgaaacttcagtttctccaaggaaagaatcttaccttcacaatttggatctttcaaacgatcgaactgcgtattgccatggtcggaaatcaacggagattgtgttcagtacaagagtgccaatctctccccctggctcaaaaggccaaattccctgtccgacctcccctgtgcaatcaagagcattcgggcaatgcccaggatcccccactgctcggcaggatgattcacgaagctcaagctcacctcaccctcttcctcgtcctccgggctccccatgctcatcatcacgtgtcgtcagttcacagtggaagaagggcaagttgttaggcagtggtacatttgggcaagtataccaaggatttaacaggtacttgcttttgaaagcatttactgtattttcatccttacggagatgaatatttcttttctacaatgcatactgaatcgctattcaaaaatgtatttaatgcagtgaaggtggccaaatgtgtgcaattaaagaggtcaaggttatttctgatgattctaactcgaaagagtgtctcaggcagctacatcaggtaatattcatcttgtcaacaaatagcatctgtcagcagatatttaaactttacatctttcgtactaatactacttcctatgggcaggaaattgtgcttctgagtcagttgtcacatccaaatattgtgcagtactatggcagtgatctggtaaatatagaactcatgatgattttatgatcttgtcttgagcatgtagttgcatcataagttaaacgaagacatacaatcattcaatcattacgaactctgaaattaggtgatggcaacagttagattaattgttagtattattttccagtcataaaccactgttctgaatttgttaagagggaaacactgtggtatatattgtatgaaaatctgattttaatttgctattttatatatttttgcctgagtatgcttcattattcaatacagtctagtgagacgctttcagtctatctcgagtatgtttctgggggctctatccataagttgcttcaagagtatggtgcatttggggaggcagtccttcggaattacacagcacaaattctttctggccttgcatatttgcatgggcggaatacagtgcataggtatgatacttgatataatggtattttgtttttgtggaaccacatgttgctcttagttctaatctatgaaacatcacttttctcacagggatatcaaaggggccaacatacttgtagatcctaatggtgacatcaaacttgctgattttgggatggccaagcatgtaagtacaacatagtgttaattatctgataattcaaggattttaatggatctattattttcctatatgatattgttttgttgactagttattgtatttatacagatatcagcgcacacatctatcaagtccttcaaaggaagcccttactggatggcgcctgaggtaatgcaacagaagttgaaaaaacttctgtactctgccattttaagttggttgcttatcattttctgttgttttctcatagaattttaattttcctcaggttattatgaataccaatggctacagtctttcggtcgatatttggagccttggctgcaccattattgagatggcaaccgcaagacctccttggattcagtatgaaggggtaagcaagtgttatgaatttttcatggtatagtgcccaacttccattggaaccatgctaagctttttgtaactgattcacaggtggctgcaatatttaaaattggcaacagcaaagacatacccgatattccagatcatctttcttttgaggcaaagaactttttgaaactttgcttgcagcgtgaccctgcagcccgccctactgctgctcagctaatggagcatccttttgtcaaggacctagttgcaaacagaagcttcaggtctggcatgacaagggacacgtttccaacttcctttgatggaaaaggcgccatggtactactacacacaatctatgtgctaatcaaacagtgtccatttgtaattcattttcatttgtgaaatctatttgtgatttacaccttagttagttgcaagatatgaacaaatatgaaggaaaagaaataagaacagaaattaactgtcgtatctgtatcttcaagttagaattttgtgtcttaccattaatgtttatatcgtttcaggtacagacaagcaacagaagcttatctcctctacgagatccagacctgacgatgagaaacttacaagtaccaacatctgccattccttcgatttcaactcgcaggatctctgccatgtatgttgtccttttttttttctttcaaaaccagcataaattacatctcttgcattgtctaacagagcgtatttggtgcagcaacccatccaatgtgcgtatgaacatgtccctgcccgtgtcaccttgctctagcccattacggcagtaccggcagtcgaatcggagttgcatgccgtcgcctcctcatccagcctattcagctggagcagctaactacagccctatcaacaatgcactctacccaaaaagaccaagcaaccatgttccagatccatggctcgaaatctctcaactgaaagcaccaccatttgattctccaagaagattgtagaaaacccaaacacactttgtatacaggaatgaaagatgttccataagttagaagaccaaagggggttcctttttttctgtttcaccctttctgtatgtatctttttcccctcaggatgcagttgcatcgccattgtacaaatgcacaaaatgagttcagtgaaaagaagtagcattccagatttcacctgttcttgttgtgtcttttcccatatgatcaattttggtcccgatatgaattcccactgtccagatgcatctttgatatgatgtattttggtctgaattaccactttggctggatacatctttgctgtagaggctggattgaattctatcataaaaaatcgaattcccatccatcttcagaacttgatgatttttcaaagattttgtctccaatatgatcaattttggtctgaattcccactttggctggctggatacatatttgctgtagaggctggattgaattctattatagaaaaaagaattctcactaatattcagaagttatatatgattttacaaagatgtttgcaaaactgaaaattcatggaagctgtatctgatgaacatggaacacatcccctctgtaagtcacttccttctcttcaacacccaaaccccagatatgcccttgcagcttcagtaaaccctttgcatcatctccatggcctttcttggccatggcaccgcccttgccattgccattggcatgatcgccattgtcagcatgagccgcctcccagacgaaccggaacacgccgatggcgcggctcagctgcttgacggcgttcctgatcgccggttcatcgccgtcgatcaggaacttggcggcgtggacggtgaccctcttcccccccttgccagagaggcgcttgccggcgtgcacctcgacgtcccggacattgccgtagaggtagaagaggagcaaggtgtagaggcatttggacgaatggcctaggctcttggagagcttcttctgcaccaggcagtcttgccggcgagcctccttgaaggcgatgtccctctcgacgaagacgttgcgtatctggtagagcccctccttcatcgcggcgaccttgtcggcgtggccggcgagccgcgcgtcggcgtccaggctcttggctaggtcggtgaacatgtcgagcacctcttgccatgtcttcgccggcggcggcggcggcgaatttgcaggtttgttgaaaggggtcgggcgcatccaggatggggacgacgaggtcgcctcgtcggcggtgtcggagaggaagtggacgcaggcggcggcgatctggtcggccatctgggtcgccggggatgggtggcccagcgcggccatgtcggcgcgcaggtcgcggagcacctcctccagcgcgccgcgccagatgtggtgctgcgtcagctgcgggcagatggcgaggcgcacgctcttcctcagctgcgccgacacgcctagcacgtcgcacacccgcgtcagcgagctcagcgacgtcgccttcaggggcggcgcgcgctgccccgcggcgaggtaccgcgccgccagcgcgtcgaactccgccacccggtcggcgacgcgccgcgcgtccgccacgacggaccccgtctccgcgtgccgcggacccccgccgtccccgcgctccacgccccgcagcgacccggcgagccggagcagcctggcgtacgcggcgcggtaccagcgccgcgacgggggcgtggcgtgctcctcctcctcgtcttcggtcggcccgggcacgaagtggatcccgcgtcggccgcccgcgagcacgcggaacgccgcatcggcgccgcgcagcgcgtgcttcaccctgccgcggcattccatcgaacacgttgtgcgcagccgcagagccctagacggcgcacgcagccgccttttctcccacaccgcgtgcgagctctccgctcagatggagaggtatgtgtcaaattttccttgaagggtttgatatattgtagtatttacaaataggtccctggtttggtagtgtcttaataaagttttaaacaaatcctaggacttatctgcataaaatcgtgccttctttctcgccgtttcatgctccatatctcgatttgttttcgcatggaaaggaatttagggacgcctatgtatgcttttgaccctaatcctgatgcgaggctttatatttctgggcagtttaatttgggatttggctgtatgattgagctggagatgtgattatggtgcggattaggtcaaaaaagttaccaatttgactgtttttcttgtgtttatgtgatcaaggatggccgaattgcacagtggaaatgcagaaccttatgatattatcttatctatttgttgagttggttttgaccagtgcagattctattgtgtggtcaccagaaattctatggagatcttcttttttttattgtagttgcaaatttgcaatgatgcttggattgattttgtgcgatctcatcaaacaaagcttagtagatttgattgataccttcaatctattggatgcagtactgttaattatgatggtatgcccgatcctcatttgctgttactttattgtgatttgtgacaaatgatcaatattcaccatggttgtttaatactttaattttcttgtacactttgtcagctgatggtgctggaacctggatagagccaaactactgaatcagtaaagcataaaccaaatattcaataacaatgcaaggtatatgctggttggcgcctcttaaatttgttgtgattttgtaatgatataaccattttatttgcgcatcatacattaattatcgaaataccgtgacactgagaaatagctgacaggattggaggcttggattcatttttccaaggtatttataatttctgcgcttcactgtttaaaaaaatgttctgcaaattatgaatgctgcttattcatgaagatggtactgagcttcctgaattttgtgcaagcatatgaaagcaccagtctagtactaatcagacattgctccattgtttgacacagcaagctggacaaaggacaaatgggaaatgaaacaaatatcaaaccttataactttatttcaactaggctctgatctataaccctactctgctagtctcatcaaccaaaagtcttcgtggatggaaaatccttccccaatcaaattcgctaaatgtattcttgtttttggaacaggcattggacctatgtacagagctatgtctcttagcatgtcatccactttgtacagccctgggatgtgggatggttgtatgaatgccttcctcaccaaatcatcaaagtaatcagtcgcaacattctctatgctatttttcatacaattttcactgacgacgacacagttgttcatccaatagcttatcaattcctcccttgtgaaggtccagcgagggtatgtacccaacaccccaaagcagcgttgcaggtgtttgggaagaagcttacaacccagaataaatggagtaacaaacctggaactggatgcgacgaactgctgacagcgattcagaacaatgtaccagtacttctcattgaggttttctcgaagcagtccactcacaacttttgcagctaaagggctgcacaccctcaatgtcacagcgatcttctttccaataacaagtaatttctggtattcttcagggtgtgcaccacccagggcattttccatgaacatgcagccgagatcttccattgccaggaaccctacaggtaagttttcatgcttattgatcttagttgccagatgttggtacatagtggtaatgatggccttgcttcctgctctacttttcatgaacagtgtatcgagtatgtcattcattcccctggggtagctagaagcaccatcaagaacaagtagaaatctctccattcttagcctttctgatcacacttgaaagattaatggttacgttagaactcaaaccaagcttcttgcacaatgactttaccaaggccatggctggactagtatattctctgcaattcacccatataatcattgagaaatggctcctcaccttgcgatcgtcgcatacgagccgcgcaatcgtggttttacctactcctttgacaccccaaatgggaagcacacaaccatctggagaggatgatccattcttgtctatgtgaagcaagaattcgatggcctgtttcctctcatcgactctgccaactaccctgtcatggatcgaaacaaagatgataaccggtcgatgatgtaacactgcttggtcattctgcaagctgagaagctgagtgaacttggggatcccagaagctactgcttctagcttcttgacagtggcagaaactttcatggtggattccttggatggaatcagctgcgatgctgcgatcttgatgcgtttgaaggagttactagaatcgatgatggagctcaccttgctggacatatctctccagttgcgcagtgtctgatcgcctcgacatgcggcgtcctcaagctcgcgtagccagcgtagtagccatgaattggtgatggcacaccccttggctgcctccagagcggtgtgaatttcgacgagaagctgccgcagacgatgagtctcctccttgacatgcttctgctcctgtgattctgaataaaagatactatttgttggatagtctctactatgaccactgaacataatacctctagtagatccaccatgtttgttccttgcaattatagaggaaactacacaaaaaaaatgagtttagtacatagccaaagtctgctagatgctgataactacaaagtgatggaagggatgagccccaatctttgatattagggaagcaaggaaatattgaataccaacagtataatagaaagggagatgtttcagttagtccaagaatgcttcatttttttcttttcttagcgaagatccctaaccgatttcgtgtattgatgacaagctgtctacttcagtatctcctctttaattaccaggaagtttccttggtgcctcttttgtcttgaggtctgaaaaacaaagacacaaattatttactattgccactgtctcgcctaattatcattgaccggttccacttcattcagaacatggccgaattgtttacacgatagatattcaattattcaggtccattctgtcattttctagtttgactccattgctagtgtgagcaaccgtcaaactatgaccattttattgttatatatattgcctcatggcctctctgtaaactgttcttcttcatgcaggttctgagaaatgcttgactatgaagatgggaatgtgctcattgactatttacattggtgtctgactcactatttgatctatcaatcatttcattaatatgtttgtgcgtttagagacattagttaagttgatgaatttagaatgaactgtttaactagtatgttaattgaaacattattaggataatccaagtgagtaaagagttactgctgtggcttgtgaaccgggtacatttttcatgacgtatttactgcgtccataacaagcattctaaatgcctaagggtctaaactatcagttggtaagtcctgaatccaagtgaactgcttagcaggatgcctgggacctactatgcaatagctttccttggctgttcacaagttaggcaattgacctgacagtttataccctgagcttgtttgaacctgtgtttgagtggaagtctccgactgtttatgctgaagcctcccatcgtttgctgttgtcaaattttgaatttaaaagttaattttggagttgattttggggtttttttcatcgtagtttcttactttcttttcctgaattagcttttaaatcactaagaacatatatataaaagttttatctaggaattattttttggttgctgataagttgttctacagattaacataacagaatgacagatctgtccgtccatgtttcaataatttaatgaaacctatccaggaatatatggagcatgtctctttctaaatgatttgttgtgtaccacaaattttagcgatgatgaattccacagtgggacattttcagcatgaaaaatccaatactcttagtggagggaaaaatgactttacggaacatttgactcaagtgtctgtcttccaagtaatacagcaattgcagactataactgtgagtgaacaccatctaatagtctaaaacggttaactagattcagctgagcagaacaaataaataaggattcctaactagtgggatctacacgcttttagcaatatttgtttggcaaaattatcatattcagattgcagaacaaccagccaatcaaacattctaatggatttttccttactaacatattgcctgagaattataacggaattttaattaaagaaaattatcattaacatgttattaccatctattaattggtgtatatatatttgttactcacatgtggacttttttagcttcacactggtttttgttttccataaaatatagagagttggtgaaatagctgatatgtgagccct

SEQ ID NO: 61024 - DNA, 2610 bp, Oryza sativa
  unsure (1)..(2610): unsure at all n locations
cgctgtgcgttgacanccattttanatccnactcggtacccaattagctcgaccacggtgttgctgcaataaaaaccggcgggacgggacggcaaacggcatgcatggcatgagtgcgcggcacgaacggagcggaggctggtctggtggtctgctttgatttcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatgggatggatgacgtcaccgtgaagggtgggcgtgttacggcccacgggacttgtgtattgcctgttgggcctcactggggcctggtaggtatttctcctacaaggtaaaaaaaaaatcataactatcgatcaagtcgaaattaggcaggtgaagtgggccgtattccaaaattttcaatgtggttactggtgagccggataaaggctgatgaagttacaaatgagctgggttggcaagctgaaggaaaaagtatgccgaaggtccttaaacttgtcatcgagttacaaaatcgtcccccaaacataaaaccggatacaatacatccccaacattcaaatccaatgaaaactaagtctctcggcagttttgacttcggttttgttcgacatgaccgctaacttagcgtgggacccacgtgggccgacacgtcagggtgaccacgtcattatcatctctttcctctctcccccctctctctctctctcccccagttgtcggcgacgagaggtgcccatttcctccaccagctagcgcatcgccgaccgccacgtaggacaaaaccgggggcaaaatcaccggaggacctatagtaaacggtttttgtaagttgatagatgttatatatctaattttgtggttgggggatgattttgtaactcgatgacaagttgagagaccttcggtttaccttttccgcaagctgaatacaagttctcatttcccgggcttcattcggcctgacaattggaccttagcccttaagttgggcttatttacgaccaactaagttaaaatcgaaggaaaatgatacatgtacagaaatgtgtttagaaacattttacaaaaactgatgtggcatttgttatatattgtatcttgttttttcgtaactatccactgattaaatccaagtttgtaagagtttagtaaagttctttttaagtacgtatagcattactcagaatcgaatcacaacctgtgattaaaaaaataatttctaattccaaattggttctaatgcatcatgtggtgacagtttgacagaagatgatcagaactacgctgcaaacagtggcacgagaagcagtttgtgcaaacaagcgattgggtgcgaatcaaaaattttaagcaaaacatggctggttgatcaaaccgagtgcgagcattagttttgtttaatccaagcagatcttatcgtttccaatataaaatggttcgacgttttcgttagcagtgttgctgcagctgcagatgcgaatgttggtccctcggttaaattaatcaaaaccggataagctcgatctccccccacgcaaggctccagttttacagggtgtccattgtcgaaggtggccagtctggctggcacgcccagtactagtacaggtttatttcagcggctgagcacacggaaaacatggccaaaacccacaaagggatccatcttctggctaaaagcagctcactaaaatttatcaaacttggtacgtacatcgaccccgtgttacaaaaagatatcaaagaatgcgatatgcatactacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaactttctctgcacccacctcatgcggcggtagctcatgtcgctgagctcctggttccaccacccgccggggccgccccttctgccggcgggcggggc

SEQ ID NO: 61025 - DNA, 532 bp, Oryza sativa
atcactccaacctctgcatccgtcctcacataaccttccggctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcacgagtagcccctgagctcaaactctctgtgactctgcgactccctggaagacccacccgttggagacccac

SEQ ID NO: 61026 - DNA, 2818 bp, Oryza sativa
tgcctcccatcccacaccacagccgccgcctgccgtgctcgcagagagggagagagagagtgagagagaagggaaggagagagagagtatgacaggtgggccccacaatcttttaaaaaaagaaaatgctgactaggatgccacgcgtacgccacgtaggataaaaccgctctagattgggtcgaggggggtaattcgtccggtattgaaagttcaaggtgaatcatgtctggttttcgggttcggggggggggggggaattcggccgaccgcgatagttcgaggggggggtaattcgtactttttccactgcgttttgattggtaaatgaaatgctaaaaagtgagaaatacctttttgtctttcaaccccaccccactgtagcaagttgttctgtcaaagcgcgaatacatttcccaattgcacgatgacacaaccagccatgcgtcaccacggatcggggtaccttgtatgcctcgatgcaaaaccacttgctagcttaatttcagcgagaaacttgtgcagttcgtatatgcatagactttatgtaacatagaatggaaaatacgtcacgattgtgacgagcacaatacctctcaggtcattcacaatggagtataataccacataagctaagcacatggtttaaatgggctcttctcacactacaaagtggtttaaccgcctaagggtggcatcaatttttcatgccacccaaaacactttctattttagttctcatatctttcaattaggatatctttcaattaggatagaagccttacattaaacacaagctctctcttgcccttcactctcctctcctcggacctcacttgtccactcttcccttcccatgggccaactctccctccccggtgatgaggtccgccgcctcctctctactcttaggccattatgacgagctcgtggcgggtgtggatcaaaagcagcggttactgaacttgtcccatttcaaaatgatgtcatcgtctaaccctcttgaacggcttgggcctatgagctcctccatcgtctagatttgctcgtgcaccaccgccgagcccctccaacaatgcaaatcaacattgtgtagtcatggtgggcgtcaatcttcttttatcgatgttggatccaagccagccatgcccttctagatctggcgtagaagaagctcggcagggtggcatgtggatcaggggtgtgtctggccagcgatctcacccgccagtgatggcgacaataggggtcttcctggtatgttccttctagacctgtctctctggtcttcagatctacctcccattgtctagatgcctcaccaacaaataacgtgaagggggaggggagggctgcacgcgttgcacgagagacatgtctctcacggctggtgaccatggctccaccatcaagtgacctcaggcttgtcggggcacctgtaccctctacaacgtgtgaggagcccagtgagatcacaacctcagttgaggtggagttgcgaatccaatgtggtgagccggagctagtcctacgattaccatgagctcctcctctgatgttggttgcatgaggtagtgtcgtcgccacttgcttcagatccatcgcccacgcgacctcaccctttacttgctcgagctcctttgcatgtggatgtgagcttgcctgggtgttgccttctcaagctagtgcctgaaagctggcggcgatgcctagatcgagcatggacaatggtgtcttggccgtcgctcaagtccaagccactgatactagtgccaacctcgttcttgtcgtcagccgccgctgtagctccctccccacctccctctcctctgccaccactcatggagaagaggatggcagtggcaatggcgccaccaatggagaaaagaacaaaggtggcaaggcaacacggtcaggtgacacgtcagccctacgatgtggcgtcctaaaatgtcatgggagagctcatgtatgactcattggcaaaaaaaatcctaattaagtccttcatagggtggtatttaaaagacgatgagaaaaagttgaatttcctttaaatttaaatttaagaattcttttttctgacggttggtagaaaaggtagctagggctatgaaatttcatacaaacaaaagataggaacctttcgatagaactgtacactacctatgtactgtaagatagctaatcgaaaggggtagcagctttctatgaccatgatttgtatagtatagaagactaagtaagtcaaagatacagtactgatcatgacattacttaccaataatcaactgtatacgtgcacgtggtactattatattatttcgccatttacctacttaacaatactaatcgtctttgtctatactaatcgagcacccaacgtttgtcttaggggctgtttggatagtgacagcggtttacaacaccaaaccttaggcacaccataatttcttagggtagtgtttagttgagttaagccacactttactagcacattggtccacacgtcatactcttattttctagccaaagtttgctatagttataaccaataatttattcactacattttgtgtggcttatcatagttatgataaatagagttatgataaagttagtatccatccaaacaacacgtaaaatcgacaaatcgccgcatatcgcactttgctgggcgaatgccacactacaggactcagccgaatatgtctgcagctatcacaccgaaatatcaccccaagatgcccacgaaaaggaccccgctgcgcgtagcggatgatgagcgacgcgctagcttttgcccctcccctcccct

SEQ ID NO: 61027 - DNA, 3781 bp, Oryza sativa
  unsure (1)..(3781): unsure at all n locations
cagaggggttcacgtggcaatgtgaaagtaaagtagggaactcccatgacgtgctgtgggttccacatgatgtagtaggtgtgaaagactgtgtggggtcaaccaaaggcggaattgttgctcgctctgcccctgcccctgcgtgaacacgttggtgtgcagcgtgtacggctcgccggtcacgttccccaggaactggaagtcgatctcatcgtgggtggaaccctccggcgtcatctgcagcccaaagctcagaagatcactcaaaccatcagcttcattactccactttagtgccgtttttttgccgaatttggtagatgaataaatgatgaagtgatgagaccgtttgggaaggaagataagcttacgtataaggtggtcccggtgccggcggagttgccgggaccgagcttgatctgcatgtcgatcttgcctaagaggtactcgctcttggcctggaacccagagccgaagctcctgtcaagcgtaaggtggagcccacgcccaccattgtcgatcttgccgcggccctgcccccacgacacctccgcgtcctggaagaagttgcctccatgcgcaatggcccccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgtacacggttaaagaagtaaatgcggcacggagcgcgtcgctgcagagcgccggatagatttggggcgggggcgatgcatggctggacgcacgctggatccagccgccgcgtgcctacgccggggtgtgggggccagagacgcgggggactttacttgaccacaccacacccatccccgggggggcatccgcgaaagcggtaacccgtaaaccgggcaggtgatgcctgccgatggacggatggatgcgagtacgtggtaaagtgtgcagcttttgtggcgcttttgctcggctttgctcgcggatcgtacgtcacacggggccgcggccagcctcggctttacagttcatggcctgcagtgcagttcggttcgcgcggaagcagcagatcgtgatccggacggacgagccaacacgacggcattgccgccatgtgcgcgaaggcctgcgattcggggaaggttcgcctggtttgccccatgggcgaaggaagtggcccggccattccatccagggcatcgacggtcgatgcacatcgttcgtacgtactgtacgatgagcgagtgatttaattgcggtcacaaatcggtctcgaggacgactgttgctgctggtgagagtgtaattgcgcccttgatgtgtctgttgggagtttgtgttttgtgacagcggattacacgctgtgatttactggagtagtggtaagttttcaatacctgaaaggttacgttttgattgatcgagttcgggattagtaaggacgacgtccgtagatgaatcgtagctgggctctttagtactccgacatgatgccgttaggtacgggcatgttgattacgacacctctggccaaatgatgaacagagtcgccattggacttgtctaggagggagacaattgattctctggccaaattcttgcgtcactcaaccctaaagatggataactattttttttaacacctaaaatgattacacgtcaatatattagctaaagctggatatagacctaacccgctatatgtaacttgcactgtggagcatgcagcttatactgttcttgatctacgtggcatgtgaagaacgataaaacttggtggcgcgctgtgagtggccctagattgatgtgaagtggctaaggctcgcgagctagactagtgggctacaactttcttgcctcatgattgcttgttatgtctaacgtctagtcgactcaatcctaatggaggtaaaacattgtaacccttaggaaacagcatcatgatctaagtagttaaggcctaagagtatccccagcagcttatccaaatttgattctcggtacactcatatggatggccatcaaaaaaagattccttcttcatatccttctcactccaatagatcatttatatttcatactccataccacatcctcctatcttttactaatatctttcaactaagcatatatttgtattattttctaagggctatattttgaacaactaaattttaatagttttattttatcacggtaatctaaatggttagattttaacggacatatttctaatagataatttagtgcattaaattgctactttctctaaaattactcagactatgtttctcttttttctctacccatagtctgccttttgcccattccaatatattccaaccttttctatttctccttttctctctgctctgttctacactcttcattctacccaggaagcatgcgtggaggcaaggtggcctgcgagcgcagaggtacggcggcctgtcggtgtagaggcacggcggcctacggacgtggaggccggtgggcgccgaggcaactggagctagcaagatcgatggtggcggccgacgggcgtggaagggcggacgaagatagcagcaaggggcggaggcagtcggcggggcgcgcgcagggccgacggccacaaccggccggcatgaagggttggagggatgcatgctgccgctggcggggttctccttctagatctggtatgtctctctctcaccctccctccatggctacacactccctctacaccatccaccgtacagaaaaatacacatccgaccggcgacgatgacaacataggggaggtcgatccaaaactcctgataggggtgggagctgcggccactgtgatatagcgtgaggagagagaaacgctatatttgggcttcctctctccgttttggcgcatcatctatttttgaagggctagatggcgtatccactggggccccgtttttcactcccgtgcactgtatctcggacagggtatccgatagaggatctcctgatgctctaaggctattcccaacccaataattagaatgatgtccatagcattaaataaggtgccacctaggatgaaaaatgatgtggcaagtgaataaatgaggaaagagaaggaaatcatgtctacccaatatccaagacatcatgtgtgataaggagcattaaatttaagtatggaatagtaatgcttgtattaaaagagtagtgtctagtactaatttcttgatgatgtggagtttatagaaactatctagtgttttgggttgggaatggtctaatggggtgtaagagtcgaagacccccgttgtccgtacgaccatccgaaaatgcaagactcccaagtcaagtcctttaccacgcatagcatgcaagacttgtctgtcacacgacgtgccacgatggaacccacatggcatatactgcttcttttgctggagatctcgtactatacaatacacctggttccagaaacttcacaagaaatctagctggccatggcataagcaaacattcagcaactgcatccaataaaatccaaataaatacttccacagtggcagcactgaagaacacctcggcatccaggtggcgagtcgaaatntcaanncacact

SEQ ID NO: 61028 - DNA, 673 bp, Oryza sativa
ctgaaaatgactctgtacaccacacttgcaattgctacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaataattctcagtgcaatt

SEQ ID NO: 61029 - DNA, 13407 bp, Oryza sativa
gaggcggggcaggaggtggaggaggaggaggaggggaggcgtcctcctgctcgtcttcctcctcgtcgctgcacccggcgaagcggcaggcgacggcggagcgcggcgcggatctggaggcccgccgcggcgccgtccgcgcgtggggcaaccaggcgctggcggaggccgacccggacgtgcacgcgctgatggagctcgagcgcgaccgccaggtgcgcgggatcgagctgatcgcgtcggagaacttcgtctgccgcgcggtgctcgaggcgctcggcagccacctcaccaacaagtactctgagggccatcccggggctcggtactatggcgggaaccagcacatcgacggcatcgagcgcctctgccatgagcgcgccctcgccgccttcggtctcgaccccgcctgctggggggtcaacgtccagccatactcctgcacctctgcaaacctagctgtttacacaggtctcctcctgcccaaggaccgtatcatggggctcgagccgccttccggtggccatgtcagccacgggtactacacaccaagtggtaagaaggtgtctggagcatccatattcttcgagagcttgtcgtacaaggtgaatccgcagactgggtatattgattacgacaagcttgaggagcgggcaatggatttccaccctaagattctcatatgtggtgggagctcataccccagggagtgggattttgcacggatgaggctcattgctgataagtgcggtgcggtgctcatgtgcgatatggcacatatcagcgggcttgttgcggccaaggtaaataactaccataaaggatcatttatttatgttgtatgaaatgtagcagaattactcaaatcacgactgaaaagcctagttgttagtatggtttgctgctagctgcccagaaacgtgttgaagaagagtttcaatctttggctaccttcattacctggctatctgttaagtcctgttgatttgaaccattcaacatcacaatgcaagattttctttatcatgtttctaatgtgacgattaggctgatactatagtcctgatgaaactattttgcagtcagttatcaatgtatcgtattcaaactgagtttgagcatagtaatcatagaacatttttatttttagagaacctaaggttacatttctagtcatgttcacataagttaaagataactactacagaattatattttctgtgagtcaacgttgatccatgctagttctgggattttcccctggtgatggaaatcatgctgatgaactaagttactagcacatgttatcgctattaaccacaatattcaaactgagttgatactgtagtcctgaagaaactattttgcagctagttatgtatcatattcaaactgagtttgaacatagtttatcatagaacattttgatctttagggaacctaaggcaggagtaacatttctagtcatgtttacatctgttaaagataactatataactatattttctgcgagtccacatcgattcgtgctagcttatggggttttcccctggtgatggaaatcatgctgatgaactaagttactagcatgtgttatcgttattaaccgcaatatcttatcaatattcattccattaagaaactgcagtctccatgtacgtcttactgctgttttaatattaatacacaatataatattttcaaagcatttttcaatgtcatttttatatggcaacttgagatagtttcacatatatgttatgtcaaactttgagaatgatgactaggttatacatttagaaacatatagaatagcttttgttagaattatccttaatcagtttgttgcatttttcatgtttgcttagatgctacctacacttgctactcttcagaaatgttttatttccttaatgtgtggcatcattgtgtgaagccgggggtctgccccctgaatcaaaataaataactacaaaagttcttagttggttctactgctaaatctagctagttcaatgttcttgatgttcatattgtaatagtgatattgttgcatgctccttactgttgcgagattcttatttatacaagatgctcatactgtggttgctgagcatttattgactactgacagtttatttcttgttaacttttgcaggaatgccgtagtccctttgattactgtgatgtggttacatcaactactcacaagaatctgagaggtcctagaggtggtataatatttttcaggagagggaaaaacttaaggaggcgtactggatctttttctcaagcggatgagaatgattatgacttcgaggacaggataaattttgcagttttcccttcaatgcaaggaggaccccataataatcatattgcagccttggcgataactctgaagcaagtagcaacacctgaatacaaagcatacatcatacaagttaagaaaaatgcccaagctttggcatcagccttactcagaagaaaatgcagattggttactggtggcaccgataaccacttggtactttgggacctcagaaatttaggcttgactggtataattctgcctactgttttcttaattaatctgtttgtaaacttgtgatcagggggtgtgttaatttcatagtgggtgcctggaaactgaaatatctctgctatgctaatgtagcttagcacttagtttttggaaaaaaagtctatacgtacttagtttttcttattaaattcttactaactctgacgtgtgtcatgctatgagtacatctagttatgttataacttccatctagataaacgaaacggttgatatcatcgtttgtaagagttttgtaaaaaaaaatccattctttaattgcttaaagtcatgtctctagtactattgctctttgacactttatttctacaatttagatgtggaaatgcatgtggtttctaatgtattgtgttcaaatttttacaggaaagaactttgagaaggtctgtgaggcatgccacatctccataaataagatgccgatatatggggataatggctcaatatctcctgggggtgttcggattggttagtgcatacaccatggctgttttttcttactgttttgtcatttctacataaaacatagactattgtattctacttactgtcatgttacatacaggaacacctgcaatgactactagaggttgcttggaagatgactttgaggtgatcgcagatttcctcatcagagccacccaaatagctagtaatcttatgaaagaacatggaaaaatgcagaaggaattcctgagaggcctacagaacaataaagatatcatagaactccgtaaccaggttgagaattttgcatcgcagtttgcaatgccaggttttgatgtatgagtgtgcatgtatgtgtacatatcttggtgaggttgtccagattcatcaggaattagcaaccgtttcactctttgccgaagtgtttctttcaacaggagcagaatagggaaagatcgttttttcttttgttggaaattggtcttgactgaagctgtacatgcatacttctgagttgtcatttatgtaacgtattgaaccttcatataacggctttgtataggagataattttcctccatgcgtaaggatcttaaatctattttgtgtttatgtctagcctgaactgtattgatccagatgttacagggtagttgtgatatcagtagctgacttacgtgcgccctgcctgcatgttgttgttgataaccagaagccctgaacaaccaagacattacagtgagactagtagtaacactatcagtatagcactgacgcattgacaataatggctgtcaagatctgactatttgttgtactggagtactcctactcgctaaacgctgtaagccaagcacagtgcaggttgcatcatggtactcccctgttcgctgtatagggagaaacccatcatgaagatttggtatagctggcatgttaggtaggagtaggagtaggagtagtagcagcctaattccggttgcagctgagatgggttatcatctcctcttttgacccttgcctgccgcctccctcgctcggttttgtttttgcccgtacttgaccattgatacgcttcttttcggccatgatttgcttcgctccggtttgttgccgatccatggacatcacatcggtttgctccgtttttcctccgtgcaaatgatggtgtgcggcgtccgatccatcgatcgatcgcccgatccggggggcttaaggcgaagaaagccacgacacaggtccttttcttcaatgcggagcagaaagcggcgcagcttccagctgccgttccagaacccctttaatcattgcgaccatctgctctgcttcttgggacatcaatccaatcagacaaacaccaaaagccggaggagtagactagcaggtcgcagctgcagtcgcagtgtgtgttgtgttttacactgatggtgttcagttgctcatctctctgactctcaatcactcctcccgaatcccttttatctttctgggtgtgtttagttcacgccaaaattgaaggttggttgaaattgaaatgatgcgacggaaaagttggaagtttgtatgtgtaggaaagttttagtgtgatgaaaaagttggaagtttgaaggagtttgaaactaaactcggcctctgtctagcatctctcctgattagagacaatgaaacattagttaagctttccttttgttgccttttcttttctcattgagggggatataaggaatctaaaccccttttctccccctattcttgttctagtggagtccttaatgatgacttatgaggaagtgagctcgccactaccagtaaagaactgatcactaggtataagggacaaaaacaattgagagagaaaagagggcgagatcttggcatttcacacttccttttaaggtcttctcgtttctcagtatcaagtttcacagtgattgattaatcacctaacctagaaaaagaagttgctgatagcaaatggatgtgtcttagcatagattcatcagtcatcacaagggctttttaaggtttttggttcaagcctatcccaattcatgatagctgacagttctaatatgaacaagagacaattagacatactcacataccatgtcattttagtatctattttaaaatgagagacataataaattactccctcctttataaattgatcatcatataatagaatctaaaatttctcaaattgatcattgtataactatatggacaaggattttataggaatacaattaatgcagtatgagagaacgtgtgcgtgctagggtatactcttaattgacatggagttttaatcgatgcatacattatgagagaatgtatgcataatatctttattgatgtgatttaaattatacttagttttggtgtataaacttatacgatgatcaatttataaaggagaaagtagtatggtagacgtaattctcatgcagatgcttcatgcttcccatgagaaagaaagaatgggactcttgatgctgaagctggaagctacggtctactgggcgtaggagagaaccaaagtttcggccatttttcgcattatggtagaactctgatagtagcccgacctacggcacgtctgcctccccaggcgaacaaacaaaaggcgaccccttccgtcgtgcaactgcaactgcctgtgctactcctgcaatgcaacaagaaagatttcctttctctctcatccccatcatgcctctcctttcatggcacctttcatggcagagacgcagcaacaggatggaaacaacagcagcagcagcaacaacaacatcatgagcaaaatgctgtgacagcgacacactctgtctcatcgagtaccactaactactactcgtactcgctactgaagattatgcttgctactactacgtacagtacgagtactctaccacgcgaagcatgaagcatttcatgccatcatccatggcgatgatgatggtgttgcagtcgatcgatcagtggctgcaaaggtcggagagctccttcctgccctcgacaatgtcgtcgaggaagtcgtcgagctggcagacgaggccgtcggtgccggtccggagcacgtcgagccacgccttgagctcgtcgaccttgtccttgacgccgccgtcgccgtcctcgcactgctgcttgcgggggcccgccgccacggcgcgctccacctcctcgtgcgccgcctccacggcggcgcgcgcgcaccggaactcgtacatccggatgcccccccgcgccgcgccggcgctaccgtcggcgtcggcctcctccgccatcctctgctgcagcattgcgatggacgccacgaacccgccggcgtccgcggcgccatccgcggagcacggccccgctgcggcggcggcgcaggagacggcgccggaggcgaggacgaggagcagcagcgagctggcgttgtgcagcgcgtagagcaggccgcggaagccgttgaagccgctcaacctggcgtccgcggcgcgcagcagcagccgctcgtcgagctgcagcgacagcggcgcgatcctcgcctccgacagcgcacggttctcctcctccgccgccatggcctccctcctcgacgcagagatcgccctcatcacctgcaccgatcaaacaaatctccataaacacaaaaaaacagagcatccaacaaagaacacatagtagcgatcaatcgatcaaacacacaaacagagcaagaaccactaatggcgtgtcgcagcacagaaacaaacacgtttcgcaaccaaccaacctggcgagtggagagaggggaagggtcctggagccagtcatccatggcggccgcagcacaagacgcggcagcgcaataccgctcgacggcggcaaggccgaccttgacggcgaggcaagcctcccagagccgcgcggtctcgtccatgtactcgtcgagccaccgcccaccgggcggcaggtggagctgccccaccagcagcgtgagctgcgagtgcagccccctgagcagcgccgccgcccgcagcagcgccggcagcgacgacagcccgccgccgctgctcaggtcgtccagccctctcgccagcgacgtgaagaaggcgttcatggcgaaatccccacagcaagaaagatcgaacaccggtcgatcgatgcgtctggaaggtcgagctccggctggctatatatagcgcgcggtgcaagaagggcaaggaggagacgatcggggaggaggaggaggaggcggggggcgtggaggggcaatgatgggtgtctagacgagggggagaagggtgatgatgaggttggggggaggcagaggcacagccatggctgatgtctcgctcgctcgctcgctgctgctcgctgtgctgtgtgcggtgctctggtctggtctgtggctccgcgcgcggcgtacgagcggggcgcgtttaatggctgcctcctcgcgacaccgcgcgttgccgggtttccggaggaggttaggcttaaccgccgtctttcttcggtttcactgcggatgttgtgggaaacaattttaatttctagagggcatcctcgtatttttaaaacacaacagaaacataggtaatcataaaacacgcatactcatcgctataaataaacacgcacacaatacatctataaacattttttaaaaaagttactgtatatacgattatgtagcgttacacaaccaaatcccatggtattttctagccgtttctaacgaagtaacacgtgacattcactatctgttagcaatcgtataattatcgtacatataaatcgtatacatagcattttcgatttttgaaacactagaccgacatatcctcgtcaatcatgaacgtctcactatcgatgattacgtcgcctgcaccgaaagaatatcacccatcttaagcctagaactttaatgggtgatttggttccgtcacaagaaaactaactagttaaactacgtttagttcgctagttatttacatattatcaaaataattaggaaaagtataaaaatttaacgagatcaaactccataagcctacaatattaatcaagttaaattttagagtggcatatcacatattaatatatcttgtcagttttaaaaaatattttataatgcaaacataatgttactagtagagttcaagatccattccccatgtgtttttagccatttctagcgcgtaccgcaggggggcgttggtgggggaggttgttgctccatggggtggcccgcctacggtaggggggaaaaacatacctaccagattatcagcttttggtgaaatttctccaccggaatattgcgctttctgcatagttcagcggtcaaaatggcatggcatggaacgtccagtccttgactacggaaacaaaacaatcgagcactagaaacagtcttggagagggacttggtcgtgtgtggtttgtatggttcactgaacttggagagtatagtagtagtagacttttttttttggcattgaatatttgcaaatagttcagctgctctagcgatgccattgagtggttatgttggctaaaatgtcaaaccaactgcacattgtagccacctctagttacagttaccaaggattctctcatccatcctttagatttttttgttattctttcaacatttgttcatttaaaaatttgaaaataaatcgtccataccaaccaaatttaaggccaaatgtcatgccaaagaatttttgtagcgcaaaaagccaagatgtggcgatggtgatttactatactattgtggagtaaccaaatcattaccacaccatagtttttaacccatgtggtaacattgtcttgtcatgccactaaatattgtcactttgattatgttgccacctactgacttgactcttagcatctgcagccccatcgtttggctttttccctataaaaataaatttatattttatatatgtgttattggtggcctaaaagctaatactgaaaaagaaactataataaaaaaaatctcaaaattaagtttaaaaatttaaaaattgcctttttttggctgattaggccatccgataggagcctatttgttggtttgcgcagccaagatttaaattttaaacttaattttaagttgaatttgggatgttttctatcattgtctatttttcaataccgtcttttagtctgtgaataacataatttttatctataaatcatttctgattgcttcgttcatacttctataacaaccaatggcatggaccaggataacaaataagcaaaagccactatatgaagcggcaaaatagaaatatcctttttaacattatacaaaaacatcaattttttttaaaaaggctcttttccatagaggaaaaatatattattgctgtgaggaatatagagttttcagttctctcagtaaaaaaaactgtttttctatagcttggtaggattaacttattttagccacagggacagatatgatgagtgatggtgcaatttaattaatgagttaattttactttgggctatgttttattgccaaagttttattttggaccaccatttatctaatcttttcactttggactaggtaactttacctttgtcgcataatggaccaccccaaaacacattttcatttcttcgatgacttcgagcaaattgttaacgacataccagcaaactttcatatctatatgcatgatatactttgtcgaaagagacgctagacatcacaagcgaaaagagttagggttgtccattgtgcaacaaagataaagttaactagttcaaagtgaaaagattacgtacagggtggtacaaaataaaactttgataataaagtacaattcagtcttaatcttatttgtcacaacaacgcagatagtacaaagtagaggcaacttgttctgcttgcgaattgtgaactgcatcagtattctgcctggtactacaaatatcatcagaaaaagcagtttcctttttgtaggttgtggatcacgctccgacaacacagcgtagggttaaattaagctatgcgatatttagtaccatcaatcccatcagtccatttgacatcccaagcatgcgttattcgattcaatcttatacctccctttcctccccctttattccctttccaactcagagatgcaaatcttatcctgccaaagccactacatatcatagctcactcgaattctcttctacagttcatcccaactcccattagcaaggagctaaagatcttcactacttttacaccaacgaaaaacaattatactcattctgtatcttcagacaagatcacaagagtccagagacatctagtcgaaattattgcaatacacgaacagttacctaggtaaggctattttgtacttttatagaattccagtagaaaacatcctgagctttaaatcatgcactattctcctgtttattcgggttgtcaaattgaccccttttttgtttcccctcctttacatgaacagtggctaatacttcctccgtctcagattacaagacgttttaactttagtcaaagtcgatcaaattgtttcaagtttgattaagtttataaataaatatagtaatatttataatactaaattagtttcatcaaatcaataattaaatatattttcataataaatttgtcttgagttgaaaatgttactatttttttctataaatttgattaagtttaaagcagtttgattttgaccaaactcaaaacttcttataacatgaaatggagcgagtagcaaattaactggcgccattgtgtggcatgatttcagcgttgtctgcttgccatttggccgtctcagtaagtttcagacgaagagttaactgtcagggctagtgtactcagatcaccactccctgctcagagagggacaattacccgacatgcatgggattagcatggttttcggtctgagcagcgaacttcttgtgatgcgcctttgcgcctttgtgttcccatcttgtcaagcactgaaagatgatcaatcctaatcctgctctttgtgcgcgtaaagcctgtggagacacggcaaaacagcctcgtcgagcagggacatgaatgatgataccagccatggaaggtggtcatggcagctcccaagcaagaggacaaaaacggaaggctttttcttcagaaatgagaactctgaactctgaatgtctgaatggaacttctttgtatgctgcataatttcttttggaaacatctgaaagcagggttgtggttaattaaaaaaccggtctactagaccatgaacatggaacaggagcccctagctactatgcttaccgtaaacgcatgcaagaaacacttttgtattgtcacctgctgtaatgagacatctttgcaataactacagcaatttgagctaaaattggtcaacactatcatgcttagggtccccaaattaaactgcacttttgactaagaattggcagaagctagcggcagcaaattgttcctttccattggacatattccccaactcattatttaacgacgcttttccattccacttgatacgctagaagaaccgtgtggtttatcatatctgcaaaccaaacggatgcaatcgctaatcacatggataaatcttcgcaaaagggagagatttcgggtgtgtgcgtgcgcatgcgttgttagagctgctactcgtgggatcttggagaatgtgatgcttgtagaaagaaacagttaaggggtataaacaaatgctggagaagcaaacaggatcctaaaccgtgatctcgcgtaatctaatcacggtctattgtatcgccaacatgtgataggtgtctagaagcttgcattttaatactaccggcaaagcttgatttgcctctgctaatgtgatccaaacatgataaaccggttttgtatccatccctgaattaggtattctcttgccttctgacagtgtgatccaaacatgattatccggtctgtatccatccccgaattaggtactgtcaaatacagtgaatacactattgtcatgtgtatgcattctgaatataaaatagcccaaaatgtcatgtgtgaccaagttttttatgaagaacacatgagcaaatcagcgtgcattatacagtggagtacacttaatcctgcatttattttgtttgctaaggagacagggagacgatggagttggaaggcatgagatttgcgctgcaccaacccacatggatgaaggattcaagggggacaaagactgctgctgagcctcttgagtgagtcccatcatggtcactcatggcagtaattatggccgcaattatgcctgcccaaaagcccacagggcgggcagggccaaatgcaagtatgcaaccgaccctaatggaggggattagcaataatttcctcgtttgatgcttttgaccaccgatgatatcagcactaatcacaggggtggattgtacacaacacactacacaaaggccaaagggatccatgcatgatggtgctgcgtttgtagggcactcggcctagacagaacccccgaaaaggctgcaaaatctgctgcagctgcaatgtgagctgagagtgaggccgatcgagctcgagctcgagctcgagctctcctctccccttcgattctttttggacagtgcgtgagctaatggccccggcctaagctctcctctccccttcgattctttttggacagtgcgtgagctaatggccccggcctaattcaatagggccagtatttaatagtacgggcagtctctttttccctgcagggcttgtcttggccggtgggtaacacaatctcagaatcagtactgctaatgatccgcttggtttttaataccgctacaactactagcactactattcctagttgcagaacggagagttgagctaggctgtaaagatcgcggagcacgagtaattcttgcttggatgcatggacagatggatgcgtgtgtgcatgggtgcagctgcagtggcgccgtcatcatgtggttcaatattggggcgagcgaaatctatcatttgtcgggccgacacgccagcatggacggatcgacggacgctggctggtctcagccgttgctcctgcagcctccgcgtcgacggggcggaggaagacgagaacgagacagcgagtgtgtgcgcagccagccggccaggcaaggcatgattcggtccggtctggctggctccgatcggcagcgcgcgcgcgcggcgctgtcaaccatgtggcgctgcgcctcgcggggaaacgacacggcgcgcgcgcgcgctgcgtgacgcgttcgtttcggttgcatgcgaatcgcggggcggatcgatcgtgccggatttgagtcatttggcgggggggggggggggggggg

SEQ ID NO: 61030 - DNA, 53084 bp, Oryza sativa
tgaaaaggcgcttagtcctcacaacaaaaaaaactgcagcggaaaaataaaatctagcgaagctccggctccacccccataggcagctcaactcgggtataagtcaaacgtcttctccttctggatcatttttcttcaactgaggttgattgattattgcaaggcaagtcacacagatcccaaacacgattcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgctatatatatacttgcttagccatgcctagaaacattagttcattaatgggatgaatcctactacattattatttatggttatatttaggggcaatttcgtttctgcccctaatttgatgtctaatattgattttacccttattttttagggttttcgtttttaccctcattttttttaaccgaacgcttgttttgcccttaccttggatgataaaattaacggtgttaagtaattgacaaaatgacatttataccctctcatgtatgttcattaattgtgtttttgccctcattttatacatatagctttgaaactttatttttggagtatatttaaaactagatgatgcacattgactaatataacaatttggaaaaattctgtatttgattgaattttgacaaaatttcagcattttgatagaacttaaacaaaattttggcaacattatgtaaaatgtaattatctgttctctttagatattagtcaatgtgcttcatttaattttaaatatactcacaaaaataaagttctaaagctacatgcataaaataggggcaaagatataattaatgaacagagatatgagagggtataaatgtccttttgctaattacttaacaccgttaacttaaccatccaaagtaggggcaaaacgatagttcggttcaaaaaagtgggggcaaaaacgaaaaccctaaaaagtaggggtaaaatcaatattagacaacaaagtagggttagaaacgaaattgtcccttatatttaatggtagctcacgatggttaatcgtgttatgataattaattgataattaaaacttgataatggtgggttgtgagcacatggttttgaaggtcgtgctcatgacaattaaggaccagtacgcgagctactgttgtgagacattaaccgtgccaaccacaagccagcgtgggcaacggctttaccttttgtatagtatggtacattgcggggcaccagactgtgaagcggcgagaagtccgtgggggtcactgggagtccacgcctctggttattgagggggtgattatgatccaggaatggtgcactgtggtggattgtgttgtgcaaggggtactgtcacagttcctatctgagatatcgtggtggtattgaggcgcatggtaacatgttgtggagctgtgtcttgtgggtacagtggtacatctctggccagagtaaaactattcgaatagccgtgcccgtggttatgggtgagttgagcaatgttttcgtgattagtctcatacctctcacaataattattgatgcaataattggtaataatttgcttagctcctggttcggagttagatctgtacagctcggtatggttgttcagaatggttgggcctgagcagcatgggcgtgtgttaacaaccaaatttggtaatatcggcatcgggaaagaagattagatcgaagcaaagtcggaggcggagatcgagttcggaaacatagcaggaatcggctggagtccagttcggctacgattaggatcggctgggtctgagttgggctaggtaagccgatgcagccgattccgacaatgcaacttgatgaatgacatcgggttgaattgaggtgcttcaaggtgattgctgcacatcgatagagtcctgagaaggcaattgtatctattaattaagatgttttatgtaatttccttagagatatgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggcgcatcgccaccctttttgctttagttttatttcgacgagttcttactttcgggttgagctacatcggtttcgatcttcaacaagaggtaaaacttgttatggcggcttgcgttttcgggattagtgcttccatctttatgacactctaatcttgtttatgtaattcgtcgagttatcatatatcctacataatccttggcaatatcgatatctgacctataatcggctaacatccgtcaatagaaggcagccgattaggttaaataccgatgtttacttagattatataggatatctaccactctatgacacatccaacagcttgattgtctagatattgtcctccttttcatacttatagctgcatcagttaagtttgatattatgagttgtgattagaatctcaatctctagcccgcttattggttgctgattagggtagtatcggactttcagccaatcttgcctgatttaactactttttatcctatatgcttgattgacatgttaaatctgccctttacgttaagatcttgctgcatttaagtatattaagcttttgtttagtatattctacttgctttaatatcttaatatagagtggtatcggagtattagccgatacatgctagatctatctgatcggctatgctatgaacgtatatagtctcattattaatatatatttcgatctaagtgatttatactgcctcggcatggcgacggatctatcccaatcacttgatttaagtatatatcgatataaagattatatattggtaatatctgcagccgatcgagtagattcagtcctttcttatttattaatgactgccgatcgatgcatatacgacatcggctcaaagataaatgatatgtcatcggcacctcgccgatcggctatcatttatagatttaactgcgatttatttatcaaatcaactggcacgctcatacattcgaaggcgagctttggacctgcactggagttaagcagatctcccaggccttgtgttttctgtcaacacgcttttggcacacctggtgggacatttaagaagtcagccaacaattcttcctcatggccgagaaaccaccaccatccccagctagcccaggctctgttaaggaaaagatgctgaaattagggttggctgacgtcaatgaaggaaatgtcgtgccgatcgatccagaaaaattcacacctgagcagaagaaagagtttgaagcaatgttgcagcaagcacgggatcagtgcttgaactcattcatgcagacccgcaaggggacacttgttcagaagtacaaaataaaagtggttgctgatgatccggggaccagttcttctaaggatggagatgggaaacaagctccagacggctcggctcagctgagtaacaaaagtgctaccgacagctctctaggaaatcaaggtgacaattctcaaggagtccatggagtgcaaggtgacggggtgcatggagttcaaggtggtggtgcccgagggttgcaaggaggggatcttaatcagaatagtgatacgacactgtaacatacccaaaattctaggacttaaaaatttgttgtcaaaattgttagaagataacttctccaattttgagagccaaaaatttccgttttaatttaggtgatgaccaacttaaaccattgcatgattaaaatttgagaacaaaataaaaccttttcattcccagcattagactagaaatgtcatcaagcatttgagcatacatgtgcataatgcatgcctaggcttgagtccattgtgcatttggttttggtatcgcttttcataatagatctcatgagcataaactaaaagggttaaaactactaaacaaaactatagttaatattgggtgataacatgtggacttaatattaaattctaatatcattttctcagcccaaaagaagtttaatgtaaaccctataatagtattagatgcaattatgaagtaggaacacatattcaaagaaaggttattctaattctttagaataatctatgcaagaaaaatcatggaaaaatttatgtaaactatgtttagctcaagcaattcactataatattggtacaggttaataactaagtttaataccacaaattaatcagtcaaagcagacaactaaaataaatcaaattaaactttaatcggctaaagcgatacttcatccaaaagtatatttaactgcacataagtgaatatagaaaataatttattcaaatactagattatttatcatgcctaaatataatttttctagaatttttctcctctgtttaagcctcctaaaaattcaatctagatttctaatagcccttctttgtttaatttctgtgagcaatctacccattatttttaagtgcaaccaaagaaaatggaatctacgtgtaatcatttacctccagtaaaatcaacactaattaatttgatcgacacattaaattatggagttacaaatttagaggagaaaataattccgaaaattaatctaaaaatcaagtttacccagtcttctacccatatctctctccctagcctagtttccatcgagttggccccacttgtcagtgccttaggctagctttagccctgtccatcacttcctccactgctccagccgagagagggagagattgagtgagccgacgcgtggccacaacgtgtcgtcgatctcggtttcccttttctcgctctctactcctcccagacgcgtcgccattctccattcaacactcagagctaaagaaaccgagggaggaggttctctgcctctccatcgctccaaaccttgccgccggccatggagacgacgaccatcgccatctccatttgagtcaaggtcacctccatctctttcgcgttcccatctctccacacaatgccgagcatttcctcttttgacctaaacccctctcgtgcagtgcatcgccgggaacgcaagccacgccgacaacgccctggagcacgcaccggagcgccgccgcttcaaccatcgtcgtcgtccggccattctcgaccacctcggagcaagccgctgcgccatcgtcatcgcctcaacctcctcttcaatacgcctcaagaaccccagctggagatgtgaaggactcggagaacgcatcttttcttcaccggcgccaatctagaatcgcctccgccgtcatcgtcgattaccgctgcctcggtgagccattgttcgattcctcgcacatacaccatctccttgacctcacaaaccttgtgcatgcttgcttgtagcagctcatgcgagccgtcgtcgttcacccgaggaggagtgccgtcgccgagccgttccacaagtcaccactaccgccaagaccttgacaaccctagctcgacccatggtgagcattctgaaggctagaagaccacatgcatgcatcctttttgttcggaatcgacttccatccacacatgcgctttcaccccaagaaccaccgccgctcacactcgccattggcgctactccaatgtcccctaaccaagaaaactagaggaatggaatcgcaagaacatgctcttcatttatcttttaaccccaactccaaccgagccaccaatcgccgccggtgaacccgggatcgagctcagccatggctgctctgcctctgtgcgtgtgaaaaaggagtcagggacttcattttgagaatttaaataactataaggttcattacgtaatgttcccaatcaatgacatatggacctaggactgcgggttgagttcctgaaaccctaggggcctttttgcatattggcctgatactgacaggagaaccccatgagtttaaaatctgaaaaaaaatgtaaaaagataatactaaaagttttgtattttcaacaggaaagcatgtaaacttataaaatccataacaaattgaaaacaactcattttagaaaatccataacaaattgaaaacaactcattttagagtaaatcaaatttctgtgaactcaccaaatcatgaactttagagttattgcataaaactacattcactgtacaaactttgtctctaaaattggtctaagataaatcatacataaagcatacacaaacttataaaatacatagaaaattcatctcaactcattttgaaacaaactcaaaaaaactgcagattcatcatcatgcactctctgattaggtgaaataaaagtaattacttactttgcatcaaatgcctctaaaactattatctctataatgattagttttagataagctaaactttagaaattcatgtagaacccaatttagcttcaatttgaataaacttaagttctgtaggatcaccaaaacacgtatttccatgttatgaaataagattatatacttactgtgtgtagtaaaagtctctaaatattcataaaaggatttactaacatagagcaacctttaatttggcaaaacttgtagaaaattcatttttagtccaaatgaaatgaacaaagtttccatagaactagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaacaaaaacttgattgaccagtaaagccatagttccatcctcatccactaaaacttagaagaacttagctcatatgacaatttctaggttaatataatatattgctagtttagattagagcatctctagcgtataaaatatgaaccatagtagtaaagaccataaacatgtgaaataaaaatgttttagttaaccaaattagtccttttattcaacttaaacaggaagtagcatgttctgaacctacaaattgagagtcatgcacatataaaacactatatgcctaaaacacgttgtaacttgtaaaatctataagaaaatcattataactccaaaaattgtgaaaccaaaggtgttagtcttagaaaacacatctccacactcctgtcaagtctaatataatagaaatcacttgacaaaagtattttataacactacctaagactatactactataaaccgataaaacttctaaaaattcataactccctaatggaataagataaaataaaaattctttcacctaaattcattttagatcagtaccaaaccactgtgcataaataatgcattttagagcattttggatttttagctctttcggtgtttaattgcatatcgtgtcctttatctagataattgcataatcggtgaaggagtggattaggtgctaacatttctctgatcaaggcaagttttctcctcccatcctttgaacacattgaatcccatgatttgaggaatgaaaatgtttgtttgcaaagctgcatgtgaacttagattatatcggtatttaaaattgggttatggtagttatgacctatttgctgcataccccaccttgaataattgatcctcttgctgtttgaacccctagaaatggttagagtacactctttgtgctcaaatgggtttatatatgctctatttgtaactacttgcttagccatgcttagaactatgcaaatgctcattccatctataattaaaatatgattttgatatatgaacctttgctggaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggcctaagctgagtaatctatttaggactagccttgcattctggtaggccggtgtgtatgagttcgtataattcagaggagcttcctatttaccccgacgtggtagtttaggtgactaagtgtgtccaatacaacggtattgtgccacgtggtgggttcctgtcgtgtccgccatcacggcgttaagtttaaggcgtgggcccgtcacttaacggttctaggtatattccaaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagttgtacaaactctgcagagttctttaaactaatcgattagccgtgctcacggtcatgagcgctttggtgatgtgtcatgtgtatagactatgttttaaaaatgtgatcatgtgacattggtttgaaatggataaatgtgttgagttgtgtgtgtggtgatacattatgacttattgttaagtatggcaataagagattgattatgatggaattatgaagaagttaataatgaaacttaaaacttgttttgttaattgaagcatcaacttctttacaaaagaattgcgaaacaaaacttgctttatgctgaacatgaactacatattgccttcctttgaatatatgccttacatgtagtatggtaggattgacttgtgcttgccagtacattaacttgtttaatgtactgactcttgctgttgatataaccttttgtttgcaggtttagacttagtctttgaatgatgcgggtcctgattgcttcttctaggatgagaacttaatggggtaaacccctagtcggtgtgcttgtgattgggtagtcaagcttccattgttctctaataagcctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacgcatctggtcgctgccttcgagtggtttgacgggcacatctcaggctgaagttgactggcaggctaagggcccagcaatgtctccaatattcctctctcgaggcgtcggatgtttcattatgcttgttggatgacttgaattattcacttcatctctcaaatataatggaagatccggagagcctacgacagacacaaggttttttcagtaatttccaagatcgggtcgactacgctgtgcatcatgttttgatcaatcaatctggggtgttagtcaagaccttatcaaacatgatgaagtccatagccgatggttcaatagctgagcatcaggctgcaggcccggtttatttgcaaggaggtgtctttccaaattatcggtctttgattaccgatgttcagccatcaactcaggcggttccctctgttgcaccaacatctcagccgaaggcactggcgtcaattcccctacctgttccgtcagcaatggcgccaggccagccagtgaaccctcagttgttaatgagagagcagccacagcatggtgggcaggttgcgaatcggctgacccaagatcaggttgctgccacgtttctgccgcctcaacctattgttgatccaatacagcagcatccgattcagcagacacccccaattcagcaggttgtgcaaccaatccagcaacaggtcatgcaaccagttcagcaaacaccaccaaggcagcagcctctgcagccgactcagcagacgctgttaagacagcaaatcgttcagccgatccagcgccaaggttcaataggtgcatcggccgggtttgcaacgcctggtggtcagcctgtgcaacaatttttaaatcaagttgtcccagaacacttggttcaccacgtacagccggatggcacagtaatacctcaagttgttcctgagcatttggtacgtaatatccagccgaaccttcataattactaaggggtaacttgaattaccaatatcaacctccttccctgcaagcccaatatcagccagggggattggctcaacctcagtttgcgcctcaatacggtcagttcgagcccgtgcagcaacagtcataaggggtagctcagcaacgaccgtgggctgatgtgattgctgacgtaatgagggaacaatttgggcttaaaccaaaagagacaggaagcttgtatcggcagccttaccctgagtggtttgagagagttcctcttcccaatcggttcaaagttccggacttcttcaaattttcaggacaagatggtgtgtcaacttatgagcacattagccgattcttagctcagtgtggtgaagcatcggctgtagacgctctgaaggttaggttattccggttatctttgtctggatcggcttttacttggttttcttctttgccgtatgggtcgatcaatagctgggccgatttggagaagcaattccacagctatttctacagtggggttcatgagatgaaattatctgacttgacagcgattaagcagcggcatgatgaacctgtgcacgagtatattcagagattcagggagatgaggaacaaatgctttagcttgagtttaactgatgcccagttagccgatttggcttttcagggtacgattgctccgattagggagaaattctcgtctgaggactttgatagcttgtcacatctgatacagaaagtaaccttgcatgagcataggtccgcagaagttaggaaaaactctaagaaggttaatcatgtttgtccgtacatgtatggatcggatgatgacgaggacgattctgaaatagctgcagccgagtgggtgaggagtaaaaaggtcataccatgccaatgggtaaaaagttctagaaaagaggagaagtatgattttgatattactaaagccgacaagatctttgatctgctactccgagagaagcaaattcaacttcctgctggtcatacaatcccatcggctgagaaattaggcaaaaagaagtattgcaaatggcataattttgggtcccattctactaacgattgcaaggtttttagacagcagatttaggtggccattgagggaggcaagattaggtttgatgattccagaaagccgatgaaggtcgatggtaatccttttcctgttaatatggtgcatacagctggccaaacagccgatagggcccgtgcaaggggttttccggtgaattcggctaagattatcaacaaatatcagaagaagtatgacaagcagcaggagaagcatcatgagaaatacgatgatggttttgatcctcattggggttgtgagttctttagattctgctggaatgaaggtatgaggttgccatctattgaaaactgccctgggtgcagtgatatcgtcgagaactcaagccgatcatatgataggggcaatcggctaaggcagacaagagtttctgttcatcaaagattgggtccagtaaatcaagatcatggccaaaaggaccatgtaatcaggaataatcaatggtgtccttctggtattttcacgaagaatcagaagagaagggttcaatgattgaggaacagggagcgccttcaagaggctgaacaagaaattaatcatcggctgaagaaagcaaagccaaggcaggagtggcgtgttaagaatcaggttcctgcagtcgatgatgttgcagcagttgaggcaaaaaggtaggcaaaagggaagagtgttgtgacggcaccggttaacatggtctttaccctgccagccgaattcgggatcgaccaagccaatgttgacgaggtggaagaggaatcgactaagttggttctgtcactagaacaggcagtgttcgagaaacccgaggggacagagaatcggcatcttaaaccattgtatataaacggctacgtcaatggaaagccgatgtctaaaatgatggttgatggtggggccacggtaaatttaatgccctatgctacgtttaggaagttgggtagaaatgccgaggatctcatcaagacaaacatggtgctcaaagattttggtggcaatccatcagaaaccaaaggtgttctaaatgtggagctgacagtcggcagtaagactattcctaccacgttttttgtcatcgatgggaaaggttcttacagcttgttgcttgggagggattagattcatgccaattgttgcattccttcaactatgcatcaatgtttgattcagtggcaaggcgacaaaatagagatcgtgccagccgacaagtcagttaatgttgccagtgctgatttagctctttgggagatggatagccttgattgtttatctggaaaagtctgggatagagattttctaaaagtgtccgattctgatatacagccaattgaagatggagaacccaagctattactttgagggcgtcgtggagggttcaagtgtctacactacggacacggtagatgatctcgatgacaagcatggtcaaggtttcatgtcggccgatgatttggaagaagtggacataggtccaggcgatcggcccaggccgacatttattagtaggaacttatctccagagtttagaaccaagctgatagagctcttaaaagagtttagagattgctgagcttgagagtattatgagatgcctggactcagccgatcgattgttgaacatcggctacctatcaaaccaggggttatgccacatcaattacctccgagaaaagcaaaggcgaacatgcttgaccgggtcaagggtgagatcaaaggatgatatgatggtggtgttattggtcctcgccgaatatgttgagtgggtttctagtatagttcctgttatcaagaaaaacagcaagggcagggtatgcattgggttcggaaaattggaataaggccaccccaaaggatgaatccccattaccagtagccgatcaactagttgatggctgcttcgggacataagattttgagttttatggacggaaacgcagaatacaatcaaatttttatggccgaagaagacattcataagataacttttaggtgtcctagtgcaatcggcttatttgaatgggttgtcatgactttcggcttgaagagtgctagagctacatatcaaagagccatgaattacatatatgacgatctaatcggctggttggttgaagtctacattgatgatgtggttgttaagtccaaagaaataaaggaccatatagcttatttgaggaaggttttcgagagaaccagaaaatatggtctgaggatgaatccgacaaaatgtgcttttggtgtatcggctggccagtttttgggatttcttgtccatgagagggggatcgaggtaactcaaaggagtgttaatgcgatcaagaagattcagcctccagagaataagacagaattacaagagatgatcggcaagattaattttgttagaaggtttatttctaatttgtctggaaggttagaaccttttacaccattgtttagattgaaagtcgatcaacagtttacttggggggcagagcagcaaaaggctttggacaatattaaggaatatcttagctctcctcctgttttgattcctccacagaaaggaataccgtttaggttatatttatcggctcggtcttgattcaggaattggaagggaaggaatgagttgtattctatctcagtcgtcggctcttgcatgctgaaactagatattcccctgtggagaagttatgcttgtgtttgtatttttcgtgtacaaggttgaggcattatctactgtccaacgagtgtactgttgtatgcaaggccgatgttgtcaagtacatgctatcggctccaatattgaaaggaagggttggaaagtggatatttttcttaaccgagtttgatcttcggtatgagtcgccgaaggcgattaagggacaagctatagctgattttattgtggaacatcgtgatgattcaatcggctctgttgaaatagtgccatggactttattctttgatggatcggtgtgttctcacggttgtggtatcggcctagttataatttcccctaggggggcatgtttcgagtttgcttatactattaaaccgtatgcgactaataatcaagctgagtatgaagcagtgctcaaagggttgcaattactcaaggaagttgaagccgataccattgaaatcatgggggattctttgctagtaatcagtcaattggcaggagagcatgaatgcaagaatgatacattaatggtttataatgagaagtgccaagaactaatgaaggagtttcggctggttactttaaagcaattctctcgagaacaaaatattgaagctaatgatttggcccaaggggcatcaggatataagccgatgatcaaagatgttaaggttgaaattgcagcaatgacagctgatgattggaggtatgatgtgcatcagtatttgtgtaatccgtctcaatcggcttctaggaaattgcgatataagggattaaagtatactctgttggatggtgagctatattatcggacgattgatagtgttacttaagtgtttgggtgccgatcaggctaaagatgcaatcggcgaagttcatgaaggaatttgtggtactcatcaatcggctcataagatgaagtggttacttcggcgtgcagggtatttttggccgacaatgctagaggattgtttcagatattatagggggtgtcaggattgtcagaagtttggggcaattcagcgagctccggcatcggctatgaatcctattattaagccatggccattccgaggttggggaattgatatgatcggtatgataaacccaccatcgagtaaaggacataagtttatattggtggcgactgattatttcaccaagtgggtggaggcgattcctttgaagaaagttgattctggggatgcaattcaattcgttcaagaacatataatctaccgttttggtattcctcaaactattacaactgatcaggggtcaatcttcgtgtctgacgagtttgttcagtttgccgatagcatgggtatcaaattattgaattcttcaccttattatgcacaagctaatgggcaagctgaggcgtctaataaaagtttgatcaaattaattaagcggaaaatttctgattatcctcggcagtggcatactcggttggccgaagcgttgtggtcttataggatggcttgtcatggatcgatccaagtccctccttgcaaatttgtttatgggcatgaggctgttttgcggtgggaggttagaatcggctctcgaagaacggaataacaaaacgatttaacagctgatgagtattacatccttatgtcacgattgcgagcccttgcaaaggttaccaaggataaggaacgtattgctcggcattataataagaaagtggtacctaaggatttttcggaaggagaacttgtatggaaattgattgtgccgattggtactcgtgatagtaaattcggcaagtggtcgccgaattgggaaggaccgttccaaatttataaggttgtgtctaaggaagcatatatgttgcaagggcttgatggtgaagtctatgggcgagtgcccaatggcaaatatttgaagaaatattacccaagtgtttgggttaacgcatgatcggctagtattgccgatgcatgacagccaatgtgtttgcatcgccttgagatggccgatattgttatatcgcccttagttgttttttcaagaggtaatcggttgtgatttgccgatgtacaatggccgatattgttatatcgcccttagttgtttttcatggtgtaatcggttgtgatttgtcgatgtacaatggtcaatattgttatatcgccgttagttgttttataattttatcaatgcttttgtcattgtaaaattaggggggcacatatatatcaaaatgcaagaatcaaaattcaagacaaaaatgcaatgcaaattttttgaggcaatttttttgagcgaattttaaaagtcatattaatcggcacaaaggattgtcaagacaataaagtactagagcatcttagctgattacaaaaaatttctgagtcctattacacaaagttattgagagaagtatcgctggatagccaaaatagccctttgcctgattttttctacttcttcaatagcttgggcatcttgagcatcagttccagagatgactttcagagacttggttaggtcagcaacattcttgatagccgatttgagccttgcttttattcttcaattgattttgggagatcggctagctttttgtgttctatatctagctcggcattgcattcttcaagttgcaccaagagctcaattttgtgagcttcgagccagtcaatattggatttgatcggaccttcagatagctgatcaagtttggttttttcttcatgcacaagctgccgattagcttggattgtggcctcaatctctttgcgatcacggcgttcggctagtcttagcttggctttttccagcttgaactgatgttgctcgagataagcggctggagttaggacatcggccagatcttcgggaatcagagcttgaacttcatgtagccttgtcctaattgacccacagtcaactaccaaattgtctaaagaagaggcttctagccgatgagaaatgtcttcaagtgtttttctcacatcatcgaataggggagctagggctttgcttgaagtgtcttcttctgcttcgtcaaggtaatctctgatgtcaaaagagaagagatcagctagtgcctgtagagacaatttcggaaagaataagagctgggtaaattatagccgatctaattgttgagacaaagggaaacttactggaatagcaggagcagctggttgttcttcctcttcgacgtgatgactccccacagctgatggagtttgatcacttgaagattgctgtacaggaggagaaggaggaggaggctgcgaaatagacaagtgttatatagaatcggttgagattgattaattaaaaggattaaggacatctttctggtggaaccgatttaacaattgttgctgctgttttttttcttcacagcagttttcttcttctgcaaccacaaagtctatgggtaattagctgaagagtgaggtaatttcagaagaagtcagagaaaggtacttactcttgtaaaatgaacgggggcagaaggagttggaggcgtttgcttgggtgaagccgatggtgttctttctatgtcactcatttcggctacagcttggtcaacatcttcatcaatttcctcttcatctaaagcttgttcaatagatggatccaaggcgggcagatcatcagtcgacatatcagttggttgtggttgagttttcttgaatttggtctttttctttggagccaaggataaggtactcatggctgatgatctggttttccttttcttgcctgcgtcggctggttccctagttaggccgtgaaggagagttgaagtcttgggggcatggtagccgatgaaagggggagatagtccacctccattcggaattagatctgaagcatattcaatgttcttgacactgttactttgatgaggaggggaggactctgttgtctgcaaaacaggagtaagaggtcagtcaagtaatgaatcggctaactggttatgcaatttagtaatgacaaagtttaccggggcatgatgtcagggaatagatctgtcacatacattgaagccgattgatgaaatagatgcagcttccattcgccccaccatctatcaaagtttttgcttctaaatcttgccaactcaatattatcaatactgcccagagggggtcctggtaggttaagtagccgatccatcattagagtggaagtgatttgtcctcggcactgaatcttgtcggcaaagaataagccgattgggagttggcccaatccaagttgtctggccgagctcattgggtgataaaactcgtaagagacttggatgtttcttccttggtgaataccgacagggaggatgcatgggctgattgcagctataagaatttctctggatttttggaattttttatggttaatatcttcaaatctaaagtctaatggaagttcaaggtctgctgagtcttcgtagggaaaccagattcgtgcatctttcttaaaaccttcgtagaagctgcagaaccagtcttgagtaactcagccgatagcttcgctccagcatcggttggtgtggatgcatattctccatatgacatgcatctgcgatgggtgcgctcttctccatcatcttccacaatcggctctggcaatgggaattcagcttctgtcacagagggccgattgacaaccttcatgactaccaggtttaaccaagtttgcagcagccaccatggtccacctgctccaactattgagccgacggctattttagccgatgcattgttcaacatctggtacagatagccgagaaggattttgcccaaaggaaattctttctttgattctaaggcttcggctacgaattgccattggttgtagagcaacaactggatccacagaagaggaatttttccagccaaataagcaagaaagctacatgctctcgaggggtaacagacccttggcccatatatgccgccacatagccagaccagccacctatgcttttggtcttgaagttgaattggttcttggtgttcatgctcatagggttagccgatgaagttacatctaatccagtaatcatggtgatgtcaattaaagttggagtcatcggcccttggttgaataagaaagcattaatggtgttggactagaagtaggtggcggcagccatcagaggttcatccttagtagaattggctatggtgagagcgagtgcttggccgattccaatttcatcccagtgaactttcttactagccgatacgcgttggtactaggtggtccagctcttatcaggagtaggtttttcgagagatggccaagacttgaaggtattcttccagtgactcaggttagggttggctagtctaaaggggatccggttagtttcaccgatgatgaaatcagtggggtcgagattgccgattgggccaagaaaatagtggtttttgtgtgaaaggctgggaatcgcgactaggttggaaaggtgctgcaaatccaaaggaattgggaagtagaaaacaagaggagaaaaggagaaattgagttcatgcgaggaaaagggaactagctggtgaggacttacctcagcgtactcagccgatggcgcagtagaagggctggtggaagacgacatcgccgcgggcggagatttggttgggaacaaaatcgcccggggatcgtcttgtgcgtcggggagatcaccggagagagagagagagggcaaagttggtttcagtggcaaaaacggaggaggacggtgtgagatttctcgagggtaacggttagtatttaaagcacggcagtaacggtcggaaaacggcaaagtgtgaaacttgctcggagtcgatttacagcaaatctgaaactctatcgaatattccggacttcgggggcatgtgttaacaaccaaatttggtaatatcggcatcgggaaagaagattagatcgaagcaaagttggaggcagagatcgagttcggaaacagagcaggaatcggctggagtccagatcggctacgattaggatcggctgggtctgagtcgggctaggtaagccgatgcagtcgattccgacaatgcaacatgatgtatgacatcgggttgaattgaggtgcttcaaggtgattgccgcacatggatagagtcatgagaaggcaattgtatctattaattaggatgttttatgtaatttcattagagatatgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggcgcatcgccaccatttttgctttagttttatttcgatgagttcttgctttcgggttgagctgcatcggttttgatcttcaacaagaggtaaaacttgttatggcggcttgtgttttcgggattagtgcttccatctttatgacactctaattttgtttatgtaattcgtcgagttttcatatatcctacataatccttggcaatatcgatatctgacctacaatcggctaacatccatcagtagaaggcagccgattaggttaaatgccgttgttgacttagattatataggatatctaccactctatgacacatccaatagcttgattgtctagatattgtccttcttttcatacttatagctgcatcagttaagtttgatcttatgagttgtgattagaatctcaatctctagcccgcttcttggttgctgattagggtagtatcggagtttcggagtttcagccgatcttgcttgatttaactactttttatcctatatgcttgattgacatgttaaatctgccctttacgttaagatcttgctgcatttaagtatattaagattttgtttagtatattctacttgctttaatatcttaatatagagtggtatcggagtattagctgatacatgctagatctatctgatcggctatgctatgaacgtatatagtctcattattaatatatatttcgatctaagtgatttatactacctcgacatggcgaccgatctatcccactcaattgatttaagtatatattgatataaagattatatattggtaatatctgcagctgatcgagtaattcaatcctttcttatttattaatgactgccgatcgatgcatatacgacatcggctcaaagataaatgatatgtcatcggcacctcgccgatcggctatcatttatagatttaactgcgatttctttgcttctatttcttgttgattacaggatcaaatcaactggcacgctcatacattcgaatgcgagctttggacctgcactggagttaagaagatctcccaggcctcgtgttttctgtcaacagcgtgttgttcagagttgaataaaattaatgattaaattactctactgtttcgctactcttaaatctttgctaaatgctgcttttgcaaatgagcctatattatgccatcctttggtatccttgtggacttgcatatttgttgtgtggcttgttgagtatgtcatatgctcattcttgcaataatcaatcaacctcagttgaagaaaaaggatccagaaggagaagacgtttggcttataccccagttgagctgcctatgggggtgaagctggagcttcgctagattttatttttccacagcagttttcttcgttgtgaggactaagtgcctcttcagtaagtattaattgctttagttattttgatgtatctgtatataaaattgtcagtttgtgtacctcggctgattcctggatggggattttatgcacaaataagttcggaaattactagtgaatttccgggcgtgacaagttggtatcagagccatctcgactgtaggataagccaaatggtcagactttaaggacaaattttctgaaaacatgatttgtgaaaaattttcttttcttccttctctaaaattctttgcaaattgttttatcgttctttcccctcccactttcaacttaagtagttgttaaacttattagagaaactcgaagacgtcgatgtggtctacttatggaggtcaagtcaagtgagtcgaggaaaaagaagataatggtcgaactgaagtgcggagcttttgtgatggagtgaagtttggatcctaccttagaacctaaaccaccaaagtgactttgaagtatagtcagtagggtacaacgtttgttacttgcttgtgtgtaggtatggttgcattcccatcattgggtgtgatgagcgtgtaattatactaggttgcttgcttaatcaacttaaacaatataatggtttacacacatcagatcagtggtaacatggttaaggtctcgtctttagtgtgacccctctccttctaacttttcaaactctgcgacggataaaaaaaatgcaagctatagtgggaaccacaacaatgctagtggatcaggaagttggaccaatggatcaatttaggacaatcacttgggcagagttcactgaagcattaaagaagacacacatagctgcaggagttgtttttttgaggaaacgtgagttcaagacacaaacaaaaggatgataccatgacagagtacctccatgagttcaaccgtctagctcgctatgctctagaagatgtgcgtactgacgaagaaaggtaggagaagttcttggaaggtctgaaggatgagctgttaattatgttgatccctcatgactgcggatttcaggagctggttgtcaaagcaattcgactggaatataagaagaacaggatggacaaccgtaagagaggaaggattgtttcccaggaggcacagggtagtagccaaaggcagcgtaccaagccactccaaattggtgaatcttcttctgcatgtcaagaacaattacaacagttggacattagtggtgagatcaactcagagactaatacaagaaatgaagttaacatggagaaagctactcaattagtgctagttcagcaggatcagtctcaagaaggtaatagtaatggaagggagcagcagttgtgtttcaattgttatgagccaggtcactttgcaagagagtgttcgaagccgaagcatcaacatccacaaggtcaagtcaacaacatcatcctcacaggagcaaatgcagtgccggttgcgtcttcaagtgatacagctcagcgatcagtttcaaagcagcagtagtttttttaaagccttagaataattattggagctagggaataagatagactgcagttttacctatttcctttttctttctagccgttccgaatctcgagacgagattctttgtaagggggtagatttgtcacatcctgattttcgttttaggatttataaattatctaataaattattattagaatttatattaaatgttcattaatttacaagtgaagttaaatgtggaaaataaaatttcctaaatataaagcatggatggatttaatttttattcaattctccatggttaattatactctctggaattttctcggatttttcggagctcaactcttaattttaatcatacaaacaatatttcagtaattatccacatattaaattaatcattaaatggtctggttttagtatttttaaatactttgagtgtccaagtatgttcaagatttttcttggaattatttgagcataggaagtatttttaacaattcaaagatcatttcagtgattaatttaattgaaaaagtaataaaaaatcctcctcctcagcttgggcccttttcagcccattccctctccgctctcctttccttagccgcagcagcccactctccctctttctcttggctgaagtccattcaggtccctccttcagtcgggccggagaaaaagtaagcccagacaaagtctactttacctccccggtactgttcatcttccagctccagacagagcccgagccagccgtcccgagattgtgcagcgccgttttctcctccaaatctagtctcctctctcgtgttatttcaaaattagttgaggggaaatattcctcttatgcttctctatctttttcccccaagaatcggactttatcccgaagaaatcaacgcggaatcgagctcgattcgtgtttatctctccaccaaaccctaggttttcctggcgcgattccttgcgttccaagcgcgatctctctctcccatggctataaatagagtcccctccctctcctctttcggccgccacctctccctctctccgccgtcgcttgtagcgccgtcgccgcgttcgtcttctctctccgccgcccgcagccgctccagccgccgtttgccgccgcctcggccgtcgccctcctgtgccgccacctctctcggctccgcaaggtcaagagcaagcccggcagccggttcccttgcgccgaagaccccgggaagcccatcgtcgccatcaacccgaagctcgccgtcgtgttttgatctccggcgaggctctgcagctcctcccgtcatcgccaagcttcgccgccgcctccattggattcgcagccgcgaagtgaagcccggccacccctccattgtcgccgaaggtcgccgaaacaccgtcgccgccgtggacagtacctcgctgccatctcgatctcgtcgccggccatcttccgtcactgtctgtcatcacgtaagtgttggtaagaatcgccgtcgccttctctacctctcggtgccctctgtttgcattgttgtgttgtggttcgccggcaaccgccgcacctatgtcgttcaccggtgtagtttatccctagggtcttaattcaatataatctaatccgtggttgatctagcgcgttgtcatctccgtgtgttgctgtcggaacgttgtcatcatcccttcctctccgatcgctttggttcggtgcgacttctatccgttctctcttttcaatggtatattatttctttttaatatatgtcatctaccaaatataatctaatctttttcggaggtcgttttaatcttttctctcagttataaatcatttgtaaatggtttaattaatttggaatagtcttttctttaatatgtttaattggaattaaatcttataaaattcatatctaattcatatgaagtcggaatgaggccgttcaagtctctaaattcatctaaaatcatgatttacatgtttgtttacattttatgtactgtttatttggtttttattagtttttttctccgttttgcgtgttagcttgtcgtttccgttgttgcgaaggttcgcgagtgtgttggaagtggttctgaagactaattgaagactgattattgcaaggcaagtcacacagatcccaaacatgattcctttgagcatgttgatcctatatttaaattctctatttatttcaacaatgcatttattttcgaatgtcaccgggtggtgtgaacatattcctttgttatggccaatttgtattgaatgccctattccttgataccttgggtaataaattgattagcttgaaccttatgtattggtttggttcagctaaatgctatatatataattgcttagccatgcctagaaacattagttcattaataggatgaatcctactacattattatttatggttatatttaatggtacctcacgatggttaatcatgttataataattaattgataattaaaacttgataatggtgggttgtgagcacatggttttgaaggtcgtgctcatgacaattaaggaccggttcgcgagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgagggggtgattatgatccaggaacggtggctgtggtggattgtgttgtgcaaggtactgtcacagttcctatccgagatatcatggtggtattgaggcgcatggtaacatgtcgtggagctgtgtcttgtgggtacagtggtacatctctggccagagtaaaactattcgaatagccgtgcccgtggttatgggcgagttgagcaatgtttttcgtgattagtctcatacctctcacaataattattgatgctataattggtaataatttgcttagctcctggtttggagttagatctgtacagccgggtatggttgttcagaatggttgggcctgagcagcatgggcgtattgttcagagttgattaaaattaatgattaaattactctactgtttcactactcttaaatctttgctaaatgctgcttttgcaaatgagcctatattatgccatcctttggtatccttgtgcacttgaatatttgctgtgtgacttgttgagtatgtcatatgcttattcctgcaataatcaatcaaccttagttaaagaaaaaggatccagaaggagaagacgtttggcttataccccagttgagctgtctgtgtgggtggagctggagcttcgctagattttatttttctgctgcagttttcttcgttgtgaggactaagtgcctcttcagtaagtattaattgctttagttattttgatggatttgtatattaaattatcagtttgtgtacctcggctgattcctggacgggggttttatgcacaaataagttcggaaattacctgtgaatttccgggcgtgacagcatgtatgcaacacgttgcttcatccatgtgactttgagaaacgcggcataactagtgtttccaagctttgccatttcttggttgcatgtgatcgagctgtaatctaaattcgtaatcttttaatcttttgagcgccgcactataatcaggatgatgatgttgccctcgatcaggtcactgggcccaccatcttgctcagaccgctagcggcgcacacagtctttgccttgagatgataacccctcaggcggagatctctgtgaagagcatgaggcaaccaataccagcgggcttctcgttagaattatcagatgttttgcttttaccctgggatagcgtcaatcccccgggctgtgttctaccccggggcacgtactgtgcctgggcccattggacggacccgagccccaggcacagtcccgtgctttgtaatagaagtcttcattatgttggacgaatttctggaagatgtcgttgatgaaggagttcatgatggacacaactctacaagtttattccaatacgcaattgtatctatgccttgaagatgcaaatcttgatggaagccagggcttaagggaagcaagggacccaattcttgttctgtgccagatgtcagtccccacatatgcatgccagatgtcagtccccacatatgtaggttgtcacctggcaaatgaattctaaatatgacagaaagtaataatgtggcccatggtactttaggatcccggagaaagggggaccccggttcccatttctccaacacataggattcttcaaaataataaatttcaaaaataaaaactcatgtgttgcaatagttccctttgttccaccggtcatatgtcataaatcatactggataaattgtctactttgcaaaacaaataacttactcttatttcatcattattatctagctattattatctagttgcttgttgtatacctggtttgagcatagaatttgatattcctcttaactcccagatttggcacctagctagagtaagaataggaaaacatggccagatttaaaaagaacccaaaacttgctatgcgaggccagtctaaccgccactgtagggtaaacttgaatgcgtaatattattactaaaagttttttggtgagcttaggtagatagtgcaatgaaggcgtgcggttttatggtagtgagtacaacatatcacttatttagatgtggcaaaacttaagtatatcacaatgagtacaagtttacttgcgattatacgtttcaatagccaaggctttgagtggtgtctctttgtgaagcaccatcccatacttctctctcatatccacaccatctttctcggctccttctggaagcttccagtcgaagtgaaacaacagtgacgcaagaaccatatgaaccatcctgtacgccagtggcaaaccaaggcagatccgccgtccgccaccaaacgggatgaactcgggatgcttgccgaagaaattggtgtccgtctccatgaatctctccggcataaacctatcaggatcagcccacacgtcaggcttgcgatggatcgcccaaatattcagtatgatgttggtgcctttgggaataatatagccttgcacttccactgtagcctctgctttgtagtacgtcattgggacacttgggtggagccggagcgtttcttttagtacagcttggaggtaaggaagctggctaatgtcagactcctctatctctgttctagtacccaaaactctcctaaactcgtccttcaccttctgcattgattgtggattttgcagtaattcaacaattgcccactctattgcagttgagcccgagtcagttccagcgacaaataaatcctgggatgtgtgttgatcaaagccaattcatcaatattatgcagattgtgatgaacgattgaaatgataactaattactaccgtcttctgtcaaacgaaaatgaaacactaattggatgtcattatcatacattctcgtctcgtctcgctttccattgaattgagaaataatttaagattcaagaattaatcataccgcgatgagtcccttgatgttattacggtcaatcacaggattgttgttcttccattcgtcttcgttatcgagcgccacgtccagcatgtcatccttccgcggctcgccggcttcacggccacccttccgccgagcaagaagctcgtcgatgatcccataggcacgcgctactagcttccccatcctgcgccgcaagccctgcaggcaatgttttaaataacggggttaaggcatttatcggttagcttctcaaacagttatagcttccgctacagtagactaaatggagttataacgactaaattgtacatgagagcaaatagctagaacccttctcaaacagctatagcgggagatttaaaaccctgcctgcaggtcggcggccgccatcgccgggaagaagtcggaggcgttgggcgtcgcggctagcttggtggcctcctggacggcgtccctcaggtcgggtcgacgaggtcggcggagaacgcggtgcacgacaggatgcccaggaatgcctcgaacgcctcgagcccgacctcgacgggctcgccgcgcgccgctcgcctggcgacgcagcgcatcagctcccgaaccttctcccgccgcgtcggcgccagcgcgtcgagcctcctgggcgacatgacctcctccgtagcgagcctccgctgcgcgcgccacacgccgtgcagcgggaggacgatgacggagttgcggtggtgctccgcgccccgccacacgtcgaacagcgggcgggacgcaaggtgcgcgttgtggctgtggtggtggatatcgcccgcgacggccggcgacgaggcgacgacgtaatcgacgacgccgagccggacgcgcatgagcgggcagtagcgctcggcgaggcgcgcgagcgagcggtgggggccgctccgcgatacggacaggaggttgccgacgagcggaagaggcgttggtcccggaggaaggcggcggcggcgcgcggcggctactcggtggtgcatggcgaggtagagagaggcgaggacgatagcaacaagcaaccaagccagggatgccgccatggctagcgtacgttcaaggggtacgtacgtgctgatcgaccttgatatgatgcagtagcttgcaccatatgcctcaatttatagtgaatgctctggccattagaatgctattactccttccatgtcatattactacgtgaataccccgccgcattgctgcgggaaattaagttatatcatatgtataaataacatacaatacaattattaaaactaaaacaaattgatacttatgaattttaagccgaaaataattgagattgcatggtgttatgagagaagaaagaagagacaatttgaaccacagctctatcatccaaatgctagaaataattgaggtcatgtggcataataagagaagagagaaatagcattaactatgtaggatctgttaacaaccaaatttggtaattcaggcatcgaaggtaaagataaaatcgaagcagaatccaagatatggatcttccggaaacagagtaagaatcggctgaaatccgaatcggctgcgaccaggattggcagagttcgagtcggacaaggtagccgattgagccgattccgtcaaagtgtcccgatacacatcatcgagttgagttaatgtgcttcacatggattgccacacacggattgagttctgaaaaggcaattgtatctattaattaggatattttatgtaaataacttagagataagcttgggcaaaagtctgccgcaaagacttatggtatcttagagtttcttagtgataagagtcgtgtccgacaaggacatattttgtatctcggatataaatatgactcgaagccatgtaatcaaacaacacacgttcaatatcaatcttggcgcattgccaccctttttactttcgtttcatcccgacgagttcttgctttcgggttgagctgcatcggtttcgatcaactagaggtaaatttgtcatggcagcttgcgttctcgggattagtgcttccatcattataatactctaatcttgttcatgtaagttgtcaagttatcatatattctatgtaatctctagcaatattgttatttaaccctcaatcggctaacatctgttaatgggaggcggccaattaggttaaataccaacgttgacttagattatatagggtgtctaccactctatgaagtttccaaaagcttgattgtttagatattgttattgttttcatacttatagctgcatcagttgagtttgaccttataagtcgtgattagaatctcattctttaacctgcttttggtcgctgattaaagtagtgtcggggtttcagccgatattacctgatttagctttatatcttatatgcttgattgacatgctagatcagccctttatgttaagatgctgtggctttcaggtatattaagctttctgtttggtatattttgcttgctttaatatctttatatagagttttattggagtattagctgatacatgctgggtctatttgatcggctatgctatcaactcttataatcttttcgtcaatatatatttcgatctaagtgatttatattgtctcggcatggcgaccgatctatcccaatcatttggtttaaatatatatcgacaaagggattatatactaatgatatctacagccgatcgagtagatttagttctattttgcttatttacaactgccgatcgattcaaatatgacatcagctcaaaggtaaatgatatgtcatcggcggctggccgatcggctatcatttatgggtttaactgctattttcctattttatttcttgttgattgcaggttcaaatcaactggcacgctcacgaacctaaaaggcaagatttttggaccggcactgaagttaagcagatcttccaggccactgtctgttttccgtatcaacacgcttttggtacgcccagtgggaccgagtttcaataacttttctcatggctgagaaaccaccgcagtcgccagcgacggtgggcaaggccgagccacctcttagcaagccaccacctgggcaaccgtctgaggtcaataagggaaacatcatcccaatcacattagataagttgtcagctgagcagaggcaggagctcgagcagatgatgagcaccgtgaaggacaaattcatgaactcattccaggagacccacgagggaacggtcgtccaaaaatataagctcaaagtggtcactgccgatgaagctgggacaagttcatctcaaggtgttaagggtactgcagattgctcaggtgataaaggtgatgggcttcaagatggcttggtcgaggatcttggtgaagatggtaccgaagagcaacaacctctgaaattcaacagtttccaagatcaagtcgattatgctgtaaagcatgcgttgatgaaccaattaggagttattgtcaatactttatcgaatatgatcaagtcaatggttgatggcacgatagctgagcatcaaaatacgggaccagtttatcttccaggaggtgtcttcccaaattacagagagttggtaactggtaaccaacagcccgctatcagtgcaccaccagcctagccgatggcaccagcttcggctcctgcgccagttgcaccgtcatcggcacagaggcaaatgaccaatcccagattgctgaccagagaacgaccatagcatgctgcgcaaaatatcaatcggctgactcaggaacaggttgccacgatgtttctaccaacaccaccaactactgatccagtacagtcaatgctggttcagtaaacaccaccaaggcagcaagtagtacagccgattcaacaacaggtggttcagccgattcagcagcaaatggtgcgacaagtgccaactgggttgaggacacctgacaatcggcaaagacaacagaatgtagctcaagttatccctaagcatctggtgcataatgtacaaccaaatcaatcggctgtggctcaagtcgttcctaaacatttggtacacaatatacggccgaatttccagaattatcaagggggtaatttgaactaccagtatcagcctccttcacctcatgtccagcatcaacaaggtggatcacctcaattgcagacattgcctcagttcagccagtttgatccgatgcagcaacagatgcaaggagtacctcaacagaaaccttgggcagatgtgatgagggagcaatttggccttaagccaaaggactctggaaatttgtatcggcacttgtatcctgaatggtttgagaaggtttcattgcctaaccgatacaaagtcccagatttttcaaaattttcatggcaagacaatgttttgacttatgaacatattagtcgattcttggctcagtgtggtgaggcatcggctgttgacgctttgagggttagattgttcccattgtccttgtacggatcggtgttcacttggttttcttctttgccttacaactctgtcaatagttgggccgatttggagaaacaattacacagctatttttacagtggagttcatgagatgaagctatctgatttaacagcagtcaggcagaggcatgatgaaactgtacaagactatattcagaggttcagagagatgaggaatacgtgctacagtctggctttgactgattctcagttagccgatttagcttttcaaggtttgatagctcgaatcaaggagaaattttcatcccaagactttgagagcctatttcatctcgcacagaaggtgactatgcatgagcaaaggtttgcggaggctaagaagaatttcaagaagatcaatcatgtatatccttacatttatgactccgatgtggaggatgattccgaagtagcagcagccgggtgggttaggagcaaaaaggttgtgacatgcccattggtgaggagttctggaaaggaggaaagatttgactttgatatcaccaaggctgacaagatttttgatttgttgcttcgggagaaacagattcaacttcctgctagccatataatcccatcggccgaagaattaggcaaaaggaggtattgcaagtggcataattctggtttttattatactaatgattgcaaagtttttagacagcagatccaggtagccattgaaggggacaaaaatcaaatttgatgattcaaagaagccaatgaaggttgatggtaaccctttccctatcaatatggtgcatacttctgggaggacagccgatggaggaaggagccagaattctcaattgaattcggttaggattatcaacaagtatcagaagaagcatgataaacagcaggaaaggtttgatgaagaagttgatgatggttttgattctcattgggattgtgaattcttcagattttattggaatcaaggcatgaggttaccatcgattgaagattgccctgggtgcagtgatattgcaggagttcaagccgatcgtataacagaagctatcggccgagtcagaaaaggttgcctgttcatcagaggttgggcctgatcaatcaagaccgtcaccaggatgaagatgaggatggaaagacacagtggtgtccttctggtattttcacaaagaatcagaagagaagagttcaacggatgaggaacagggagcgtttttaggaggtacaacaagaaattaaccatcggctgaagaagacaaagaccaagcaagagtggcgtgttaagagcacggtcacaacagccgatgaagttgaagccgacaagaccaaaagattgctcaagggtaaggctactgcatctgcatcggtgaacatggtttttatgctgcctgcagaattcgaagccaaggaagccgatgttgatgatgttgaagaagcttctgctagattggttttgtcacctaaacaaacaatttttgagaaaccagaggggacagaaaatcggcatttaaaaccattgtatgtcaatggatttgtcaacgggaagccgatgtccaagatgatggttgatggaggagcaactgtgaatttgatgccatgtgctacattcagaaagttgggcagaaattcaaacgatctcatcaaaactaacatggttctcaaggattttggtggcaatccatcggagactaaaggagttttgaatgtggagctgacagtcggcagtaaaaccgttcctacaacattttgttgtgattgatgggaagggttcctatagcctgttgcttggaaagggattggatttatgctaattgttgtattccttcaactatgcaccagtgcttgattcgatggcaaggtgacaaaattgagattgtgccagctgacaggtcagttaacgttgctagtgccgatttagctctttgggaaatggatggtattgattgcttgtctggaaaagtttgggatggagattttctaaaagtgtccgattgtgacatacagctaattgaagatggagagcccaagctattactttgagggcattgtggagggttcaaacgtctactcgaaggacagagtagatgatctcgatgacaagcaaggacaaggtttcatgtcggttgatgatttggatgaaattgacattggtccaggagatagaccaaggccgacattcatcagtaagaacttatcttcagaattcagaaccaagttgatagagcttttaaaggaatttagagattatttcgcttgggagtattatgagatgccgggacttagccgatcgattgttgaacatcggcttcctattaaaccgggggttagaccacatcagcagccgccaagaagatgcaaagccgatatgcttgatgctgttaaagctgaggttgcacgtctatatgatgctagtttcattcgtccatgccgatatgctgagtggatttcaaatatagtttcggtcatcaagaaaaatggcaaagttagggtgtgtatttattttcgcgatttaaacaaagctacccctaaggacgagtacccaatgccgattgccgatcaattggttgatgctgcttcaggacataagatacttagttttatggatggtaatgcaggatacaatcaaatctttatggcagaagaagacattcataagacagctttcaggtgccctggtgcaatcggcttgtttgaatgggttgtgatgactttcagcttgaaaagtgctggaggtacatatcaaagagccatgaattatatattccatgacttgattggctggttggttgaagtctatatcgatgacgtggtcgttaagtcaaaagaaatagcagaccacatagccgatttaagaaaggtttttgaaagaactcggaaatatggcttgaagatgaatccaatgaagtgtgctttcggtgtatcggctggccagtttttgggattttttttgttcatgagagggggatggaggtgcctcaaaggagtatttacgcgataaaaaagattcaacctccggaggacaagaaaaagttacagaaattgatcggcaagataaattttattagaaggtttatttcttgagattgaaagccgatcaagagttaacctggggggcagaggaacggaaggctttggataacattaaagaatatcttagttctccttcagttttgattcctccacagaagggagtgcctttcaggttatatctattagccggtgagaagtcaatcagctcgattttgattcaggagcttgaaggcaagggaagggttatattttatctgagtcgcaggcttttggatgttgagacaaggtattctttctgtggaaaagtggggtttgggtttatatttttcttgcacaaagttaaggcattatttattgtccaatgaatgcactgtgatatgtaaggccgatgtggttaaatacatgctatcggctccgattttcaaaggaagagttggaaagtggatatttgctttaacggaatttgatcttcggtatgaatcactaaaggcagtgaaagggcaagctgtagccgattttattgtggatcatcgtgatgactcaatcggctcggtcgagattatgccttgtaataagaacacaactagctcggatataaccatggctactttatgtattactcaaccaaaggtgcatatgttctatattagatttacttgttatatatttgaacaaacattgcaaaacgatgagttttgtgtgttttcgtttgcagaggtacttgcttgggcgaaagaaaagagaccgagcataagaaatgcatggatgattgaagaagttgattagggaccaaaccaagaccttctccaagtcttctttcatctaaccacgtcacttttggcccatagaagacaagagattaagttgtgcacgttttggaatcggattcgggcctcctaacatgatcaacttcaaacgaacctagccactgatctagaaggaatttcggggcccatgaatacttgttggaaagcttatggagtctactttcagatggtttgtgtcccatgttaatattcctattgagctgccgggaatccgcaaaacaagccacgtatctcatacagtccgaatctgatttgggttctgggccatataattttgtcgtgggcttagcccaagggggtgtgcaccctaggcaatcctaggacgtccctaatcacattttttcagtacccgtcaacgtttagagtggggttttgcttagattaatctgtcaagaacagttttgccgctagatcggtttgtggaaccccaaatttgtgtgcttaatcattcatatgcaatttggttgcaatctatcttgttcttgcttgtgttctttgattcgcatgcagggattagctttctcggcgaggtcaaccgggtttcggcacggttgataaccagaggagacgtggtgctacgattgcgggggtcagtagcgtgtacattcagaagctggatcgagttgtgtcgcgactctgcccaaatcgactgtttatcaatacctatcggaagatcgggacctaacatccctcatcaccttggactttgtttttcgatggatcagtgtgcactcatggttgtcgtttcggcttagtcataatttctcctcggagggcaagtttcgagtttgcctacatgattaaaccttatgcaactaacaatcaagctgaatatgaagcagcactcaagggtttgcagttgttaaaggaagttgaaaccgatgctgttgagattatgggagattcattattggtgatcagccaattggcagaagaatatgaatgcaaaaatgatacattgattatctacaatgagaagtgccgagaattaatggatagttttcggctggtaactttgaggcatgtgtctcgagagcaaaatgttgaagctaatgatttggcccaaggggcatcgggatagaagccgatgataagagatatcgaagtggaagttgctatgatcacagccgatgattggaggtatgatgtatttaattatttgcagaatccatgtcaatcggcttcgcggaaattgcgctataaggccttgaaatacaccttgttggatgatgagctgaattatcggacgattgatggggtattgcttaagtgtttaagtgccgatcaagccaaggtcataatgggcgaggtacatgagggtatatgtggtactcatcaatcggctcataagatgaagtgattgcttcggcgtgcgggatatttttggccgatgatgttagaggattgcttcagatattacaaaggatgtcaagattgtcagaagtttggagcagttcagagggcaccagcatcggctatgaaccctataatcaaaccatggccgtttaggggttgggggattgatatgatcggtatggttaatccaccctcgagcaaaggacacaagtttatattggtggcaaccgattactttaccaagtgggtggaggctattcctttgaagaaactagattcgagagatgctatacaattcgttcaagaacatattatttaccgatttaggattcctcaaaccattacaaccgatcaaggttcaatctttgtgtccgatgagtttgttcagtttgccgatagcatgggtatcaaattgttgaattcttcgccttattatgcacaagctaatggacaagtcgaggcatctaacaagagtttaatcaagctaattaagagaaagatttctgattatccttggcaatggcatacaaggttggtagaagcattgtggtcgattggatggcttatcatggttcaattcaagttcctccttgtaagcttgtttatggacatgaggcagttttaccttgggaaattagaatcggctcgagaaggatagatttacaagatgaattgacagccgatgagtattacaatctcatggccgatgaaaaggaagactttgttcaatcaagattaagagctcttgctagagttactaaggacaaagagagggttgctaggcattataacaagaaagtggtgcctaaatatttttctgaaggagagcttgtttggaaattgattttgtcgatcggaactcgagataataaattcggtaagtggtcaccaaattgggagggaacattccaaattcataaagttgtttccaagggagcttacatgttgcaagggcttgatggaaaagtttatggacgagcacttaatggcaagtatttgaagaaatattatcccagcgtgtggattaattcacgatcggttgcgctttgctaatgcatgtacatccaatgtggttaacatcgccttcagatggccgatatagttatatcgcccttagcagtttttgtttatcatattcggctgagttttgccgatatatgatggccgatatggttatatcgcccttagtcatttatgtaatcttatcataatcggttgtatcttgccgatgtatgatggccgatagttaatatatcaccgttagtctcaaattataattttatcaatgctttcatcattgcaaaattagggaggcacatgtataaaaaaattgagaatttttgagtaaatttgagaattttcgagcaaattgaaaagttatgttaatcggcacaaaggatcagtaggacaatcaaaaggagtatcaaagtttcttagccgattacaaaagttttataagtcctattataaagataatcacccagacaagtaacgttggatagccgacacagcttgttgcctaatttgctctacttcttcaatgggctggatgtcttgagcatcggttccaggaatgaccttgagggatttggtcatgtcggctactttcttgatggccgatcttagtctggacgtctgttcttcaacagcgttggggagattagctaatttttgtttctccagatccagttcggcgttgcattcttcaaattgtgctatgagatcaattttgcgggcttcaaactgatctatgttagactgaattggcccaatagagagctgatcaagcttagctttctctttatgcacaagttgccgattggcctgaatggtggcttcaatatcctttcgctcccgtcgatcggctatcctttgcttggccttttccagcttgaattgatgttgctcgagatacacagctggagagatgatattcgccaggtcatccgggactaaggcttgaatctctgcaaatcttgcccgaattgaaccacagtcagctaccaagttgtccaatgatgactctagccgatgagagatatcttcaagagttcttttgacatcttcatccggaggagctagggtcttacttgttgtttcttcttctgcctcttcatcaaagtaatccttgatgtcaaaggaaaacagatcggctaagacctgcaagagagaaaattgaagacagttaaatttaaagctatataaccgatctaagaattatgacaatgaaaggattactgggatagcaggagcggctggttgttcttcttcctcaacattatggctacctgcagccgatggagtacgatcacttgatatcggctgaccaggaggagaaggaggaggagcctgaaaaggacaagtgttaattaacattggctatgatcaaagttaaaagacttttatagaaggaaccttaccgatggaacttgtctatatggtgctggtgccgatttcttcttcacagcagttttctttttctgcaaatacgagactaatgagcaatcgactatacaaatttctattcaagagataataaagatgagttatttacccttgaaaagtgagctggagcagcaggagtaggaggtgttcttttacgagaagccgatggtgtcttatctcccgagtcgcttagtctagctgctgcctggtcaacatcttcttcaatctcctcttcatccaggactttttctatggatggatctaaggcgggcaagtcatcggttggcttggacttcttcttcatggctttcttcttcggagccagagccgatagatcaacggccgatgccttagctttccttttcctgccgatattggctggttctctcagttgcccttggagtagacttgaggtcttgggggcatggtagccaatgacagggggagctagtccacctccttttggtatgaggcctagggcatattctatgtccttgccgctattgctcttgcgaggaggagaagattctgttgtctgaaaaatagaagaagttagtcaagatgcaaatcagttgacagctattatacaaaattgacaacatgaaggtttacccgagggataacatccgggaataagtctgtcatatacatggaagccgattggcggaacaagtgttgcttccattcatcccaccatcaatcgaagtccctactcctgaaccttgccagttctatgttttcaatgctgcccaaggaaggttctgagatattgagcagccaatccatcatcaatactgacgaaatctctcctctgcattggattttattggcaaattataagccgattggcaattgtcccatcccaaactacctagccgagctcattggatggtagaattcataagatacttgtatatttctcccatatggatgccaataggaagaatgcatgggctgatagcagctgaaaaaacttctctagacttatcaaatttctcagaattgatttcttcaaatctgaagtccgatggcagctcaaagtccattgaatcctcatatgcaaaccaaactcgggcatctttctgaaagccttcacagaaactgcataaccagtctttgagcaattcagccgatagctttgctccggaatcggctggtgttgatgcagcttctccatatgacatgcatcgtcggtgggtgacttcttctccatcatcattgatggtgggttctagacttggaaattcagcatctgtcaaaggtggctgatttacagccttcatggcaaccaggttgagccaggtttgtagcagccaccatggtccacttgcaccgactactgaacctatggctattttagccgatgcattgctcaacatttggtataggtagccgaggagaattttgcccaaaggaatttgcttctttgtttcaagggcttcggctaagaattgctaattggtagtagggccatagcttgatccacagaacagaaacttctcgagccacattaacaggaaggctgagtgctctcggggggtaacagatcctttgcccatgtatgcagcaacatagccagaccagccacctatgctcttggtcttgaagtcaaattggttcttggtgttcaaactcatggggttagccgatgaagtcacatccaaaccgatgagcatggtgatatcaagcagagtgggggtcattggcccttgattaaaaaggaaggcattaagggcgttggactagaaataggttgcagaagccatcaagggttcgtccttagccgaatttgctaaagtaagagcaagggcttggccgattcctagttcatccgagtgaacttgtttgctggccgatacacgcttgtaccatacagaccaacttttctcgggagaagttttctcaagggaaggccaagacttgaaagtgtttttccaatgacctagatttgggttggccaatccaaagggttatcctattggtttcggcgatgatgaactcagtgggatcgggattgccgatggggccaagaaagtactgatgctcatgtgacaaactgggaattgcaaccagattggacagatgctacagatgcaaaaaagaatagagaagaagaaaacaagatgagataaggaaaaaccgatctactacacaaaggagaggatctagccgatgggtacttacttctgcgtattcggctgatggtgcggcagacgggctggcgaaagtcgacatcgccacgggtggaagcttctcggagcttgaatcgccttgggatcgcctttttgcactgaggggattgccggagagaaatgagacaaagtttgcttaagcagtgaaaacagaagtaacggtgtgaagtttctcggggtgacggttagtatttaaagtgctgcgataacggtcggacaaacggcaaagtcttaacaaccaaattttgtaattaaggcatcgaagataaagataaaatcgaagcggaatccaagatatggatcgttccggaaacagagtccgaatcggttgaagtccgaatcggctgcgttcgggattggcagagttcgagtcggacaaggtagccgattgagctgattccgtcaaagtgacccgatacacgtcatcgggttgagttaatgtgcttcatatggattgccacacatggattgagtcctgaaaaggcaattgtatctattaattaggatattttatgtaaatactatagagataagcttgggcaaaagtctgccgcaaatgcttattgtatcttagagtttgttagagataagagtcgtatccgacaaggatatattttgtatctcgggaataaatatgacccgaagccatgtaatcaaacaacacatgttcaataacaatctcggcgcatcgccaccctttttacttttgtttcatctcgacgagttcttactttcgggttgagttgcaacagtttcgatcttcaactagaggtaaacttgtcatggcggcttgcgttctcgggattagtgcttccatcattatgatactctaatcttgttcatgtaagttgtcgagttatcatatattctatataatatttggcaatattgttatttaaccctcaatcggctaacatctgttaatgggaggcggccaattaggttaaataccaacgttgacttagattatatagggtgtctaccactttatgaagtttccaaaagcttgattgtttagatattgttattcttttcatacttatagctgcatcagttgagtttgaccttataagtcgtgattagaatctcaatctttaaactgcttttggtcgccgattagagtagtgtcggggtttcagccgatcttacctgatttagctttatatcttatatgcttgattaacatgccagatctgccctttatgttaagatgctgttgcttttaggtatattaagctttctgtttggtatatttttcttgctttaatatcttaatatagagttgtattggagtattagctgatacatgctgggtctatttgatcggctacactatcaactcttataatcttttcgttttatatatattttgatctaaataatttatactgtctcggcatggcaaccgatctattccaatcacttggtttaaatatatatcgacaaagggattatatactgatgaaatctacagccgatcgagtagatttagttctattttgcttatttataactgccgatcgattcaaatatgacatcggctcaaaggttaacgatatgtcatcggcggctggccgatcgactatcatttatgggtttaactgctattttcctatttaatttcttgttgattgcaggatcaaatcaactgggacactcacgaacctaaaaggtaagttttttggacctgcactgaagttaagcagatcttccaggccactgtgtgttttttgcatcaacgggatcgaacacaagtaaccaagccttccagaggggggtgaatggtagggaaaacctaaaacccaaaaacttttagcggaaataaaagttaccctcaaatcgatggaaatcacgacgtagtcatgtcaccgccggtcacaccgcttctaagccgccggtccgaccgccgtagtttgcctggttagaccatcgcgccgccttcggttagactgccgtactcccaccggtcagaccgccgccttgctgtcgttcaaaccgtctccctgccgccggtgtgaccgcccgccggttagaccgatgactcgcctccggtcaaaccggtgggatccagaaaaacacttatcgacaaaacacttgaaagtatatcaacatttttgcatcaatatgtgtttacaaagttcacctaaagcactcatctctcaattcacgaaataggattaaaaccacgaagtaaaccctaacttttctttcctagaagtcgttatcttctagcctcaaccgctcatctatttatagcaaaaaatcctctattcaaagtacatataaaactcctattcccagtaggactcaatccttcaatttccaaaacctgtaaccgcacgcaccggtcacagaaaatccagcatcaaatcccgaacgcactcggtctcctcgagcaggctgacaccaactcggcctagctcagagttatggatgtactgctaaacagccaaggtcggagcttttttcattaagagttgaaagcaaattggtaatataaatgctattacttaattaaccatttttggatgcaacacatgaaacaaagatgccacaaatgaccttaaaaaaaagaatcctagaacaaaatgggaagatctctgccttgcgcctccaggccgacagcctctgctggtcctgcacacacgcaagcaaaaccagcaagctgctgcatgataactccaagcaagtaacacacacgccaaccaactagctgctcatgtacagccacatgcacacatacatgcttcaccaagcatgtatcaacacacacgccaaccagactagctgcacatgtacagccacatgcacacatacattcttcaccaagcatgtatcgatcacacatacacgtacagcacacgtacatgcatctctgctacagtgcctcatgtactgtagcagccctttttctcctccaatttaatccaatctccttcgcgaacaccgacgcttgcacgcacacctcgtgaagcccgttgcataaatctcccccacacggtgtccatccaccgtgcgccatctcgtatccaactttgtcacccggtatgcttgaccgtatggacctcaactccgccttgagtctagtcccgatccccaccgttgaccgaagttgacctccaagaattctgattctagtcaccttctcaaatggtatcctgaccgcactagacctctgctcctccccaagaatagtcccggtcctcaccattgaccaaggatgacctcaagtcacctgcacacaatcagacaaaacaaccgttcctgggcacatatatcacaacatgacccacattagtcacacgaactcacaccaacatccacacatcttttcaaaccattttatcgaataaattattttgcaaagccaattattcatcacaaatattaatcatgacaatgatttcacaaactacacttagtgggaatgaactatatcagtatataggataagtcacttcgaattttttttctaatcatcttttagtttgatcaaatttatcgaaaaatttgcaataacaacaacattaaattaaagtttcatcaaatctaacatttgaatttatattaataatatgtttattttgtggttgaaatgctactgtgcaaaagctaaaaaaattgccttataatgctagaagttcaattgctctcatctggcggtagattaaagtgttagtatcagttaccactcttaattctgctcttgatatatagttccaataggtctatttagtgtgtgtgcgtaaaatttgaagtttattacaaagttcttttgtcccataatttacacagtgcaaataatctattttctgatgtgttttacatatatacaaattcaattgctgattcgccttttttttaatgttgattcatgtgagagtatcctcgagtgttacgacttgcatcttctatgaaggccaaaaaccttttaagaggtcaatctaggatgaaaattaacaggatgcttaaggtatcttagaatagatcgagtaatatattgtatgcccatgatgtcgaaacaatatttcagcaatactaaaagggtgtgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttgcgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccgccggcctgcctccgtcgccgccgagtggtgcctccgcctacacggctggcctattcactccgtcgccgccgactggtgtcctcgcctatacggtcggttggtcacaccaccgttgatgggcatcgttatctacaccgccggcctgcctccgtcgccgccgactggtgtccccgcctatacggtcggttggtcacaccaccgttgatgggcatcgtcatctacaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattcactccgtcgccgccgactggtgtcctcgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtaggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactagtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcgacatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattgctgtcggttacgtttgtcgtcgccgactaatttcctcatcttcatgattggtggatttcgtcatcgcctttgatctgcctcgtctgtcaccgactgattattttgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtgttataccttcaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagagataatcactcagatcacatggtctatatcacccgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctggcttttttatatagtcaaggtgctgtttgggtttatcaagcaattgattggatacaatatcattgctttttgccacgtaagtgtgtatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgctatgtgaactttcaaagatgttgtcaactttaggttgtacgcatcatattttgccaagcagtcggtatatcacttggatcatattattcggggattcacaccgcatatgctatatattggtatcaagtcacttggttgactataattatcaaaaaccactcggttaattggataatttattccttgactatatgtttagtttgttcagctaatcacatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcatagttatccgactggtataggggataacttatatctatggaatatgtaacagatcatgacttgggt

SEQ ID NO: 61031 - DNA, 9430 bp, Oryza sativa
tgtgtaatccgagtctccaagatacctaccactaaaacactatcttctgtagcaacagcattttaatgtaattattccgctgttccaaattcaccatgatacagtcacatccccaatgtaataattggatcgtgtttaattagatgtgttccatcagatgtaccagatgagcaaatcatgcatactatattcttgtacttcaaaaagatctcagaaatggattaaggtccccttttatggaaactcttaagtatacataaattatccatctcccctatcatagtaaaagaacacacggtgctagaacagtaagaataaccatacacccatagatccagaatgctttacgcttatagtttttctgtacacacatcccaacatcatctaaacatccacatcgtaggcctgagatgagcctggatgtgaataaatggtcagtgttcccctggaagcttaacctttttggaggatagtcagtgagctaaactaaaccaaaaacactgggtagcaaaccttcaaaaaatcagtggttatacccaccactttgtttcgtgcaactccttcgcatactacagtggcattgaaagaagcatgtttttaaaaacatctcattctgtagcctcaactatatattttaataaatatttcacccatatgggtcaacgtacatgtcaaacatgcagaatatgtaacacaaaatatgttgattctacatattacgctgtagtctttggataatgctgcttatactgtgacaataacttgccttctaactagaccactgtaggtgctcctcaatagttgtaactttcttatcaggcataatttgcctgagatccaattagaaaagaaacaaatgagatttccacggaacatttcaaacaagtaaaataccatctactacatgaataaacgatgtatgcatgtagccatgaaggaccttctatccagtttattgcttgatttctaaaaagtttcaagtcattcaagatgttgaggcaaatgtgcttgtagcatggtggtaaatgccttccagtgagaatctaccaaccagggttcaaatcctggtctcgcacaaaaaaggtgacttgtgcatgtaattcagtaattcaatagtgtactacaagcaggactgcctacaccacagagtacagtacataactaccatgacatgttgaactcaaccagtggaccagaataccacgtatttaaggctcatgccattcgcacagcactgtgtcttctggcactttgggggcacttggacactaggcaggtgcctagtcagcatctaacagtagttatattcagtgaaatccatcatataccaactaaagccagtaaaaagaacaatgaaaaaggaaaaaatggcccactaaacctatcctagagaccaggtctctgtttagactttagacccatcctcaaagcactaacatacactaaaattaactacttgtacatggcgattatgccacctgtcatgttgaggatagtctaaacacagacttagtctcagagaactatttttgcacctactcagtgcagcctaatactagtagtaacgacttgacaaccatgccttaagcacaatatcaccccacctcaaaagaggtaataaataattctaaccggggtgcaatcctaacaccagttgtaatgctgtagagaccaatctgcaagtggacctgctaatgagttgaagccactccactgccgccaagccgaccctaaggatgatcaaccaatccaacccaatccatcactatgtggcctacatcctgctgatatggtatggttgtcaaaggccatatgctaaccaaatcaaccacaacagccataggatctaaatggttaggccatgaatagtatttaactatttttacagcttggctggttggccctaaactcgaaggatgacacagtggctacgtcccattttgcaaggcagttcatgctagtattgagttaaaaaagtatttacatgagtagacacgctagcttctttgctaataagatagatttcagaagaacacaaaaatatgcatgtaggaacaaggtggataaagcattaatgattttgcaacacactgaagatggaaagtattgtgtgcatcagagacagtctccttacgagttgcaattattctgcatgtcttgagttgacaaatttgtcgaattttgaacagcactctggtatttttgcacaactgcgcccagttgactaacctgcatagaacaccgagggttccaaaatatattaaaccctttcccgttttgcccaaaattcagaatatcaaaatgagacatctgacttgaataaaaatatgcatacagtgaaagggctaaatacctgtgggattattgatctacgtggaataagctcctcgtgacgccttgcacaaaactcccaagaagcgatcttcaataaaaggaaacatgctttagtcaaaaaggcgccatttatcataccagcaactttaaaggaccaccagtgacaaaaaaaaatcaaaaaaaatataataccttgagatcaggattaaaaactatccttagatgtccttcgcgtaccacacgcaactgctcaaagacactttcctggattgctttggtatagtccaaaacaatctgaccagaggcattctgcgattcacgtggcatgtcgacatatagtaattcttccaatgtaccactggcatatttaatttggcataatcgtggtaacacctcaacggtggtctctgttaaggtagtcacgtaagtggatgtaaaaagcagattaacagagaaacatgtgcaaattaaaatgatgcttaccaaagcctcgcccaggcttccgattgcatatctcacaatgccatacatcctacaagggcaaatatagaaatctttaacgaataatttgaaaggaaattaaaaatatgaggcgctacttcacatctgccaattaaaataatagaccagaagcattaatgaaatatatgaaaaacagaatggatattccagatttaaaaaatgacaagtcagcaacggctcatgaaacctgagggaaaactccagtagtttgacgaccacttccatagagagatacacaccacctttttttagcatttggagaaaaatactcattgacaaagtttctccagtactcgatattgttatcctgcatcaaaaggaacaagtagagacacaaaactgtaagcccatggccttcactatacactaaattaattgtttggaaaaagccgaaaacttacctgtggcctgttttgttgatgatacatgtaatgagtcaatctctttgcacaggttcctggctcataaggagccgattttcctggagttctcatgtttagactctgttggcgaagtagctgctgctgttgctgctgctgctgttgttgctgttgtaattggtttctctgcaaaggcagattctttagaatctgttgttgttgctgctgttgttgctgcatttgcaatatccgttgctgttgcaaaaggttcagttgagctgccgcagcagcttgaggattctgctttgtcagctgcagcaaatgttgctgctgctgttgctgttgcaggaatgctgatgggtctgaactctgctgctccatcttcaccgcactcaaactcctcaaagcttgcaactgcggcggctcaattttaacattgctagcattgcgcatcatctgggctgtgctattctggtcaggctgccccatctgcggttccaatttgaccccacctgtgctgccaccattctccaacttcactgtagcctgcggctgctgtggcggttgcggtggcaactgttgttggttgtaagacattggcagttgctgctgatgctgatgctggtgctgcaagtcctgcatagcatccaggtgttgttgttgctgctgatgttgcggtggtggatgcagattatctgaacccagctgattgcccaaactaacttgcgacgatgaagggaacgagagagaatcagaacctcccgcgccaaccaaatcgccagcaccatcaagccctcctctctgctgctggagggtattcattggaagcccaccaccacctggcatcgaccccggaccgagcatatgtcccccattcccaaacggccggttgagcagggaggaaacattggagccacctcccagcaggccattagcaccaaactgcgtgcgcggcgacacgagggacgagaagggcgactgcgaaggaagcatgcctccgccactgcccatcccctgctggccgccgctgagcaggctggagctcgtcctgagcaacgaggccgcgccaaccggctgcccaggacccatcgggttcggcggccccgacggcaccatccttgccggcaatgacaaagtgctccaaacctcccccgcacaaaccgctgcaagatcacgcgcgccttcactcagctcgccatccttccaccgtaagatccaccggaattgagcaagaacaagcggtcatccccctgaaaacaaaccacagattgcaacctcagaacacaaccacgggatctacaccaccattaccagaacaaatctactgtgtcaaactccatcgcccaaaaagccaaccgaaaaccagcaccagcgagcaccaaacccaacctccccctcccgcaacaacaacaccgagcgcaacaaaaccaccaccgaatccaccccgaaaacgaagaaacacgcgcagaaaccatcagcggaattaagcaacgccgagctccccgaacaccccccagatcgcatccctcgcctcccaaccccgcaaacccgcgcaaaatttagcaccagaagcagcagcagcagcagcaacagcaacagcagcaagccaccccacctcacctcacacctcaccaccaccaccaccaacaacaacaacacaagcacaccgccacaaactccacgcactcacctccccgccacgaatccggcgatccggagctcgtccacccgccaaatcgccgctgccgccgcccaccaccggcaccgccacttcggctagggtttagccccgccgccgccgccaactccgccgccgccgccgtgggccaaatttacacaataaaataaaataaaataaaacctcgcgagtttattactcctctcgctttttttcttctctctctctctctctctcgccttcgcgatgggatttggttttctcctctgcggagaggaagagaggaggaggaggaggagagagaaagaagaaaaagaaaacaaaaacaaaaacggaggagagagagagagagagagggaggagaaaatggcgagacgcggacgtcaaaaatatccgctggatttgattaggggaaaggcacggccacgcgggtggcgtacgctgccgctcgctgacgggtggggccaggggttggtggggcccacgtgggtgtgaggggggcgggttggggtttgggtggaggttggggtagggaacggggttgattagagagggggtggtgttggtgttttttttttttttcgttttcgtttgggtgtttttaggtttaatttttttgggggttcttttgggttaatgttttttttgtgtaggggtgaggttttatgtaattaattgattaatttaatttaaatagaagtcaaaagggagtgttgtgctccatgccttgggggtggccaatggtgtggcatcagttgcttgtgtatcctcactcctcctatcagcttcggctcatccacggtgacgatgataatgacgacgacgatgatgatagagttttgcaaggaactggttttgtggttttatagttatattatttgcgtcgtgtgaaatgttggtgtttgtatttttataggatagttgagtgtttttttttaacgatcgacgtgttgtgtaatacgaattaagttttggcgggtattttgaaatgtcctttttggaagtatttatgtttaaagcggttcttaaatgctagtttagcaacaaggatcaatccaaatttggtgaaattgtatatatagataacttagtaatataacgtaggaataattcatccacgtaaacttcaagttgggttattaactgagaatcctattgcacctttcaattctttccctttttattctttttttctatgttgctttagctaacctcagacttttgacccaactagtacttagcttatgtttttcttttcaagcatagacaactgaaagacccaactagtatttatgtaacctcacattcgcttatgttctttttcttgtcaagcataggccgtgtttagttccctgtcaaaaagatttttaagtatacggacacacatttgaagtattaaacatagactaataacaaaacaaattacagattccgcctataaactgagagacgaatttattaagcctaattaatccatcattagcaaatatttactgtagcaccacattgtcaaaccatggcgtaattaggctcaaaagatttgtctcgcgatttacatacaaactgtgcaattgattttttttccgtctatatttaatgctcctatgcatatgtccaaacatttgatgtgacggaatttttggaagtttaaagggaactaaacaccatagacaattgaaagacacaagtagtacgatgtactctcacttttgcttgtgttttcctcatcaaacatgcatggttcgaattagaggggtttgatcgtttccgcaatgctcaacatatagaatattggtggccgattaaaaaaaaaaaccaaatttcagtaatttttactatattgtatcgtacatgcttttctctttgtcataccatgtttgtttccgtatagtcttccctgtttttagaaaacgagcaagtttcgcgatataaataattgaaaccctgtacatagggagtagctagagctagtgagaattggataaatccaaaaatataagagtagcaaggaaggaaattctaaaattcaaagaaggataaaggagcatgcatgccattgtacacaatagacccatgctacatgttagctagctaggattttgttgggtagacaaactgaagatgccagggggcttcaagattcgtgcaaagctcacttctgtgggccacatggttttcgttgtcccatgcgcatggacttctttgaacctgccaaaaatcaacttattgagttggatatatgtgctccaaaagacttgcaacagcatcagttgtttctatccacttgagtctaggcacatacatggacatgggtcttctccttttatgacactgtatgttgttttgatatacctggattggtctcaatttcaccgaatcagtatgtaggttgttttaaaaagtacatattgtgaaaatggttctaattcttgtttatctataagtgggctcatcaaattcatgaacacttctctgttaataagcttaggtgcatatgaatgtttttcataaagggcacgctaatatgcattaagtaatgctacctttggtgaggaatacttgtcgctttgacaataacttggtgttcaaaatacaactatgaccgtagatttttattgactacaaaaggtcaatggatttatattttgttgttattttgggggtgggggcgggatcaagtgtacacacatgcaaactttatatatccaatccatgtaaagcatatatatactcaaccattcaaaagcttaaaccaaagacatgtccaaagcaacgtgtgtatactcttgttaccaaagccactagttagtacttgtattctgccaccctataggtcgtttgccatcatttaaattgacatttcagtcattgatattctgccaccctgtagatatatatatttcagaagcagacaattggtactttctaggattagagaagtttgcatttggagggtcctacatataattttcaataaaatatgaactaaaatttttactacttgcatcaatcggtcaaatatctcatatttaactatctacttttgtcttattattagtcttcataattcataattagctgcatcatccttcctgactctgcatccactcatatacacctttcattaaaaagaacttctgaatctgaatctagagatgacctatatattcagatttaaacttagagatcgttttatggatggagaaagtatatgattaaaatgccaatctacaattttttttaaatgtactcctttctatcacttttatttgacgctgggagtattaaattgagtatcaatctacattcatttatatataataacattaacaatctaaatatagacaagccaagtgaattagttcattatttccgataattgccaagccaaagtatacaccagcacttgatcatctgatccacacaaaccggattggtctccttcgtgttgtcaaaggcgtgcagcacctgtttctccctggttcccatggcccacggcatagcctttaaacatggaccactgtctatctccagcaccaagaaggctagagagtaaatttcactttggatcatattttattactgattttttttactttggattaaccaatgtttttattttggactggatatttatacctttatggcactttaaaccaccggtcctcaactattttatctatatacattcaacttgtcatatgtcaaagaaatagtcttacatatagctgctagagttcattgacgagtaagaacacagaggtactcgagatcgtttatagtttgataagagagttgggtggtttaaagtaaagcaaaaataagtttatacgatccaaaatgaaaacaatgattaaaaggtgatccaaagttaaacatcattaataaaatgtgggctttggcaaaatttactcaaggcggaaaagcctcatgctcttgctcatgcattccattccattccagatttccaaattgacttagcattgaccctggctggacacagccaccacaaatttttcatgggttctagtgagtgcaagccaatcaaatagggatgagaacggtggcaaaatttcttgaccgagcatcatttatgtagaagtggtaatattttttattttagccaaagattaaaaaaaattaaaaaaaaagaatctatcactaccatattatagttgtcactaaataaatcattagttgacttggtaaatatgaaaaaaaatatatcacggaccaagaatcgttgatgtagaaatgatatcgttctcgagcaaatcatcacaaactcacggtgaaaaaaattatatcccaattatattcttttacatgaaagatgattgtttcctttgaatttcatatattttagacgcaccgatttgcaccacctctactagggagaagaagtagaaaggaaggaaggatttaatggacatggagcagttggccgcaggtcatatccaaatcatgccggggtgccaagcagattgggagacagccgatctgagttggagccatg

SEQ ID NO: 61032 - DNA, 1635 bp, Oryza sativa
tgaatttttcccaaaaatgtaagctgattcatcattcatccaccatatccatggtgtgcaagaatgcaaagcgcagggatgtcccaatctgtgacatgtgcaggcactagcacatcaaacgcaagcttatccaacttaaaaaaaatggacactaactcataatatttttattgagttcttaaaaaaactcataatatcgcaacgaaacccggacgctttacatgtgcatcacgttggaccgccgtgatcttagaaacagggccaaagttcttctgtacagtactaccggtctactccacggtgtcactgtcaccccagaaacctagtaaaagggaagaactgccttgttttagtttagtgctattctaactttgtcatttttgtattaaaaaaattgtcatttttagtagctatagaaagaatttggttattgccagaacttttggcaaaaaaaaaaaaaagattagcccttcgtttcgttactaccaaagctatacgttatagaatcaaataagtcaaataattagcaatgccaatgtcttagctaaccaagcagacggctaatatttggaaattatctatgaatttacctagtttcatcgtccaaaaataacttcgtagcaatacaaagataaaataataagaatgttttctactttgttcataggggtgagggtacgttcgttgtgagtgtctacgttgtactgtgtaattaatacaaagataaaataataagaatgttttctactttgtttataggggtgagggtacgttcgtgtgagtgtctacgttgtactgtgtaattttttttaaaaatatactatattaaaattacaattgatcccactgtatcgagtttaatttatccttcatttttactaacttttttttcttgtcatgtaacaaattttacctgcagtatgtcggaagtcaatcgtcgattcgtcgacacggcccagaaaaagggcccagcccacacggggtagcccgaccggcacgtgtcggcggcaggtgcgtcgaccacctcccagccggtttcccgtccaggttcttccccccgtcgtccgtgctccatgctccaagccgcatccgcgtctctcgtcacgcccacaccaccacccaccaaccctccccttccgtcttcatcaatagtagtacgcctcccctaaaaacaaaacaaagagaagtccaccacacatccccccccccccttcccctcctcaccttcccttctccggttctcagattccacccaatccgccgctgcgtcgcgtgtgctgttcggcgaaattccaagccccaattccccacatctcatggttctctctcccatcgcctccgccgacgtcgaccgcctcctttgctgctgtcgccggtgttgttgctgtcgccggtgttgttgttgttgagggggtaacggtggtggtggtggtggtggtgaggggttagaggggctagggttgcggatttgcggccaattggttgggggattttgaagggggaatggatctctcgcggccggaatcgtcggacctgtcgctgggattccactcgctcggccacgcccgcgggcacgcggtcacggggccgctgcggctgttagatgacatggaggacgccaagccggagaagagc

SEQ ID NO: 61033 - DNA, 50929 bp, Oryza sativa
  unsure (1)..(50929): unsure at all n locations
cgcaagttttccaattcatctataagaagtttgttgtggtattgcgagaactcattcatccacctaagacaacctatctctggctcataatcttccttcttatcactctcaaattgcatgaggtatgttggaatacatccaattgggaggttaccaggaacaactagtgtcttggctccaagtccgatcaattcctgcgaactcaactttattgcattacaagctatataatattatattgcttcgtgaaacaggagctcaaggtatataaaaagatgcaggcacattactcacggtgattgtagaagaaattttggcaataacactaggagtgaagctgcgaatcttttcaatgggcacgccgctcataagaggatagttgtaatcattgcctccgatttctccgaccaaaaagagagattgattcatcatgcccttgcaacctgtgccataaacatcgtttagtaatagctgaaagggaactttaactatcaaaattgctgctttatatggtagttaaactaaactatcttcacctactacttctagcatgttcgtttattatcctattataaactagacagatttgtagcaaacccacaatcattgacctggcatatttattttttttattttattctatgcaaccaattcaagggttaagcaattattcacgtggaaatcatatcatgttgaccaaatatttggcagtggcatggtgtgcattattgtatagtagcagtagtagtatactccaaactagcatggtggctcgcgcagattacgcggctagtaccattatattttctcttatataatagcatatatattttctcactatattattaaaatatattacaatgacaatataattttaaattttacaataactttacgaaactactcatgcgtaatatttatattgtattttatatacgtgttagttattaattatttttaatatcaaactttagttatttgtaaattatatatattcctatatggactctggacttgtcttttaatatatttttttaattctgaacttttattatttttaattgtatttctatgtggattctaaattcatctttcaaaattctttaatttttaatttcaaatttcagttacttctaaattgtattcctatattgactttaaactcttcttcccatgtttttcttaatttctaattttagttatttgtaaattgtatttttatacggactctacacactacttttcattttattatgtttattctaaattttagttagttttaaattcctatatggactctatactctacttctaatattccttatttttaattcctaatttctattttttttttcttaattgtatttctatatggactctatactctacttctaatattccttattttttaattccaagtttctattattttctaattgtatttccgtatggactctatactctacttctaatattccttatttttaattccaaatttcagttatttcctaattgtatttttatatggattctagtctactcttctaatattccttatttttttaattccgaatttcaactatttctaaattgtatttctatatggactctagtctcctcttctattattccttattttttaattccgaatttcagctatttctaaattgtatttctatataaattcatctttcagtattctttaattttaatttcaaatttcagttacttctaaattgtattcctatattaatttaaactcttcttcccatatttttcttaattttgaattttagttatttagaaattgtatttttatacggactctaaactctacttttaattttattatgtttattctgaattttagttagttttaaattcctatatggactctattctctacttctaacattccttattttttaattctgaattttttttcttaattgtatttctatatggactctatactctacttctaatattccttatttttaattccgaatttctattatttcctaattgtatttctatatgtactctatactctacttctaatattccttttttttattccgaatttcagttattttctaattgtatttctatatggactctagtctcctcttctaatattctttattttttaatttcgaatttcaactatttctaaattgtatttctaatatggactctgattttccatatggactctatactctacttctaatattccttatttttaattctgaatttctattatttcctaattgtatttctatatggactctatactctacttctaatattccttatttttaattcagaatttcagttattttctaattgtatttctatatgtactctagtctcctcttctaatattccttattttttaattccgaatttcaactatttctaaattgtatttctatatggactttgtttttttctttttctccgattaatgcgagaatttctaagccatgagagcgaacgtggaggctcctttttctaatcctttaataatataataggtagatagataatagatagatagatagatagatagatagatagatattgttaatgattgtggtatctctagacacgcacctttctagacaataaagccccaccaactaatagcaaactgctatgactagtgcttagaaaatgagaactgccacgatctcgttccaaacgtcattgtcgaagcctcaaaggttggtggtgcaaggcgaaagccgaaagccgaaagccgaaaggtgttggttgattcaaacataccgtccatgtcgccggcgcagagcatgtcgagcagatcgcggaaccaccccatctccatctcgaggtgcacgacaccgtcgtccgtgggcacccctctctcccggaagaagtccgggccgagcgccgtggcgccgcccaccgcgaagttggccccgctggcgaagtcctccgcggtctgccctccccagtacggccgcaggaacggcagccccattgcttcagctgcggcgcggcgtacccacacgcgcgcgcgcgaattacacgtctcatattagcaaacggatcgagcgatcaatcgatgcagacgaggcctgcaggatggatggatgatgaggcgtaccgatgaagtcgatgatgaggcggccgtcggagcaccggccggtggcgcggtggaagaaggtctcgccgtagggtggccacagctgcgaggtcgttgccggagaggaaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaaacgtagtataaatgctaagcgctcatgatacgtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactggtagttgtgctttttatattatctaatatttgaagtgttttcgttatttcgatttctttaaacaatatcccgtacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctataagaaataataaatcttaaaaatttacgaagaatcaaacgatccacaaataaaaccttgtggtcgtgactaaaaacagagaaggaataacaagagccagccaatcacttgggcaacagccattctgtgtagaacagttctgcagttctgtaatgaggcaaaaataccacaatcgttacatcttttaatcacacgtattgtctatataataaaaaaaatatagttacagaattacaaatcgtagaggaccttgtattcaacagaagaactgagctcagtaatttgcgggcacgaattagtggtggtagcaaatgaaggttgtgtatatgaacctcgtagcagtccaattgcaatggccttgtatgcagcttctgatggatggaagccatcccatgacccaaacttttgtgggtcatcgcaaaccttgtattcaccatatccacatcttgcagttccagatacaccatacggtcctcctccaccacaacaagctgtcaaaggatctttgattcctgaaccgaggttagggaaatgttaaacaagctatactcagaagaaaaaaatgatctttttcttgataatatgcgctttcctccatattaaggcttctagacagtttttctagtgtaaccgactagttagttcagtcttaaactcggtacaagtgatgtcatgttaatttgtaatacacataatgtatctataccatggtaagaatgcaataatttgtaatacacataatatatctataccatgataagaatgcagatatctgaacagaggtctggcgtgggggtgcattacgtgacatgatgaaaataaacttctgaaccttacaaacatatgaaggatacagacagatttgcttcgtttgagaagcactaaggtaatcaaatttaagagaacacatatagagtatttttcttgtaacctaaaaactaaaattagtagtgttaagctttcgaaaagaaatcatagtagaaacagtaatgaattaactgaactcaccaaattgttcaggggaaaggaaaacttccatggcagctccatagtaatcagcatagatgatggccacatcaggatgaagcttgcgtaacttttccaattcatctataagaagtttgttgtggtattgcgagaactcgttcatccacctgaggcaacctgtctctggctcataatcttccttcttaccactcttgaatatcatgaggtaatttggaacacatccaatggggaggttaccaggaacaaccagcgtcttggctccaagcccaatcaattcctgcaaactcaacgctgttgcattacaagccatgtaattttgtattgcttcttgatacagggtctcaaggtacacagaaaagatgtaacataggcacgttactcacggtgattgtagaagaaattttggcaatgacactcggagtgaagctgcgaatctttgtaatggacaccccgctgagaagaggtaggttgtaatcattgcccccaatttctccgaccaggaaaagagattgattcatcatgcctgtgcaacctgtgcaataactagtgtttagaatcagtatgtaaatatgatattatagctgaaaatggaattttaagcatatcacaattgcttatttattatatcatagttaaacatttaaaggatcacaggaagcttactacttgtcatttctactaaaaaccagatttgtagcagcatgatcttccccttggcgtattaattgatttctgatttatgttgtatgccatcaattcaagggcaaagttcatatgtagcagtgacatggtgtccatttataaaatattttttataatttttaatttcaactaatgatgatgtattctttggaaaacaatgtgttatggattcgcggtgtgattttatatatatatatatatatatatatatatatatatatatatatatataaactgcagaaagttttaggactccttttacaatatttcctttttatagaaaatacagtatcagttatggacttaaggtgtttgacaatgacggttatggattttgaaatggaccatctgcctagcagcaatcaacaaaagctgtcaatcttcaagccacaaataaaccccactatttctggtaatgatgaattgcttttcttattttccttgtgctgttattttctttggatgcacatttttttgtgtctaaaccaagtaaccacaggtgacatataatatgtgaaaatgacattagtagtgtatcgtggaaaatacttcgatgcagttatattctttagaaaccatgtcaacgtcctaaagcacaagtaaaaactaaaaaggaatcaaggaatatatattgtataccattgcaccaattctgaaatggcatagaaggtactaggataagttccacaccataaggaaaatgctatagcatacttttcctttttttttttctcttcaactttctagccaactcccaccttccatgtcttctgagagccacaaaaggttgagacagtgccttagtacctgtcagtctgcgtgcttatactctactaatcagtttgtggcatgtttgggatttgcttctccaatctccatgtgtcacattcagaccattctatttatcaccagatgcgcatcatcatcaagacattaacccccaccaaactactagtctactgctacgatttcatatcgctagttgaaaatgtcatcgtcaaaggtgggtagagagagaggagggattatatcaacataccggccaggtcgccggggcagagcagtttcagcagatcacgaaaccacttcatctccatgtcgaggtgcacgatgtcagccatgggcacccctctcgcccggaagaaggccgggctgagcgccgtggcgccgcccaccgcgaagttggccccgcatgcgaagtcccccgcggtccgcccgctcaagtacggccgcacgaacggcagccccagcgcgtccgctgcggcgcggtgcacccaaatttcaaatctcaggttagtcgggtcgttcgatcggtcgaccaatcgatgcaggggaggagggggctgaaaatcgccgcgagcagagtaccgatgaaatcgacgacgaggcggccgtcggagaatcttccggtggcgcggtggaagaaggtctcgccgtagggcgggcggagcgccggctcgcgggagtcgttgccgtagatgaaggcgaagttgcccgtgtccgtcagcgagtccccaaagctgaacagccgcgggtagcacggctcctccgtcgccgcctctgccgccgacaggagcaccgccaccgccacaactaccgccgccggcggcggcgagaggaggagtcctcctcccttcctcccggaggtggaggaggaatccattcctctcctctgctcgagatgaacggagaaaaggagagaaagtcgtcgcggcgatgctttgcgttggtccaagtctaacgtggcttttataaacgctgcggtagtcactgacatgtggggtcgcggtgacagaggcccacgggtcagtggggccagtggtcgctctcacgtgtgacaagtgtgctttctaaccttcgagaatgatgagatgtgctcagttaagaggccctctttgaagtacacgtcgaatccattattttttgcacacaaacatatgttctttttagtattacttccgtcccaaaataaatgcattcgtggatatccgtgccccacgtttgaccgtccatcttatttgaaaaatttaaaaatatttagtcacacataaagtaatattcatgttttatcatctaatagcaataaaaatattaatcataaaaaaattttaaataagacgaatggtcaaacgttgaacgtgaatagtacaaaactatatttattttaggacgaaggaagtattaattaaggcaaaggttttggatactctacgtctacgtgacctggtgaaaccggtaaaacgcaacaaggacgtacgaaaattacgtattccgaatggtgaggcacttccgtatgatgaaaaccgtgtgtgagtgaaaatatgttttcgtcatctcgcttctcccatgggcaaacggcccaaagaacaataatacgaagctcagcacgcagaacggctcggaggggcaatccttataaaccaaaattaaaatcttacaactttaatctagcgttgtttctttgaatctttggttttctcatcgtagtttattttacaacattattttaaaaagttcaaaatttgaaatatactcctaacttttaagaataacaaacttagagcatgtcaatggattgtctatactacttctaatataaatattttgcaggttttttcaaaaaaattaacctcccacaatagccctaaacaagctgaaaacatcatccccatcaccataaatgtctctccataagtcgagggagggcctcaccccggatagccatcaccgaccgattcacacgcttaggagtcaaccgtgggagtacaagaaaataggtctagttttgtctgaagtttttttatgtagacacatttttattttgagaagttaaattgggctatctcttagagggaaaggatatttttatcccttaaattccattagagattaaaaaaagatttaaggagattgaattttggcaaaaatgttagtcatgctctttagcataataactcactaggttaaattacttgtaataaaacctattcacatgggttcaaaccgtacacttgacatcacacggatgcttgtatttaggtttattattctttatgtgacatggtgctcgtatttaggttatgatgactttgtcaatccacattcatatataatatgtggactgcttctaagtttaataaattcctggttctcaaaaaaaaatccacattcataatgtgacaaaagtgggggaacacatgttagaagaaacgacaagtatagttcaacgagaaatgtgtttttttatatgagtaatagtttgtcatatactcctatatatgtaagaaaagtataaaatgttgtaaagttgatgttgcaatgatttgacttaattgattgatataatttgctcgtgactgtactatttatccaacacttccaaaattttgaagtgttctaatctttttcatttcttaaaacaacattctcgtgcattctttgagaggatattatttatgggctatgccacttgtcaggattttgtggatacaaacaagagcagtcatactcacccaaaaaggagaaagcaaatttgcatgaccatggtttaattttttcaatctcatatatacacaagaaatatcggcttctcataaaatctctaaagcgttaccacgcagtgcggtgatatcatactaccaacgtctaaacgtgcactcaaatgtacacaaaaatatgaaaaagatttaaggcgtacggagctcaacgatatgtacactactcctaagtactaacacagcaggactagcaggatccttgccaagcaatgtgttcttggaggtagagagttcacgaaagtatatatatgcggtgttgaggcacaaggtaacaagttagcaagtactagcaacaactatggtgttattttgtgtactaatctcctctttgtcttactcgctccgtcccactaaataaaacacttaaatttatcagtctccaaaactaatttttcatatatattttttgtcaaaaaaatttactatgtttataagaataaaatcataatcatatgaaagtaaatttaaatatcaatctagtaatattatttttaacaaataaaattttatttataataaaatagttactgatcaaatatttaaaaagttgaatctttaaaatatgtgtgtgccttattcttcagtgggacgaagggagtattagttttggtcggcagatcgccaccatgagacggaaaaaaagatctgtaccaacaaaaaaatcaactcaaaattatgtatacacggtaaaaaaggacaaattcaaggaccaaacagtacacaaataatacgtcccatcattattggtagttacagaatgcactgtttttcatactcatatccccatgtataaaacattttttttgttatttttgcatataaattatcatgttgcacatcttgatttttttttctttacacattagacacacatgcacatatcatcacatacgcaagaccgcaagaccgcaattacacacccacaaatgcatccactgacacacttttgaaaagaaaaaagaaatagtaacttgttcctgatcttagtatattcttgtagagtgatgcatttttagtgtactttggtgtaccagacatccagcttctaaatttagtttcaggagtttattttgtgagagaggtttacctagctccgctctcagtttaattagatggagctgaaactgtttggctgagttccagcttacgagagatggaggtggagctgaagctatgccaaacaggctagtagtacataaagattctcttctccatcgcaccaaacattgtgaaagagaaaagagcaccattttgagattcgtttatgcactattactattttgaatattgcgattcaatcttcacaagtcaggtgcaagaactgaatgaaaaaaaaaggaagaaaattggaacgcgcgctaatcttttgcttttatagaggaccgtatcagatacggtcaaaagaaaaaaaaactcccatgaacataagtaatttgctttacctcatcagcattaaaagcttttaagtgtccccttcagaatttacgaatcacccagggatttgacacttgcaagccacattgaattgttcaccgacgggttgccgctcaccgagaatattccatcgctggaaatctcctatctaaatttgctttcaacttgagtagatgaacaattattccaagtgggaaccacgaatcgcatatactagtctccacatttgatggctggtgagtggtgtgacttgttaacagcaatagtctctcttttcactcgtcaaattcaaatgagtagtttgtatttccagaaattatagttttaaaactggctaaagcagaacattaggccagtgtcaacaaatgctaaggcaaaaggtgcataatccaatgtttgtccaatgtaacaactcaaaacttgacacaaatagttcctctcgtacaagttttgttctgtttggcattaggccgccggattcttattgtaaagctcaaatcctcggtatcccaacacaaggggtagaaaaaagcataaatcaaatcaagagaagcctcatctacaggtatgagttgctagtctgcaaaatggcctaactacgcatttgcaaatttgatacccttctcaattgaagccttgagctcgcccttaagattctccagtccttccttctcaaagtctgacagctggcccaacccaagaacttcctcaactccattcttcccaagcttcacctgtaacatcagtgaaggaacataaatatttcagcagcttgaccataaagtttactgattgaagatttctaaagcaaaaaccagttttgaaatgaccagatgatagaatcacattcacgttaggctaagcacccactacgtctatgtaatatgtaaataatgtcaccatgagcacaacataaagcaaagcagcaaaccacaggaaatcttactgcaatttgcatacatgatttgctatgagatttggcatggcatatttgagggcatttgtatgaccttttgtacaaaaaaaaaatgcttcttttgcaacagccttacagtaaccagcctataatataggaaaccagatgaaccgtaacttcttttgcagcagtacacggatgccgtgcacaatatctaaatttgcatggatggtctcaggttcatagaatcagagcaccaaaatgcacacttccacagttcatagtaatagatgagccaataaaatgaacacattctgaaagtatataataaggtagcaattccataaatgaggtataaccattaattgcaaagtaaaaaaagaaagaaagtatctaaccacacaatcattcaggatacaggaatctaaccagagacaagaaccactattatataggatttagtatattaatatatatctttctatgcaataaaaaatttgcatggttcgatcctgtccatcttctaacatttttggacagcaagaggaggacgcaaataaaacaatatgcatacaaaactagagccgcacattagaaaaaggaggaatagaataaaagagatatcattaagatgagaaggaatgtcaaatactctagatttactccaccaaatgatatagatcacaactgcaacagacaaagaaagttgtgaaaagaaaatgtaccttggaggcaaagaatggcagctctgttacagttgattgcacaaaagagcattcaacaacgtccggcactccattcagaccctttaagcaagcatttgcgaaaacagcaccagcatacctgtcccccaatagaatcaaatgagtaaggataaaagcactaccattagccataaaagcactaattcctcactctgcacagctgttatgtttattttaacttacgccatggacaaggttgcagagccctttccagcctttgcttcaacaacttcagtcccaccatcctgtgttctcttggtaagagccttgatgtcttcatcagacaacgcattagttgcaggagttgcctacccaaataaagagttccttcagttggattgttaagttatgagctcataaaagcatcatctgcttcatatttttgaacagccaaaataacacagttatatcttatatattggtcatgtttgtgttcttatttgtaatccaaaaaatgattgtacacttcatattagactatgttagcgatgattctataaagataaaagattcctatacagaaactatgtcaaccttgagcgagaaaatataacaaacttggttattaacttttttatcataataaacatgtgcagtttactacaagaataagagaacacatgaacagtaattcttaagttagcatgttttaaccatagcatgcatgatatgattatggtgccataacaaaaaatatatatattgtaggcatactccctccgtcccaaaataaaccaacctcgtactaggatgtgacatgtcctacgaggtttggttatttcgggacggagggagtaccaatctgataatcttatttttatgatatgtaaatatggatcctactggtatgacattctgagttatgttaatcaaaagtcaaaatccatacctgtgagaacagtggcaggatggtgatacccgcatgaccaccaacaactgggacattcacatctgccaaaaagggagaaacaaatccaacagaagataagagagaaaaaacaccaaaaccctactatatcaattctcagtactcaagtgactctcaggtcattaccagtaactggtacattggcctttccagcatagaaagtcttagcacgaacaacatcaagagtagtcacaccaaacaacttcttctcatcgtaagtcccagccttcttgaaaacctcggcagcaattgggaccgttgaattcactgggttgctgatcatgttgacaagagcctaatatacatgaacgaatttaatgaacgtgttggtaattaagcatgtaataccaatgaacatgcatgagtttcaaagatacgaagactgaaaacaaaattgatagaacttatcaaagataagcagataacaagaagcaataagtcagggtaaacaatgatattcttctgatttgtccaggttaataaatgacccgtggggataaaaataattgctgcaccaaattatcagcattcagccagggaaccagattattcaacaagagatatacaatgagtgctggatgctgatacacgcgtgctggggaaaagtttggcgccttttcagtaatctagtacagcttttttcacacctctaatcaaatcatgtttacgattccgttactagacctaattgcagcgagcaatacccacaagcgaccacaagagctacaggcacaagagctgcagatccagagtgctgcgagtgagggagagatcttacattcgggcagtacttggcaatggcggtgcagnnnnnnnnnnnnnnnnnnnnnnnnnnnnnnnnnnnnnnnnnnnnnnnnnnnnntccctggtcatgccgggcttcctcggcacgccggccgggatgatcacgatgtccgacccctccaacgcctccccgagctggtcatcccccatgaaccccttcacctgcgagaaaccgaaacccccaaaacccaagcgcccgcagcgttagacagatcccggcggaacgggaagaggggacggcgagcgatgagagcgcgggggaggtacctgggccggggcgttgatgtgggagacgtcggcggcgacgccgggggtgccggcgatatcgtagagggagagggaggagacgagcgggttcagcttcatgaggagggagagcggctgcccgatgccgccggccgcgccgaggatggcgaccttccgctccggctggccggaggcggaggagtagccgcggcggcggcggaggacctgcgaggcggatctcatcagcgacggcctcattgctgctctcctctgcggcgctcgagatctgactcggtggaggaggcgaagggcggagagagagaggaaaatgcaaagcggtgtgactttgtagtcgagcaaaggggatgtggatgggattgggatctactccaaaaggttgttagcgaaatggtactactaacttgtgcggttttcttgctcgtgtcaatttgatttttctctctttgatttcatctctctttttctctgtgcgcctcgttaatactatcatttctgatttgattaatcttaatactattatttctgatttaatcaatctgtttttccgtccgtctggtttggttaataaaggtgtcatggtttaaaaactagtcacactcaaaactgttctaagattgagacgagtatatgacaattgaaatttactgaaagtcagctacacgaagcgctcggaggatacggaagggcggaaggcttaaggtgcttacaggcaaacaattgtagttcatgtgtaaattagcaagaaacgaactaaataaatactcccttcgtttcacaatgtatttattttagcatttcccacattcatattaatgttaatgaatctagacataatatcaatatatatgtgagaaatgttagaatgacttacattgtgaaacgaggaagtaccaaacatagccttctaagttctaacaaccaacaattattagacaagcctatcatttcttccataaactgcactcgccatttttctcaactgagacgttaactcctcatagaaaaacaaagctgaaacagcttgcagtaatatgcagttatgcactcgccagatacaaaatttgacgaggaggttaaagttatatgttatgctattgatacaagctggcttgacttacatcaagatctgatcctaacactaaggcaatcatattgggagcgaatcggagcttctaccaagtgaagagcaacaactaattccaggcacagcactacaacaggagcaaccatgatttgtccaacttcgcgagctcctaccttgtcaggctgatcatgaactaaattaaagaagagcgcaagtaaatcagtcggtcatgatatcactcccatctgaatgctcagaggcatcagtaacgtctcccagctcttggctctcctcgtcagtttccatagcatcaacttcagattcttcatcgtctgtgtccttgtcctcgtatattatcggtggaacagcgtcctcctcatcagtttcaccgtcagaaacctggaaaagttttgagttactgcagtgattaaaaagaccgcgccatttggaggaaagaaacttaccccgctgaaaagatagtctagggtagttgaaagttgaagtgctgacttgaaggttgatgttcttgcatcaataagctgcaaaattggcagatagtaacattagtattcagaactcaacctgactcacaattgccattcctgtctgtgcttgtgccctaaaaatttgataatcaaggaagtcaaaacttcaaaaaattcctgacacatgacatctaaatgcagcattgttcaggaacgatgcaaactagtaatctaataatcttaatcagaaaaagcataatccagtatagatgatgccatgccacttactgttactgcaactgcagcagaagatggtactaacctgatagagtgagtttagcaacagtagagaagattcctgagacactatgctgctcatgtgccgacaaagtaaagcctgaagccatgggagcatacaaaccagttttgcacccctgtggagaggaaaaacatatcatgtgcaacctttccaccaaattgtaatggaaatattagagatttacactaacagaaaacctacctggattgtattagcaatacaaagaacttgagaagcttaacgacgtctgccggtgttaggagtgatactgactttacaatgacctggatgtaacccagccaacaatacaattatcagacaagaggaaatgttccatgaaattgcaacaggaaaattcatatcaatgcattggaagactgctgctaggaatgaatactattagattggttatggcctcatggagaaaaggaggccagtttttagtttagtaaattaggctaaccaagtttaattgcaacttacaaagcagtccaacaagactggattaagaggttcagactactttgtcttttctttcattctgggctacccttctttttattttcaattttacttgctatgtgaaatatcattaaaaatggcaataataagaaataagaatccaagtaaccatagcctaagtttgacatagccaagcgtaatcatgtcttgttctacatgttttcctaatcatgtacataaccatcatagcccagtaaaacaaacatccaaaatcaaattattgtaacgtcaactaccttgtctgagccaaataaaaatgatgaattatacggaaaaattgaaagcagaataagattctaagtgagactgttttcaaaatatgaaaaatgattgagtgaagataaggggcgacagaagtctcaaccacacagtgcacaggaaaaaacggagccataccttttcatctctattgtacaagcattttagcaattcagtgtgatcatcagcacgcaaagcttgcttcagcaaaacatggactgaatctgcacttggtggcgctaaagagggtggttgctcttcagtaatttcagacttgtttagcaaattcagacttgcaagtttttcctccatggtcggttcatcaagattgtactctggattcacttccttggttgtgtctaaacatcccaaataaaaacaaaaattagtgatgtggtaataaaaaaaacaatatagagggcacccttaattctgtcctttcactatttagaggtagaaaaggtaaaagaaaatgttagtgtaaggttttggaggtaatgtaacaagcaatgtctcaccattagtggaatccaaaacggatgatgtccttttctttgcttttccttgaacaggttctgcatccttgctatttgctgggcaaagaaataatcaatgtcaggcatctagacaaagtatataatttgcaacttgattatcataccatatagtggagggtaattatggagagcaattccaatagattttttatcagttcgaaaggtgcacgatatgaagttagcattaaactagtggatggctgaaatgaaactacatacatgccattagtgcttggtggagtgcaccactaggcactagtcataaataacatctacattacttcgatctcttggctagttgattaatccaaatcattatccattagttaagagcagacaagctgctgtctggattggaattcatctgaacaggaagaaacaacagttcttgtcattgcagagaaaactaaaacaaggttcaagcagagcgatctggaaaaattgtgaaaaagaacaacgcggatcaagtagatcagtcctaaatctaaccgtgttttgactaactaaagctcaatgttctgtttaacaattgagaacatttttgaaataagaacttattgcagatatataggaaccagcaacagtacaaagcagctcaagaatgatggcatgccttttccattatgcaaaccgggttatttataccaggataattctaacacacttaactattcaatttactgcactgataatgattataagagcagcaggcagatacaacaacaaacctttagcttcttgctccaaattcctttcctgcggagacaccatatcttgtttagctagttcatcatactctgcaaccaagttgatgtccttgcaagtatcatccaattctacaaccttgaactgtaaaaagtttggtgatccaaatacaacatgaaccttaacagtattgtcttcattggtgtcacataatttagctgaaattattgggatacggccttttttatcgagtgaatttttgactgagatttttgtgggcagtacttcattttgggagagggtctgtaaatgccagacatgagcaacacctttcttcgatactgcgagaacaatgcccccatctccatatgatgtgctccttgtacactctactatctttggctgattttgcattgtaagggaggctgtagaaacgatggtacaactattctgatcgcaagaccacacttgcacttccttattattgtcaacatgagaaaccaaaaaacgtccatcatctgatacagacatcagctggacaggaccctgcatttgacaatagcatcaataagagttgaaagcctctattgagtacatgacatattacaaattcatctcgtggggtgtatcaacagggagagaggagcgcaagtttgagataatgacatacaacatcagaaggaatcctcaagatctcttttttctcactcacactaaataatcttgttatcttacttgatacacccataaacttctcatctgcaaaatacaatgccaaaagtttagttgagatacacaaagaaatgacaaagaaagaaattggcaataataacataagatgtcatatcaaagaaagagttcacattcaactcattttgctgaaaccctgggttatgtaaactaaatttcatttgaactacccgattggcaattaataatcgaaagatgcgaaagagattaaaagaattagtgttctgccagctccgtatgttcttgatatcccatataaaataattggtacatgaaaaattgtttttttttacctggcaattgcatatgtgttgtcatgctctatcactatcagctactacactactacatgttaagatcaacaaataattagaaatgaattttccacttcatgatacatcaaaaacaagccatccatttttggtaaaaaccttctattaacataataaacatccggaagactggattttaataaaggttttttcaagcatgcatcaggtgaacagatgaaattaaagttgcgctcaccatgagaaagtgtaaaagaattaattggtttcttcgtagctttaatagtgtctttggattccccggtgcgagaattcaattcacatataattccatccatgccagcagtataaagaacacgcccatgtcttgcaaaatgaagagaaacaaccttgctagtagaaaaaggaaagcatgttaaggtaggcatggaattttcacaataaagttacaccagagacatattgatctaacttgttttgttctgcagcacagactatgactcttttcttcagaggcaagttggctcataacataaatcatcagaatggcttgtcaaaaatttggtttacaggccatgggatgcttgtaataatccaattaagctcatgttgcctgcttaagtgtgttccaatatgaatatctcgttatttagttaaacaggaaaaattacaactcttccatttaggtgataaattgaagcttgagcttcaagcacagaaggaaagaaagaaactgagtcttgagctacaacaaatacgccaaaagaagtttttttttcccggcagagagcagcatatccatgcagaaccagccatttagattaaaaaaaatacttgtaagttcaaatattgttttaacttttaagcaatgactaagatatagcatagtacacgtgataagcctacagcgcagttaagtaggggaacaaagtactgaatgttatgtatgtttatatcgaagggagaaatggccaaactccttgtttcaaaatgccaaacattctagtttgaattagaagtactaaacgaaattcagaacattgcagaagaacccctatcagtcaagttaaaggtcaagaacatcaagctcatagatcataataagattgcacctaccaagtatgaggagcattcttccatatgacaccagtagaatcgagaactaaaacttgaccatttgtagtaccaacagcaacaagaataaggtttccatcctttttatgctacaaaaaaaatacccaatcaaaaacagcaaattgtaagacagaaatgagacagagcctaatttcaatcctaaaaaattacctttttctgaacagagcaacatgcaatacaactgtatgaatcatctggggctgaaattggatcagtccatccttctattatttctcctcctcctgtacgccataccttctcaattagaaaagcacaagcagaaaaaatggataggttagcatacatcaaagctacaatctcacaatttggattgatgttttgagcgaaggaaagattttaatgctaaacacatatccatccgaatttcctccatcatgtaaagctcaacttttcaccctctttttgttagtagtagtagactttcacctctccgaagtaccatttctaaaatagataggctatctaccattcacagatctcagcttttaacttctatcactctctacaaacagcttataagcaaaattatatactcttgagtcttgaggtagacgcccaacgtatttaaatagtgatacatcatgaaaactattgcctacaaccaagcagcacttcacccggaagaaacaaaaaccaacttcaccaaactcccctatttaatcgccgtgagagagcaagcgttcgaacctagttccccaaccatacagcaatcactcgcgagccacgagacatctcgaaaaccaaaagcacactactacatcgtagcgcagcgaccgtataacgctccagcagcggaagtattcccccctaatcaacaacgaccgaaggacgaggggaacagcgcgtaaggaaggggggattcaggtgacgggttccgagcgaggacctggactcgccgatcggagacggcagcgaagagctcgccgtcgggggagaaggcggccgcgtctggcggagggggcgccgccgtcttgtcgcccgccatggctggttgggggggggggggggggggggaaagtaacgccggcgcggggcagctcggaaaggaaggacggggagaagcggcgagggttttcaggttttggttctggcgtcccgggtttttgctggtccgagctgctaaaatggaggcgaggccgttgggccgacagattgggccagaaaacttcggctgattgcagtgggcgtggcccggtgagcattgtaaagatgggagttcgcttttaaactctccttccagaccctcttaaaaccccacgtcttccagccaaacaataaatttaacaatccccaccctgcaactcctttctccctaataattcccccaaccaaacagctgttaggtctttgtaagagtggtaggtgaagatttagccgtggaggttgtatttctttggaattgtaagaaactgtcgtaagtttttttaaaataaaactttcaaacttatggtagttctttacatggtctcatttttttttcagaacaacgtccaccgtatggtttagcgagttagatttgattggaggttaagagtttggatctatggttaacgaggtagaattttggtgtacttagaatgcttatgaaatttgtagagcaattcgatgatttgaggcatgattagaaattctagtggatggaccatcagtatattcaggcactatatatgtcagattaactagtcaggtatatcaggtattccctcctgttgttaatatttgatgctgttgatttttcttttaacggatgccgatggaagtgacaacagtgaaggctcgggagaacgatgaggcctgtggcatgcagctctggtgctcgtctctgttgctcatcatcatccactcctcgttgcgtcgcacggcggcccgcagcatgctttggtgaccacctagtagatctgtcgctcgggaattcgacggccctgggacagttgcttgggctggatagaggttgctgtcgtgtgcttctcatctcactcaccggcatcccgctcctcatcactcctctcaccgtccctgcttccttctgggcatggacgcggacgtcggtaccagtgcagacttattgttcggctcgtcggtgccagacttgcggagaagagggaggctgagtgacggctccggcaacttgggccacttcgacggacaacggctgtagaaggacaagactatgggaaattttgtcaggatagtattttagggtgtaaacctggtaatttagcaaatcctaattaggccttattcggtttagaggggattaaagagaatcgaagagaattgagggggaataattccacaatacaataggtgtagaataaattctctctaatccctccctcatggggattaacgaaaaaggccttatggttagcgttttgaccaaacccctccctgacgatgacataatggcaattttctcttatgtttcatataaaaaactcaagaaatttcttatataccactaaaaatttaccagttttcttatatgacagtggaaattagctctttccttatatgacattacctcaaattttcatacccttttatgtcactactgtgttgattgtgtgttactgttatctccatagtaaaaagacgcatttgcccttatgggatttactgatgattataatatgagaactatttgaaaattacggagatagccagcatattaaaaatacatatattttttatatatccagcatatttaaaaaatatgtactggaaattcatgtggatagtatgtactgcaaatttgtatgatttctactgctttttatttatttggcatatacatctattgttggaggtatgtactgtttattttttacaattcggtatacactagatcacgtaatagttttcagaggtatatgtactgtttctttttttttctagtattcggtatattactagtggtggtttttgttttactacgtccatatatatatccacgctcgtcctcaccatgtagggatactaatttcattgatacttttagttagtactaaggttatttgggtcatttataaaaaagataacagtttgatcaaagactactgttagtcagagtgatggtaatggcataaaacagtgtgtaaatttgatctaacagcatatctcttatctactattataaaaattgaagatgtttttgtcatgaatttttgtatgtcgctcatacatataacttggctatgtttgactgctcttatttttactgtgatgtagccaacaaacacagtattttgtttcttttggctgtggcagcgcagcggcggtacaaagcagcgaacaggccacatatcgattctgatccatgcgtccatgtgttttatctgtcttgcgaacgattgcgttagggcgtggcctgaatcgttttctgtttcctattcgatccacgcgcacgattctcacacacaatcgccccattgtctcgtacaaggaaggaacaagatgccgatccctgattggtgtatatacgcacgagccggcgaggagagaaagaaaggcaaagcatgtcgtggacacatatcgataaattacatgcaaacattgattatggctgctcttcgattagccgcgacgcgagcaggcaaagctcgctttgatgtctctctcctatatgcctgtccagaattcaaatcatctgctaatcgcaaaccatcaagcagtagcagcaacaacaaggtaacgagaggctgcatacgtttatctaatccaaaggattaagtaaattaattacctttattatttaccaatctatgcttgcacaaaaatataatttttattatgactaggattgctggaagttgctcgacatgcttatatatatagagcatcatcgtgatatatatatatccagaacgacaaaaaatctcaatatttatagttgctgaatatttatttatatatattggacaaataaaaattgtaaactaggaacaaagtgtataacttaaagatcatccaattttaccaagaaaaaacatattatcatcttaaaaggctaaatagttcctcccattataacacactgacattttctcagtaagagaacaaccaattttaagtgatatatcagaaaaccaataaattttcagtggcatataaggaattctctcaaaaatctcgaacccaagatacagtcatacagctatacggtgccccgaatcaaaatactacctccgttttttaatagatgacgctgttatttttttctcacatgtttgaccattcgtcttattaaaaaaatacgcaattataatttattttgttacgagttgttttatcactcatagtactttaagtgtgatttatatcttatacatttgcataaaatttttgaataaaacgaatggttaaacatgtgaggaaaagtcaacagcgtcttctattaaaaaaacggagggagtgtgatacatgtatccgaaccaagctagtataaatactaagggcccctttgaatcgcagggtagaaaaaacggaggaataggaaaaacacaggattctgacaggaattgaaatgtaaaacagaggattgcaaaacataggaaaaacacaggaatggtcgtttgattggagcgcaggaaaaacgcaggaatcggatgagagagatagactcaaaggaaatttttcaagaggttggagctcttgctaaatttcctccaaaatccacatgcaatgtgccattccataggaatttcataggatttagaaagcttcaattctttgaatcaaagggccaaataggaaaattttctataggatttgaatcctataaaatttctaaataaatcctttcattgaaaggggcctaaaagaacaaattaaaggactagcgatgtctagacaaacctaccttccacggtaccgaagcgacgctgctactagatgggtgccgcgagcgagcgaaagtgcacggcgtgcggcggcaccggtggcgacgaagtgcagatcgacatcgatcggcgaagaagtgcgcagaccggacgacggcaatggcaaaatccctccacaagaaaacccatgtagtcccatgaccatgctcgccgtcgcctgcatagtgctgttcagcgtctcactggtgctcctcctggagtacatcatccgcccgcccgccccgaccccgttcctcgtcctcgcccgcgccgacgggctcgacgacaccaccggcgcccccggcgttccgcctcgagatgggcgtggtcggcctcgccgagaactaccacgcgtgcgtcggagggggcggctccgtgcttgaggtgtcgtaccacggcatggccgtcgccatgggccgcgtgccgcggttctgcgtccacgggaagcgggcgggcggcgagcgggccgacggcgtggccagcgcggaggcgacgtcggtgcgcgaggagctgcgcggcctgatccggagcgagcggcagatcgtgggggcggccgagttcagcgtggaaggggagatcaagggcttcggctatctccgctgcaaggcgctctggttccgggatgacaagcggaggagcccgatccctctgtgccaagtcgaagcctaaagtgtgtggcacgggctttttgtttttttgttttccttcgtatagcacgaatcttgaggctattggatggtccaaaaatcgacgaatcttgaggctactggatgatccaagaatcgacatgtttttccctaataacatgtcatcacttttttagcagcttccttttgtttttttttcttcgtgtagcacgaatcttaaggctattggatggtccaaaaatcgacatgtttttttcctagtgatatgtcgccacttttttctagcaacttcctttttctttttattaagtggtgataatcggggcacatgtgaatgatttagtgtttgggtacatcgaaacaaataaaactgattgtgggttagattttttttcccaactcagttttcaccgttgttatatcgtaaaatatcaggttgtaaagacatagagtcaaacaatcttactagatctgaatctaatttgagaaatatccataaacgacttaaaaaaactgtaaaacctcaaaatcttaaaaaaaaacttccaaatatatattttagataacttccaaccttgatagaaaaatgcttaagaaactgcttgatgacgtagtagcatccgatcccactatcaccgatgaattgagcggtgaagcagagcatgctgccgtatccacgtgactagattgcaggaagggaaggatacgttatatccacaaggggaaaggagatagacgacctatgttgagtttggaggtggttcttatatcgaagtatatctcatcatcattaaatacaattctactatctccgtttcaggttataagactttctaacatcgtccatattgattcgtctcacaaattaacctatatccgtgtaattaggtttataattagtttatatttaatactccaaattagtgtaattagatttataattttaaaacgggagtttggaggtgcttcttatatcgaagtatatcttatcatcattaaattcaattctattaaatattttaaaacgagatttagaaaatactagaattttaggtaacttttggtgtatagtttcacacttttcacagctgggccctggcaccgttcgccacgagaaattggacattttgccactgtcaaaagagggtttcgctatagtgccattccgccaattggattcattaaaatgccacctccaagtgatgccaaacatttcttttgccatattcaccattttactctattttcaccaatttttgtacccgggctgaccaaaatacccctttgggttgcttcttccagctcagcccttcttctagcacattggcgccgccgtcgccgcgacgcccgttgccatgttgatctcccagtcccagtggactatatcgcgcgttttttggcggggagcgaggcaggctagcttgctagctagccgcgagcggtgggtcgggaatggcgagccgccgccgcatggtggtgctggttggggtggtggtggtggcggcggcagtgttgttggtcgccgtggcctcggccggcgcgagcggcaagtcggcgcggttcgagctgctccggccgacctgacgcgcatgcaccgggagcggatggcattcatctcgtcgcgcgggaggcgccgcgtggcggagaccgcgtccgccttcgtgatgctgctctcctccggcgtgtacaccgggacgggccagtcgcatcccggtccgccgtcgcatccgccatcgtgctgagcacatcttcaatgtttctttctacacacgcgtacatgagttgtgatctggttgtgtatatattcttcatggacaagttcattcttttatctttctttttgagcggaggttcgttcttgttgttgcatgtatgttcatcatcatcatcataggatttaataaggcaacaagttaaatttcccaccggaggcggctggatcccctttcctcggcttgaaaatagagtgagctgagctagaagaagcagcagtcctaaaggggtattttggtcagtccgagggcaaaaattggtggaaatggagtgaatatggtgaatatggcaaaaaaaaaatgcttggcatagcttggggatggcattttaacgaatctaatgggcgaaatggcattatagcgaaaccctcttttgataggggcagaatgtccaatttctcgttggccgcgtgaaattgatccacgattgaatcccaaaagccccaaagccccacacactcctcgttctccagccacctccagccctactatgcctcgcccaaagcgccgccggtcgcccttgccgccgccggcgccgcctggcttccccacggagcggaaacaccatctgccggagctgcagcctccagcggtggccgcggcgtctcctggcgtcgctggagttcccgccgatcttggcgacgcgctcctgcgctgcggcaagctcctggacaagctcctggagcacgaggacgggtgggtcttcgccgagccggtggacgcgcgcgccctccgcctcgtcgactactacctgcgcatctccgaccccatggacctcggcaccgtccgccgccgcctcgagcgccgccgctacgcggacccgtgggcgttcgccgccgacgtccggctcaccttcaacaacgccatgtcctacaacagcgcgggcgaccccgtgtacgagagcgccgccgagctctccgaaatcttcgaggccgggtggccctccgttctcgcggcgccaccgcgcccgcccgacgccgagcgcaagcggaggctcagtggtttgctcccgcggctgccggtgggtgcacaggtgacggtggccgagatcatgaagaagcgggacgggtgcctgcgggaggtgaacgggatgatggaggtggacctggacagggcggactccgcgacgctggacgagctcgaccggatggtcgcggagcacggggccgccctcgccggcgtggttaaggtgaagcaggtaacatctggcagtgtgcttttgctcttaatcctgctctttagcatttcagtgaaccccctggaatctgtactcatcgcgtctgtttatagcgtagcaaaatctttgcattttctttgcaaaaaggcagtccttttcgaatgttaatagcaatgatggatattgccaagttcgggtgggatgtaggctgtgcccgcgacgtaatttcggtgtgtccgatttgcacaaaggaggatagtgactgtggaaaggggcgttttgtgttgaaatgttatttgtagggtgcgttggtgatcactgatcaggagcacaatgcaaatttcagtggatggactatcagtctattcacagttgggctcctaggatgatggggataagttgatggcaacattttcctgcttggttatttttgcacctggcaatgctcagaaaaaggatggtgtatgaaaatggcttgcgtgcactgctaattgtgctagtgactatgttgctctgttgctggtagaaacttttgaggctttttgttctggtcaatggtgattaaacctttccttctggcaacactgattcccctgatgggatggcgttaggtattgcgcattactgaatgtggtgtggtgtggtagaaacattgttatgcatttcttctaatggaaaggagaggggtttcctccctctagctcaaataaaaaaaataaaagaaatatcacaaattgaacatgcagatcaactatttgaacggatcggaaaattttatttatgggccctaagcctggccccattatgtaacgtggcattccacctgtacatacttagttcgagcaagctcaaaaagtgctcaatcgtcataagaggaacacaaaataatgtgttgaactgagtattcagtatatcatcagattattttcggatccagttgtatatctctgtgtactttagttcctctccattttatgtttccaacaatatgagttgaacttctgtcgttcagtaaaataccaggctccaagtactagtttgattcactgtttgctgttatcttgaactgtgctggtctctggtatctgtttttgacatttttgttcacttatctttactcctttcgaaagaaggcaatgatggtggtagtgaatctgtcaccccaccaactctattgtgtagagtactattttaccaaatactccatgtttttacctactcttctttcatatgctttaatattaaaaatagtccttctaactctatcttatttcatttctacagcacatgtttattatacaaagacacatatagggacaaaattctccccaaaccatcaaactaatctgttccaagcaatattagcacacatataatatattttaatccatagaaagcacgagtatttagctagtgttgtgtaaaaaaactgcatgtggatagtggaccaataaatagttgtcatgaattcaggcagacatatcatacagaacactgagtcaggagagtcattttgtcattaagacgctcctctttcattgcattgttaatctacctttttttgggaatacatatcactatatatgtctatgaataagatctgatgttgtgtgcattccccattcaagatagtaagtgccttcaatttaactaatggaagtgccatttccattgcacgggtacatttgaatttctttatagttgtctttgttatacactgtagcactatagtacttgtattgtatctacaccactatattcttgcccaatcaaaatgattatagtgcatctacgcaactataatcttgcccaatcaaaacgattgtagtcttatactacctccgtcctaaaatataagcgattttgattgggtgggacatagcctgtccagactcgtagtattaggatgtcttgtccagacttgtattattaggatatgtcccatccaatcaaaatcccttatattttgggacggatggagtacattctattctcttgattgatcagtcaattaatttgtcagaccgtaagatttctagcactcgaacaaagggctgtattaatcaaatgagttatttaacctacttatatcattacattttcaaaatcactcccccttcctcacctttcaatgtgtggctttgttctgctcgacatatagttaggttcactatggtcctgtactgatctgacagagaacattcagtaatgcgcttgtccatatgactgcaaactgaatgccttgtgagcttcttgttatgcatggcattcctcacttattattttatttgattttggtgtggggcttcgggctatcttttttatgaaaacagtttattctgacacctatcacttgaactattgcactgaagtaatcaattttttatctattcatgttaggagtatttaataggacaccatttgccaactaactaaacaatgataagttgttatgatttatcagctatacgttgttatgaggtttctttctattatatatagacaagggtaaacaatttcagcatttctaagtgtaaaattttcacttgataccatagaattggtctatgcacaaaaagacaagacaaccatacttcaccatgtgtgtattcacacatgtagttagtgaagtctggctgcttttaatacccgtgtttatacttcccagctcagatgcttaacagttgacagtaataacatatatatccagtaaagacgtgtttatggtcttatggtgcagatgtagatgaatatatgcaaatcttgacgtcacacattatacagatagctgctatgacactaagaatcatattgtacattttttagcatcgtcatagatgagtctattcttccttcgattttctgttctatgtttgatctttatgctatctttttttctgaactgtaggagccatgagtggtggataatcaaatttcagaaggtcctgcaagattctacctcagtgtcccttttttgtcgaggttcctgctctgtgaactgctgatatatctttgtttcagaatgctgttggcttcaacaggacttcgtgagaccatgagtccataacaccgtagttatcatatcctagatatgtcaactttgcattttgtcagatgtcataccgttgtgtttgtaagttggaacaagcgggggttgtatgttgggatcagggttttctgatactgaaacgtttggtgaactagaaggggaaaatatgcaaaaatatgcagtgcaaactcttatgtagtgtaaaactgaaaactattatatgatacataatatatgtctgaaatgtctatgttattatgagtaattctttctcagtgttgtatgcacacataatataggatacataatataactcttatctcgctgtttgtgtgtcactcaaataattatgaaaaaaaaatcaacaaaattagattaatatgtgataaatcaatcaacaaacatgcaagttaaaatttaacttctaaagttgcaacgaaaaaaataaattaaactatgtctagttaacgcatattcacagttataatttttttcgttgtaacttatagaagtaaaatttgatcttgtatgtttgtgaagtggtttatcatatattaatttatcttattgatttttttaatttttttctcaactatttagatgacatgtaaacaacgaaatgatgtccctcaaaagtataaaatagttttcccacagggagaaaatgaagcaataatattactaatctaggtgttagtttttttaaagtaaagtacaccgccgatctttaaaattgggcaaggagttatttaaatccacaatcttgttttaatgaatcatcatgggttcaaagcccatccgactgggctgatatgcatacatggttgtccagtgtggccataactttgcacttggccccctccgtacctagtcgatccgcttcttcctcaaatatcatctcttcttcattgtttcaatttatggttgcggtagcggtgacaaggatggtagcggagacccggttagggtggcaacgatgaaggaggcgggtaggacggtgctaacaagggaggcggctaggggtattcctaaagtgtgccggtaggagaggccatggctacttgaagcagcatgtcttctacaagtgccaagagaaaaaggcccgatctctcgttgattgtgcccttactgccgcaagaataacacagtgagctcattgcaatgatgtatgctaatcgggtcgtattttcttcactcgtcctcccacaaggttaggttcatctcccgcctcgacaccaccgattgcaccgccatcatcaacctatcgactgccgaccaaacgtgctacccaaatcgcatctccgtccaccacagagtgcccatgatcgctgacatcgcccttggagtcatcacaatagtgccgagcggagggggagggggagtgggagctattgctatggatagaggaaatattttgagaagtgggtcaactgggtgtggatgaggctaactacaaagttgctgccacactagacgactacgtcaacggtcaatggtcaacacagtcagacatgttttaaactcgtgatgatttattaaaacaagatcataaacctaaatgtctgatttacaagatagtgaagctaagtgacacctcattctagctttaaggatcgacattgtactttacttttttttttaccttttttactataagattgagtcaagaaatcattcggtttttcatctagtgtctcacgccagatggcagccatcaaaccgttcatattttgactgatatggggtaaaaaaaaaacattcgaatgatcattagacagtcctatcgtgaaaatattgataacataagtgtgtaaaagtactcagcgatcattcgtgctacaaatagcaatatagtcgcataccacaaaccactcatgcatatatcaccggctcatagctgtccgcgcgcagctgacgaggaaggtgtctccgagaaattcaggacgaacaggcggcggcgggatgggggcgcgcccttcgagcatgtccacgacgtccgtcatgccgggcctcatgtcccggctatgctgcgtgcaccacaacgccaccttcacgacgacctccacctcctcctcgtcgacgccagccgcgccgccgccgtcgccgcgcgccatggtggcgtccaccacctccatgagccggccttcctccatcctgtcccgcatgacgcacgggaggaattccttggtgaaatccggcggcgcccgcgcctgcgaggcgcccccgctgcccgcgagctcgaagttccggcgtccgccgacgagctcgaacagcatcatgccgtagctgtacacgtcggacttggcggacagcgcgttgaccagcatctccggcgccatgtaaccgagggtgcccctccagcgcgtgtcgacgctggtcaggtccctcccgatggacatggagatgccgaagtcggagacgtgcgcccggaagtcgccgtcgaggagtatgttcgccggcttgatgtccaggtgaaggatctggttcttgcactcgtggtgcaggtacgcgagccccttcgcgacgtcgacggcgacgtggcgcctccgctcctcgccggagaagagccagtagtcgagcgaccggttctcgtagaatgggtacagcaggtaccggccgccgccgggctggaggcagtatccgagcaagcctaccagcgcgtagtggtgcacgctggcgacgatggtgatctcgctcaggaagtcggcctcgccgacggactcatcacagacgatccgcttgacggcgaccgccgtgccgtcgtcgaggacgcccctgaagacggtggcggagccgcctcggcccaccacgcagccgaagttgtcggtcatggcctggatctcgccgtgcgagtactcccggagcagcccgtcgatgcgaaacgcggcgcgcagccgctccgcctgcacaaggggacgccccgcatcttctttcttctccggtggtagtggttccgccgcagtagccgccgccgccgccttgcggcggaggcgacgctcgatgcaggagagaagtgcttgataaggcttccagatgcagtacaccacgagagccacgatcgtgccgatcaaaatggcgacgccatggtcatttccagtggttgcttccacactcacgaccactacagtaactacagcaaggaatgttccggaaaccgtcttctccttccagcttgagaaggagcagaagtataagcaagcagtggcgacgtaggccactgattcaacagctaactttgccccgacgctatgacgagcaaagccaaaacggaccgcgaggaacaggataaccacagttgccgtgcgcagaaggaacttccctgtgttgcctcgcagacaggcacagcagcagcagcttcgtgcttgaggaggatcaacaactgagccggcctctacgtctggcataatgtctacgcaccacaggcaaaagcaaatgcagcaaagcttaagctattggaaacgaacgaaaaacagtagagtctgaaaaagaggacaggagcacgagaggtacttattggccttctagatatcgccatctccaaacagaatgatgtgatctagcaagagggacaagttgtggcctatagatgccgattttgaagtcaaatgagcagttgttggaaaagtagatgatttaacatacaaagaagcaggtgtcgttgtagactgagcgcgctggcatgaagtgagttatataggaccagttcgaatgagcatgcaatgatgcaaatatcaactagagttgacatctttccgcatcgcggcgatcagatcggtactagactacggccgtgtttagttcaccctcaactaccaccaaattttaacttttcatcacatcacatcgtatcacatccaaaactttcctacacacataaattttcaactttttttcaaacttctaatttttttcaggaactagtaccttccttcagttgtgtgggatagcggcatcggtgcgtgatggtggtgttatttttttcttttcctaactttaatctatcaggttatagtcttataattttttctactatattcaatgaaactttgcattaactaattaagtgtcggtttcttagaatatctttctcgttttcctttagcacacttttcaaacaattaaacggggtgttttgtgccaaaaaaatctcttagaaaatcaatatatatatatagttcaagtttataataattaatatttgactaatcatatattattttttgagggaacaagtaaggagctcctacaattcacggtttataaggaaaatcggatcaaaaaccttacgtcggcacggtcaatttataaataaccagcgaaaaccctcacattgacataatgaacccaagaacagcagtccaacaagggaaaaaaactcctaaaacgaagcattcaagaaggttacatcgacagaacggtgacaccgtccgatccaaacgaatctaaggttttcacccggagaattcccttaaaatagagttgaagctccaatagcaacacctataagaaggtgaacgacgttcgagggcatcgctgttgctagcactggcaagcagagcaaagcttttacctcggagtcccattcaaccatagcaaccatagcggaagccaccaaatgtcacctggctattcacatcacctgcacaatggcctgactccaacgagaggcggagccggactgacggcgccaacagtccggctccacctaacagccacacaggccgcccaaactccgtcgtctcgccgccaccatcgggggcccgacctcacccgaccccgactgaggacgcgtcgggtctggacctagaggagccaggtccggccatccccctcacaccaccaccaccggccgatgccataacgctgccacaacaccggatgcagggaggcaggccaccgaagccggaggtgactagagacaccccagatctggccggaggagaggaccaccggccatatccagctgtccccgtgctgccctcgccgtcgtcccgggacaaggaggccgctggtgccgagtggggaggagcagccgtcaccgccggaaaccccagatccggagaaaatgagggagggagagaagagaaaggaagaagaaggagagaggaaccgccgtcggcagcggcgacgcgagcggacgcggccgggaagcccccgcgcacacggccttttcgcctcccgtgtcgcctagagtgagtggcacgggagtcagggaatcccaaaagtgactaatcatatattagtgacttatctcgctttgcgtgctacaaaatttttagcagaacagctagctctaactcattcgatctttccattttttagtcacgttcctgtcacataaattctacttttgtcgccgataatctttccaatagtatgaaaaatgctacgtatatacgacattttgcctacgatcttcgtacagtcaacgtgtacgacacagggtaaataacgtcgagcgcgcacacgctgcaatccaagagcgccctgaagctcatatccatacttgaccttgcatggataaaacttgcttaatccaagccaggcccggtcacatgagaaatttaatgttaaacatctaagtacaattaccatataaaatcgactaaaaaaattactctaggctgtaccatgaggcttacgagatgacatgccaagacgtatgtaatgagtttgagctttggataagggctcccatttttacgtgggaccaaaagttgcaactgttacactaaggctgggagagggaaaagtgtttcattgtataatgaaaagattctagaatgttacttatcacacaataaaaagattctagaatattattatcacatcattcattcatcattcatttttttcatattacacccaactactttctcacccctaactatacctcatttaatgagacatcattgtcttttttttctttctccttattttccaaaacaatctaaaatctcataattatgggacacattacatcatccatacacacaccccacagtaccacacacacatcgatgcccataattgaatgttactcacttcatctacttttgatagttatatttcatcttggcacaattgaccgatgataagtaaccatttaaatatgctactagttattcctcgtaaacaaacgattcattaatatttacatttttcgatgcccatgtagccaatattgtgtggaagaatatatagtcacacattaaattcaagaaagtcattaagaggataggtggttggattgaaatatgcctatcaaaagtaaatttttcaaatttgaaaatatgtctatcaaaagtatatggatggagtacttctttcaataatatatttattgaaataaaataaaaggtatttataaaaaatctactaatatcaattttattatattatgagttaaaatttatcatgtttgattacccgcatgctgaaaatatttttatgggctaaacaaaccatattaaattaaataaaaatgattataaccctattttattagaggagacaagtgcatgccaacacaaacaaggggctccatatcatataaatggtgcgagagatataagcagacaagccttgttgtaatattagttgttctgacgcataggagtatatgaaatggtgcaaggatttgcgttggttgtgagttgtgatcttactgagttcattcctacgtacgcatgctctcgttaaccgtctaattttacaaacatcctagtataaaatgatgattaatacatgccgaacaatttaatgttcatatacctattcgtctttgtatttagttgtctttcatataaacctgacttaggtgccagaaacaagtctatatggtgaccagttcggtgcaaaggaccaatcagcgatgagctatagtagatttgtaggatattgaccacatcagatctgaggtctacgactttcatttctacagcattctccaacctgctacctctgctaaacaggatggagctgcaatcaactatttttgtttacttcggacgaattaactcgttccaaaaacttagaaacaatctgatacagaatctgcgtcactattgtgctatggccatcaccattcatggctacaaagagtaaagaaaatgtctgactgccctagctattctttcatccacgagcattgatatcgtttcatcttaaatctcatgtatcgcattaaattttacacgaatattgcaaaaccttaacagtgagcatgccctagttggtccggatattcattttctgatatagacttctgaactgctaagtcaattgggtgtgctcgggcaattggagcaggattatttactctactccacttgaattcatgggtcaacagactcatcagagtcactcctctctgcctcagcttcttcaccgtttgcagcgggtcgttgaacattacgcttggttgctggagcaggtgcagctttcttgccaccttctcccgctccaattacgctagcattctggtctatcaactgagtcaaggaatcttgcacatacagtgataggaatacatatagcaaaaattattttcatacgtaaacatggcatggaatggctcaacaagaaccagtcaattagtgaaccagaagcagtcagataactagtagcaggtattgttatttcaacataacagcctaccaagaaaatgatgcttgccttccaagttccaacaatacgagatgttgaagtttaggctcggcaccatgctcaaaaagttcatggtattaccattgtcatcaagataaggaactcattattatatatagtttattaacttctgattaaaaagcagtaacttcaagcaatggttgttcatgagccaattacaaactaaacgacaaaaaacctgtcaactaaagatatataaataaaaaacaattaaatttttactcaactgtaattaaggtaacatatgctataatttgataaaaccatcaaaaccaaaaggatactgacagatactccatgcataatattcatgagatgcttttcaactcggtgaaccagttctgcctgtaaacatgagtgaatggaacaataacagttatgattgacaaagtgcttccatgaggagctaaagggaaggcattgaatacatttaagtcaggctctctccggaaacgccgccttcgtgcatccctcattggaggagtaagaccatgtgtgtattcaattccttctggagcaggatcatcttcttctcttaccataatcatctgttacaaactcaatgtaagattcttaaaagcctacaattgataaaacagatcttaaacaaatcttatccttttacctgaccaatatcagctgttttaattagcactgaatcattgtatgtcttgtatgactccataacagttgggagatctaagagagatgctggaaagctttcatttccaatcataaatgtgccacttcttccatcctctgtagcacgaaaaaagaacaccaatccacaagtcaaaaaagattaactgaaaatttcagtgataacagtactagagtattacaatacaagttgtatccatcaaacagaaatagaccattgttttgaaccaaaattagaagtgagtagagaaactagacatgcacaaatagaatgctttagaaaatattagcacaaaccacatttccagaatctaaagagtagaacctgtcgagtaagaacattgcattacaccatgagaagatacaaattcttcaaagtataattactggactttagtcattttttatattgctaatagtgattaggcaattggacgtcttagaaagtaaccgtagcaaatattacatttgtggaaaaaggaaacgttaagagaatgatacaaggaaacaagatttccaaaatcgtaaagtgtgctattatctgcattcccttcataatgtattatttaaatatggcatctgctgctaaatggattactcaatatgtcatcattctcagatctctgcaggtaaagagtaaagagcacagagatcagatccccgcaactggtaacccgcatcagaaaccacaagcttgcaaagcattgccctttaatatatgtgtacaggaaagataattcttgctgcgttgaaaatacagtaccaataaaaaaaatctaccaacacgctatactgcggacttatgacctaacacctatatgacaacacaccagcatatgtccactcaagtgaggaacaacccatcggaagcgttccctggtgtacccgcacttccacaagcacagaacggaggttttccacttgcactcgcacagcataaacggtatgcgcatttcgccgaacagcgtagggtcacggtacctcgctagcgaattcccaacaaaaccatagcttttgacgcgcagctgttatacgacaggcctacgcgcatgcggaagctaaattctactgacagaaagaatcacctgagaaggagagatcgagggaggcgtcgtcggggttggaggatgacgcgccggcggcttggttcatgaggcgttcgatccgctccgccacggagggggcacacggaggatgaactgctgctccatctcaaattcccaattccgccgggagcacagcaccgcggcgccctccaagattgcaaattcgacgagcagccaatttacggtctcttccgccgttctctgaatttatcctggtggagagtagttgccgactatatattggtttagtcggtaaaattgagaggatcactagtgggccggaataactgaccacgggcccttcctgcggaggaataagttcatatgaggtcccttaacttgtcaaagaatccgatttacgtcctagactagaaaaccggacacaacatatccctcaactatcaaaaccggtgaaaccggtgcagattaggtccctcggcggttttgagggtggttttggctaacgtggcgcctacgtggctcacttgactcggtcttcatctgacgtgtcattgacgtggcgcttacgtggcaattcgatccggaaaaataataaaccccgtgggccccacatgtcagtctcacacagaaaataataaaaaatggtgggacccacgtgggccccacatgtcagtccaactcaccccccttcttcctcctctcctcatctcccctcttcatctctctctcctctcccctctccaagcgacggcggccgctcctctcccccccacttaggggccgccgcgcgccgctcccccccgctagtccccgtgcgccgctgctcctctcccgccctcccgccgaccgccgacgctcgcgcaccaccgctcctctccctccctcccgttggccggcgcgcgctgcctcctctcccgccggctgccgcgacgagctcgcttcctccctcgcggcgctcccatctgccgccctctccgccggtgcggcgcgcaccgccgctcctctccctcccacccgccggatggagaaaatggtttggcggcggcacggagctcctggaagacgacgacggctcgatccaccaatctaactaatttgcatgtattttcctgatgttagtgaggtctctagagtggtacaggtgcaaggaatcaacgcgaggctcaccgaagcagcgggaatcgaaaattgatgccggcggccggagttgaagaagatggggtcgatctccctcttcggcgctccattcttctcggttcttgagggctattgattgcactgatgaggagaggttgttggcgcgaggatttgatctgcggtggtccacagcggtcgggacggcgacgatgtcactgcggcggccgccggatgccatcttctaaagcaaaagaagaaaaagaatgaaaaagaaaagaaaaggatagacaaagagaggaggggagcagtgaggatgacatgtgagggagcggtgcgcggcagtgccagcggggggaagctacgcgacgaccacaacgtcaccgagctcgaccgccgccgctcctcctctgctgtcccacttgagccgccgcaacaagggccacctcccgccaccgattcctcttccgcccacaaccgccggagccgtgcctccaccgctgcgcgccgctccctcctcttccgccggccgccgcgtgccgctgtctctccgtcgcctgggagaaaattgcatatctaccatcgcataagattggcttcgtagaaataccatcacttaaattggcttcgctagaataccactcccaactagaacggcttcgccaaaatgccattttggacaaaaatgaccctgcatccgtctcttccacctccggcacgagcaaacggcaatggtgcgcagtgcagtagtgacgggtgagatgaggaaaggtcgacggtggtcttctccgacgagttcgtccgcctcacctagctgcgcggcccccaacgccttcagtctccacgacgcgccgcctccgtcgccgacgagttcgacgaatcatccccattgccggcgagttcatctgctgcctcgacgcaccgccccatcctcaacgagttcttccgccgcacctcaacgcgttaccctcatcgccggtgagttcatccgctccgctttcgtcgccgatgagttcggccccatcaacgttgatggcatcggctacggcctcctcctagcgcggcgggcaggatgaaaaggtagggacgacgaggatggcagcgcccccatcgtcgccggcaaggtggcaccggtggctgccgacgagctcctccggcattggaggaagggagaagaaccagggtcatttttgtccaaaatggcattttggcgaagccgttctagttaggagtggtattctagcgaagccgatttaagtgatggtatttctgcgaagccaatcttatgcaatggtagatatgcaattttctcgtcgcgtggagagaggagagagagatgaagataggggagatggggagagagaaggaagaagagggggttgagttggactgacatgtggggcccacgtgggtcccaccattttttattattttctgtgagactgacatgtgggacccacgtgggtcccaccattttttattattttctgtgtgagactgacatgtgggtctcacgggttttattatttttccagattgaattgccacgtaagcgccacgtcatgccacgtcagatgaagactgggtcaagtgagccacgtaggcaccacgtcagctaaaaccgccatcaaaaccgctgagggacctaatctgcaccgattttgatagttgaggggcctgttatgtctggttttttggtccagggacgtaaatcggattctttgacaagttgagggacctcagatgatcttattcctcctgcggaaacatgtggcttttctgggccgttcagttctccacatcaaccttgtctctcgtaggccgaggccctggagaagtccacatctcgcgttctcgtggacgcacgccatcgtggaaatggaggactaaaagcaaacctcggttggtggcccaggcccagctgaaacgtcctgaagtgagggcgaatccttcgccgtcacaccgcgtcagcgcgttgtctcgaggcaggtatatgcaagggtggaaggcaacgggtgctctttgatctgatgatgccgctagctagggctcgccctacgcgattacggatatatagaagtatggtctgcctctgtccatgcctacttattggtatgggctactttggcctatccggtcatcggctaataatgtatggagggggctagctacctccatggaatagaaacggtgtcatattccctgtaaccgctctggccatctcgtcaagtagcggctggccagattgacgataacagatacgttggcatcgtccctagttcatggaacctatacaaccgaacttaatcagctcaagtttggttcatagctcgaggggtgccaatcatttgtgcccaagtggaaactcgccgaagttgtaggcgtaacaattcgagctatggtataaattgcacaggacaatattgccacaacgcgaccagtgttcatatgatgtatgaaacctagttaaaactatgtttggcatgtgtgatattatacggggttagtacgaaaacggtactagctagtaccatttcgtagagataataacattccacgattccaaccatttctttgtgacccctattactccacccatgcacccctcgcaagtcgcaaaccgtccagacatcggcagcgccaacatggctgcaggcccctgattgcgccgccagagtcgacacgagaacccgtgcggcatcacgtcggtccgggcgaaacgggggtagcaatacaatgattgagccccccgccagcggcacagccaaaaaagtctagccgccgcatggccagcccagcgcgtccccgtccccgcaggtcgctcgccggaaaacgaccgcgcgaggaggaagggcgcgcgcggaccgaatcagcgaagaccaacgagcgcgcatcgacaagccccctcgtgacaatcaactgctctctcgatcgagacgcggaggcgctgttgcacgtccacgtacgcctcgctcgctctggtctccgcgcagaaacggcgacaccctctcgcaaaaatcttttcctcccgtcaggatcagatcgaccgtcgcggccagtctctgatatcgatcggttggtcgactacgacgtggctgatcgactgatgagataataagagaatccccctccgcgcgcgcgttacgcgagtgtgcgctcctacaccgaggaggcaacgagacgcggatgtggtatgggtggtgggtcggtctatcgacgactcggtgtatacgatcgttgatagaaggtttgacaaatgcggggcagaggatgaatgaaagccagggggcgagcacgcaacgaacgcaacgcaacgcagcggtgcgtgtgggccgcagcacaactaccacccagatgctaacatgatgcatccgttgcttggatcgggccttcgcttcgggttggctgccttttgataacgacccggttgaatcgagcgaatccactaaaattatcgcaaatggagatggtggctccattattggacgaaatcaattttagacaagcgtccaaacacatatgtggtgtttaatacaaaccaaatcgtacatgaacaaaagaggaccgagtggagtgaaaaaaaaaatatggaatacgcaacgcaggacgtacgttgccagcggaaagtagacagtaatgcgtttgtctgaaaacggatcacattttacgtgcacacaacgaatgatggtggtatatatgtagattaatctagcaaattaaatttaatacagcatcacaaatagaaagttacacaagaattataaacaccgtaaaaagttcgaaatgtgccactaaatcctttgggcggttcacagttctaacggccagagacggggacttgagccggcgtagctcatgtgccccctgttgttggccatgccctgcgtacgtatgcgtgtacctcaccattgtgattaaagaaattatgtggtggttaacgaaaggcctctgaaattcaacgccatatatttatgtacaaggctcctttgcaacatgtagcaagttgacagtgtatagtattaattactcccgttaatcatcttgcagtacgactgtaccctgaggtgtacgtacagtacacttgtggctgacaatcataccaacggctattcgggcaactagaatgccaaaactggataggtgtgtgagcttgactgccatgttataagttgacatttcccgttagtgaaggtgacctgcataaaaaaaaagtgaaaaagatataggtaaaaaatgccgctatgtttcctcaggcctcatcagctaccatgcgcaggacacgcctgcatgggtcggacaactatagtcaacgacagatcaggattaatctagacatgagtagcactcattggacgtgtttcattttttttatcctctagttatccaattttgattggagtcaactgagtaattaaccaattagttttaggccaatcatacaaaaaaaagtaaccggaaatcaaggtcagtgtcatatattttagctcctcttataggattactccctccgtactcgcgaaggaagtcgcttagaacaatatttaagtcaaatcttgagaatataaatcataaataactcttaatttgttgagtttgaaaatgtaaaaaatatatgaatagatttgtcttgaaaaatactttcataaaagtatacatatgtcacttttcaataaatatttttagagaaataaaaaaatcaaagttgtgttttggagaccgtgtcgctgtacaaaacgacttcctttacgagtagagagggagtactatttttgcttggcctagctttaatttgctgatgtgtttgcacaagtgaggtcacaaggttggacagcagggacgtgtatgtagctaacaaactaacactccctccgtccccctaatataaaggattttgatattttattggtactgtttgaccattcgtcttatttaaaaaatttttaaaattattatttattttatttgtggcttactttattatccaagatactttaagcacaaattttcattttttatatttgcataaattttttgaataaaacgagtggttaaacagtgtaagtaaaatattaaaatcccttgtattaggggacagagggagtagtacgatactgtaatcctatttacaatggaaattacaaaactctaatcagtgccggttagtaaggggttgtttagattgaagacaaaataaatcttactaaattttggcaatgccaaaattttgataagttgacaatattaccaaaattttaacatgatttcttatgtatttatcaaagtttggcaaaaaaaacactaaatgtatgcacatctttggcaatcttatgaggagaatcatcggtagaaccgacacttatgggcctccttggctcaaaagaaaaagaagccagctcatcaagcccatgctccgagcagcccgaaccctcatctacctgttgacgactaaatttggtaagatgtgaaccgggtttgacattgagatcgaggcggattcgataaagagatcgattcaaagaacagagtatgcattggctgtgaaggcattggctgaagtgtgcatcggctgggatggatcggacagaggatagccgatacagccgatggaggtgatgcagccgattccaatgaaggtggtttcagggctgtttctagactcgttcaaagtatttcatagagattgccacgatggggataaagctcttggattaggcaattgtacctattaattaggatatttcgtgtaatttccttagagatatgtttgggcaaaagtttgccgcaaagacttatggtatcttagagtttgttagagatgagtgtcgtgtccggcaaggacatatcttgtatctcgggtataaataaaacccgaacccatgtaatcaataaacaatcgttcaatacaatctcggtgcatcgccacccttttttactttcgtttatttcgacgagttcttactttcgggttgagctgcatcgattcgattttcaactagaggtaaaacttgttatggcggcttgcgttatcggggttaatgcttccatctttatgacactttaaccctgtttatgtaattcgtcgagttatcatatacacgttgtaatctatgttggtcgcgctatataacttgttatcggttggttcttattgtaggaaagcaatcaatagagttatgttttgttattgatctagattgcattgtgtatctaccatctcttgtaggttttcatcatctcgcttagatatcatatttgtctttatgcttaatgctgcatcggttgagttcgatctattaagtaatatctacaactatgatatctggattgttttatgatcatcgagagagatagtatcggggtttcagccgatattacctgatttagctttatgttttatatgcttaattgatatgctgaatctgcctgttatattaagatcttatcgcaataaagtatattaggcttctgtttgatatattctatccgttttaatatcttaacataaagtggtattggagtactagccgatacatgctagatctatctgatcagctatgctatgagcgtttataatcttcacgttaatgtatatttcgatctaagtgatttatactgtctcagcatgatgaccgatctatcccaatcacttggtttgaatatacattgacagaaagattataaagcgttaatatctatagccgataaagtagatttagttttactttgcttatttataactgccgatcgattcacatatgacatcggcttgaaaataaatgacatgtcatcggcgactggccgatcggcttcgtttatggatttaaccgcggtttcttttgtctttatttcttgttgattgtaggatcaaatcaactggcacgctaacaaacctaaaggcaagattttggacctgcactgaagttaagcagatcttccaggccagtgtgtatttttcgcatcaacactacccccgatccccaactttagatcaagaatccacattcatttccctgatccccaatatcagatcaagaacatacaaaataaaaaatccccccaattcacaaataaggatcaacttcatagtaatctcctaatctatcctgaataaaaaatgtcacatatcaaaagaacatatggtgagttgagaagtccgtccatgcgtagatctggctgcacccaagggaggaagacacaacaaccagcagcccaagtctcccatgccatctcccaccgtacacccaacctcatccatcgtcgcgcttgagcccttaattgccaccaacttggtgatctccttctccttcgccacattggctagatccgggatcaacaacatgaacacaaaccaaataacgttgtcgaccccattggataagaaaatagcaacgaaggttctgaccagccaaccggatccatcggcggggaggccggggtcgccagatccggtgtccccggcctcctcgctggacgattcggtggcggcgatggcgcagctcttgtgaggatgcatagggagagacgcaccgacgcttcgtggcgaagcttgtgcttctctagctggaaggagtggcaccccccttttgggattca

SEQ ID NO: 61034 - DNA, 700 bp, Oryza sativa
ccaccaaccggaaaaaaaatattttttagctacatgtgccataaacaagacatatttttttaaagattatgggaaagacagattattaaaaaaatttagttgtgtacacagaaatcaacatgtgccagctattattctatcaacaacttgtactaggcaaaacattacttcttattaaaaagagactcactgcaatcccaaagaataattatttaccaacttcatcagacccaagcatagagcaaataaaatatgacaatggagaacacagaaaatatttcagttttgctaaaaaaacagtaaatatttcagtggatgcatacttacttcaaggttcggttggtgcagagcttagattaatctgttgttgactatctactgtgtcttctcttctcttggatttcttcacctcttctttttggagaggcagcatgctgcagcctgcagaccagcgagaccttctcttccctcgtacgtgctgcctcctcctggatttgcttggggacctaagggattgcacaagaaacctgctactagttgttgatttggattttgcctatacgcttagtggatgggaggggatatggggatggtgaagagaggatttaggggtacagatcgagagtgatttttgggtggaaagtttagggatttgatggaggggagctgcgggaagcagggacaacctcaactgatggca

SEQ ID NO: 61035 - DNA, 1476 bp, Oryza sativa
  unsure (1)..(1476): unsure at all n locations
ttagggtttgcagtaaacagcattaaaaggcacttagttgctcaagctattttgtaaatacgatcctagagctatacaatattattatcaaaggccgtgaacccacacgaacctgtcttaacccaaggcctacgatgattcagaccgaactggcaacccgaccctgggtcccagctcgtcccaagccaacccaggccaaccattccacattttagttgttaagcaagttttaagaatttaaaacactaacttgggtacattgctcggcttgcccataactgagggcgcggctattcgaatagattatactctgatcagaggtgtacatctttacccacaagacatgtcttcctcacgtgtaaccacgtgccacataccaccacggcatacggacggaagacatgacatagtttccaacccatcctagccatagacaagagtaccgacccaaccccacctacggccggaacctccgggacaggtaggcaggactgagcccctagcagcaggacaccagccctgtgccatgacatatcgactaccgggccgcagctcgtgtagccttcattttccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcataaaaccattttgagggttttgaatagagggggaggtgtgaatccaattccacaataatccaatcattccatagtgtccaggtgatatgaatattcccaaagtctagagttgtaaaaccacctaatgttgcctaattaaccagcgaagcatctacctaagttcacactagagtacccactagttggggttttgtttattctagggtgaacaaggtaataataccaataccaataataataaggtcataacaaaggtaaataggcatggctaaataaaacaatgataacgcgggaatttaagtaaagcggtaatgcaataatttaaatcaaaataattttataaactgggattcaatatgttcaaggatgatgtgacttgccttgctcgctttcccaaacgtcagcttcaacctccacgtagagcggatcttccgaagctccagcgtctacacgaccagcggaaaggaaaaaggcttttactctaaaaaactccatataacaagcaggaacaaaacacaaaaatgggttcttgacttcttaaggaaaaattagagacttgaacggtccaattccgagttcaaatggccaagttatgaacatttgaagtttatatgctctttaagtgaatatttgcgaatttcatcatttaaattttaatttaaaaaggatttattgcttggggtaccaagcaaggntacaaaanngccac

SEQ ID NO: 61036 - DNA, 3376 bp, Oryza sativa
gtgattgctacaacttggaatcactacaaagcagacaaggactcaaatgggagaagcaaagctgatgtggttgaagaaggtttttgggtattattatatttcttctctatttgttactcctactatcttctcattactgttttaaacatatgcagacaatttcgttttaaaataatatgtagacagcagacttgtcataaaaaaaatgtcctgcaggatagtatatcgtttatggctgtataggttcctctttcaaagtttctgcatttttgtatgcatgcaagatttagctaaaacatgttctaaggtttggtgcttctatatttgtcttgtttcagctaaggttcaaacatcaaccaagccaagatcaggcgcgtgctgcaaaagtgcatgttcgtaagtgttgcggtgtgttgttgggatggcttaagtattatgctcgaattcaagccataatggatcactgtcgtaaggttgaaggagtgcagatctgtgacaagagagcagggctaagatacctctccaaggaagaatacttggcacagcaacctgagtggtgtgatcaaatggcttgggatgcaatggctactgtttgggttgatcctgaatggatcgaaaaatctaaaacaaaccgagccaaccgcaagacccctaaatttaagcctcatagaggaggatccaactctattgctacagtacgacaaaaactggtaacttttaaacttttattcatgttatgatggtgggttttttatgcattaaacactgataccttgattatgaagtccaaaaaatttgggagagaagtatctgcaattgaggcatgggttcatacacacaggggatcaaatcctgaagatactaacacactgaacacagaagaagccactttatgcttggtaattttctgaaattttcaatagtttccacatttacagtctaatattttaaaaactgatggttacctggacaggagcgatataaaaccaaggcaacggagttgaatggtccaaactttgattggatgaactcccctgttgactcaagggccttatatgaatgttcttgcggtagaccacatggaaaatgggaaacatttaatgggatggttgatgatagcgaggctatggctaagatcaagagaagatctacatcttcaacagctaacaagcgtcgacgacaagaagaagatgaccatgaaagagcaaggctgatcaaggatgctcgtatagcaaaggaatatgcacaacgagtgctggagtggagtagtggccaagacagctacaacaacactataaaacttattcttgaggtgcaatctgtcatatacctattatttttattagcataattctaaagcattagtttttaattttgtgtgctaaatatttgaattgtagagtgttatccagcatactggaatgcctctacctgttgcaattccacatccaccgccgccgccgccaccacctacatacggagtttatcattctgcagatcaatctacggtgaatgtatgtggtcatgtttctattaatattgcagatgtgtcctagagatagattttttttaccttgcaatatccagcaatttcaatgtcattttagtggcgtttactatacatatgcaaccattcaagtgtagcagtgtcatatttatcaatctatctatctatctatctattatatactaaaagtccattaaacttcctataaacgctcccaagccgccatgtggcgctctaataaatacgagaaatccaaaaaattataagaaaaaaagcaaaacatccgacctttaatttttacttaagatggtggaccattattcttcaccattagatcttaccttaaaaaaaatatcctaaaacccaatccataatctcctcccacccctaacccaccacctctcaggtggctctcaagtacgtacgagacctcctctcccctgacgtacgtacgtacatacgtctcttcctctcctgtacttccttttgtcttgccattttccattcaatctaccaattttctacctagcaaaattcaatatgtaaataaaagtaaattctctaaatgattataatttttacattatattttatttatctacattggccatgtttggatatacaagaatatatcttttggaaaaaaatcctatcttttacatgaaaaataaaaagtaattaaatattaaattaataacatatatatgatcttcgctcctctctccttgctcactttctcctccctattttgtagctagcaactcattatataaataaaaagagtaaatttcataatactatatctatctatctatctatctatcatatactctttccgtcccagaatataggatgggtctcatcctatcttaggttgttacattctaggacagaggcagtactaaaagtctattaaactttctacaaatgctcctaagccacaacatggcgctctaataaattagaaaaatccaagaaattctgagagaaaagcaaaacatccgagatgaaccaccacacctaagacagctaaggtgatttaccaaggtcatcacgagtgtcgcagcaatactgatttgccaaggtgaagatgaatcaaatcatcagtgtataatgtttgttttgttaataacacttcaattttaatttgaatttaatttattaaacatgatttcttaacaaaataagtctactttgtttctcgataactggatggataattactcatagggatgaattaaatattttgttgtataaaactaacaaatagcttataaaaattatcaaagaatatcgttgaaaaacaatcgtagagaaatacttttttgaaatttgaagcgtagcatatactgtctggttaatattccaatcttataaatttcttgaacacagcttacgatacatgcccgcgtatacgcgcgggctacctttctagttgatactaatagtgtaatgtctcagtggtctttatgctcatcgtctagtttattctatacttgctactgcaaatcaatgttttgttcaataccatttgttacaattacatgaaaaccattaaattttatccattgtgctttcaaatttctgtgttggataggctcgtagcagtggctcagttgttggagctggagaagacactggtagagaaaccatctttggtcggtcgacccatatccacaatagtcccggttccattaaaaaccgggactaaaaatgatttttagtcccggttaataagaggaagatctttagtcccggttgttgttaccaaccgggactaaagatcttcctcttattaaccgggactaaaaatcatttttagtcccggtttttaatggaaccgggactattgtggatatgggtcgaccg

SEQ ID NO: 61037 - DNA, 1149 bp, Oryza sativa
ggtggagcatataagtcatactcataggtctttagtaagcttcctagaagattcacccaaaatctccatagactgcgaccaacagtcaagcctacaatggtgagttctttcaagaatgctctgcaggacagcatcttcgttaattaaagccaacagaactcattaaggcatagccaacctgccttgcagctcacgacagtacatgcatcttcacttagagagggtataaattggtactctcctctagtttactaatggtttgttcttcccagattctaattcacgggatctccgatcacatagattgggttaccaccatagtaaaactcacatgggtctcaaacccatctccttcgatgcattgtctatcacatttcgtgatagtcccttcgtgaagggatccgccaggtttctagctgtttggatgtaatccaacgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgctgtcaactctgcttccatggttgacctcgtcaaaatggtctgtttgcaagacctccacgaaacagcaccaccacccagtgtgaagacatatccactagtggctttgatctcatccacatcagagatccagttagaatcactatatccctcgagtaccacaggatacccagaatagtgaagccacaattccatactacctttcagatagcgcattactcgctcaagcgcacgctagtgatcatctctcggattagaggtaaaccggctcaacttgctcacagcaaaggagatatcaggcctagctgcactagccaggtacatcagcgagccaatgatttgggagtattccagttaattcctagcaattctattgttcttgcgaagcaacaagctagaatcataaagttttagagaaggcttactatcaatgtagccaaagcgattcaagatcttctccacataatgggactgcaagagtgtaatcacattcaaacatgg

SEQ ID NO: 61038 - DNA, 1007 bp, Oryza sativa
tgttgtgatgtctccttatcatccatcacaaattttccaagccttccttccaataattcaatcttggcctcacgaacggcgggagatccctcatgagccaattgcaaattatcccacatctccttggccttctcaagtccatcaaccttgttgaactcatccgaactcaaggcggagagaattgcattggaagcttgggcattgcggtggatgagtcgctcttgctccgaagtgagctccatgtcatcatggggtatatcaatacctgtacaaacaactttccaaatacttggatgcaaagagattaaatgcaacttcatcttgtgcttccaagcggcatagtatgtcccatcaaattgaggagcacgcccggaaggcacggagacaaagttgtgagagggaatggtaagtttgctgtaatcaaaaggtatagtagctcccttgtgtggtggagttcccttgctgcttgcttcatcttcatttctattttccccgttctttccccctaagtcttcatcttcaaagcggtgaagcttgaatcaagagcactaggctctgataccaattgaacgtgcagagatgtagcctagaggggggggtgaataggctttcctgaaattttctcaacaatcgcagcggttaaattgacagggcccggaacctcctggtgatgaacaccggaacttccgggcaggatgagtagcctagaacttccggagttcttgagccagtaacttccggacagcagggataaattgaaatctgagaagaaaaacgggtcctaggtagaaagatcaggcgcacagatgcacaagatgaagatcacagaatatcagcagattcaaacaaagaacatgcacaagagagacaaagaagattttttcccgaagttcggatcacacagatcctactctccgttgaggtgctccaaagagccgggtctcgattaaccccttgccttacttatgcaaagatctcagaagaggtccacagccttcaactcaaca

SEQ ID NO: 61039 - DNA, 990 bp, Oryza sativa
tgttggttgcggaaattccccaagcggcgcttgtgcgactccaggtccttgtgtttttcttccaagcggatgctcttgatcaggagacgttggaaatccggataatccccggagactagacggacggacaggtcaaggtccattcctggcaggaacttctcttgcttctcctcatcttcccgcacatcctccggagcgtaacgggccaggttgatgaactcgtgcaaatactccatcacggagcggtcgccttgcttcaactctcggaattcccttttcttaagggccacgactccggcgggcacatgggttcttcggaaagcggcggtgaagcgagcccatgtaataggctgtccctctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcatccacggggttgttggagctagagaaggtaggtgggcggatgcggagaaactcggcgagtttagagtgttgtgggggtggtggtggagcattaagttgtggcggattttggaggtggtggaggaaagcagtcatcatgttggcctgctgggcgaggatttgggtgagaatggcgttggtgtctggtggtggtggtggaggtggagaagaaggtgaaggtgggttgccctgatggttgtggttgctgccttcaggttggttgccatcaccggtgttagcacttctcctggtcatcaccatctgaaaaccccacacagaaccagcaaacagagagagctgacaattaaagctaaccacccacgactaccataattcttgaatttattactgctattaaatgggttcattaaagttcaagttgcttaggcgaataaaataaagacaggctccgacacagttacaccacacaccggcataaccgtgccccacacaa

SEQ ID NO: 61040 - DNA, 5664 bp, Oryza sativa
ccctctttttccctcccatcgcgtatccacgtcggcaatccggcgagcttcgccaccgtcgccggccgccgtcgcgccccttctttccgatctgatccgtggaaccgattccccgcctcctcctctcgcttccagtgcctgccgcccactccgattcgccgccgttcgccggagcgcgccgagcgccgtcggccgtccgatgagccgcccggcctcctctcccttccctgtccgacgtggcgtccacgtggacgccacctcagccgctgaccccaccagaccaagtcaacccctgcccagtcagccaccccccttctctctccccgttcgtgggcctggcccatcgaccagctccccctcctcggcccattgaaacaaaggaagtccatttttactccctccgccaaacacaatgaccaaaagtctatatatgctccctcccaattcacctctctctcaccatatgttggccccacatgtcaatgagtgataaaagggtattcttgagaatattcatttccataaatgcaataaatcatatctcctgctccataaaacatttcctatattccaaattccataaaatccttcctcttaatccggggatttcaataattcaacccattggtcctgcatgttagtgactgtcaataatactcttgagaatattatttctataaattctataagccatttctcgtactccaaaaaaatccgatagatcatttccttgtccagaaatccaattaagcttccaaaatccatatctcctcaaccgctcgaccgattgactccgttctacttccagtagttccgtaaaattgagatctatttaatgtcactattaattagtctaaataggatctttcttttggtcttttggttaggtttttgattgtttgcgtatagttgcggttaccagattttcatcaagcggatttcttgaagattcgtgaagatcaagaccctgagcaaggcaagccacctttgaacatattgagcctatatttgaacttaattatattgcttgcaaaatattatgcattgataggattgcaattaatatgttgccccgtctgcgaggcagatcggtgggcatacctaacttgttgcatttgatccttccattgttaattgctatatcatgtttccttgtaaccacctggtcgcgcctcggtattcgtgcactctatgcgagtatcgacggtcgccttcaaacttaaaatatgataaacatcttgggtaaaacttggtttacaaaacgattgggaaacccgacgcctgggtcggtgccttgtgaaagaaaatgagctttaaaaataaaactcgcgacacaagaccattcctgggcgggaagcttgtgcggtcgcatttaagggccgattccttcggaattacatccgagcatataatagtacaaccacatgggtggaatgggacacccctggctgagtaattagctaatcaggggagccttgatgccgagagacaagtggattcgccggggtggtgtcggggaggacccctggtcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgccgtgtgggtaaagtgtaccccctctgcagaggttatcaaactgttcgaacagccgtgcccacggtcatgggcagatgtgaggtgattccttagcgtagttttcgttttaccctgctttgtgaaaaggtgttaaggtctgggaaacctgatttttggaaagcaagtggctgtcagggagacagcgggacagggagtccttgaaagtgattggttgtttggagacgacctaactctgaaagtttggaaaattggtttggtttgggaaaccagcttcgaggccaactctgggagttgtgcaaatcttgataaataaatttggtcacttctcacccccctccccgaccaagctgagacttgtctcgctctggttgtggaaagcacacacttagattgttgaaaacttgcaaataaaattgattgaaaaataacagccttcccttgaagcttgcattaaccacctaagttcccatggcttgctgagtacgtaagtactcacccttgctctctatataaatatagttctgccagctctgaagatgaagttgaagcaaagattagggtttcgtcctagttcccagccgtcccctgtggtgttgagtgttagtccgttgtttccgctgctgctgccgttgttggtgttgcctcgtccgtgtcgtcggttgtaatctcgggctgtcctgagttgcaacctaagttaaggtaaataagtcctctatttattctaaggattgcaatgattcatatttgtcactgtgggtaccggcgctatgtcctgggactggtactgagatcgcggtttcgtaggaagcggttcgcgccgtttttcctacgacacgctctaatcaggtgccgctgtacggcggtgccggattggggtgtgacaatattttgttttcaatttttctcctttatttttttcgaatcaaaacatcacgtcaatgccatgtgggatgaggacctagtcaaaaggaaccacgtatgtgccacgtcatccaaaaccggtcacaatattgccgagggacctcttctgcatggttttgtaagttgagggatgtgttgtaaccggttttgaggatgaaaattaggctgggtgacaaattgaggaacctagagtgaacttattccacaaacaccgaagataccttcgttttcactggtatgagttcgctcggtccagcccaattaaaattgtgggctttactccgcgaagatttgctacgcttaatttcgttttggaccccgtgtttcatcacgaaggccagcctatttggagcacagctttagtaaggcaaagtcagtccactttatctccctctaatattggtccaaacttatccgtatcccccaaccgcaacatcagatatcttggctctaactattgaagccggtgcaaaatagcttcccgggtggttttgtgagcgatttccgttgacttggcccgttgaatttgatccaactagctgagtcaacatatgaggggcacgcatggtcagtgtctcatccttctctttcttttctctctctcctccctcatcttcctctctccacatgttctctctgcaaacagccccttgcatctccaaccctcctccatggcagctgatgaggaggatgtggtggtctagccagggagctagcagggccgagacgatgggctcatgtgtggaaggggtcgacaacaggatctggcgccatctccatttgtggccgacgggaaaggaacaacgcatctcatcgggtggtgtcggctagaccaggattaactctctaccgctcccagacctaccgacgagcgtggacaggaagccgtggctatctgcagtgcgcaaagtcagcgcagcgggtatagcgcaggaatgaccagaccaggtgtaactcctggttgctcccacacctgtcgacgagcgccgggaggaaggtaggatgccactttgttcccttgtcgctatctcgctaggtgcctttcaccaggcgcgcatactgatgggtgcggcacggggggggggggaggtggtgccggccgcaagggggaggatctcaagcggcgagaccctccatcgacgatgcggagccgggacgaggagtggcggcttggagcatgctccccatctcccccaatgccttccaccatgccatctttgtctccgccgctggaatcgtcctgctccatgccataactcctcatcgaggcaccgcttgatgcggaaggctttgtgctgtcgccctgcggccaccctctgcacgtgtacccctctgctaccgccaagaaaacatggggggagagagagaggggttatagaaggaaggagagagagagagcaagggaagtgtggctggtgagtcatattttattttttattttgtttgacgactaggatgacacgtggatgtcacatcaacaaataccactatcaattttatcatagagttaaatagtaatggtttcaattgttacgggggtcaagatttctaatattgtggttgagaggtacaagttagattggacccttatttgagggactcaatctagacttatttctaaggaaaatccatccaaaaattttaagctctatctagactgtgctcaaggagatcacatatgggccaacaaggcttcggttggtaccccaaactaagatgtaagcattttccagcgctgcacgccgttaatcccccccccccgcccccgcacgcgctgtagcttgtggatgcctcgtgcctggcataaactgctatcaaagtgacatcatcgatggggcattccggtgacgcacaagtcatgacgcatttgatagtagtaggtactttaactaaaataaataactgatcgtatagtagctaaccgttgaccacagatgacctatactagcccgtcacagatgagtcatctgtgacgggctatagttaatgcccgtcacagataagggtcatctgtgacggacgctagttgtggcccgattgagataggtcatctgtgacgggctatagtttgactggtcgtctgggtcaaagctatcggtgacgggctttacttagggcccgattgagatagaatcatccgtgacggccgtttgcccgattgagatagctcttcacatcagtgacttctagcctgtgacggacgccatgcccgattgagatgaggcttaccgcccgattgagatgagggtatccgttatagtggttgtattaaatgatccatttttctagcttcgcttcgggctactaaattgacaagacaagcctggacataacaaataatcttttgttgactgttgttatgttcttagctttcaaaattaaccaacaagaaagtcagtctccccaacaactgaagcaaagacatacatatagataattaattaaagaggccgatcatgagaattgatacaaattatacaaattaagtaattgatcgatctagtagaccacaacgcttccttagaccgatcgataaatatcaaatccattacaattattactggcttcacgacgacacacaatttcattttattaattactagcttgacgactcaattaatttgaaacaaaggctacggactgcgtcggcctgcacagttcctgcaagattatagaatcatacaatatatatgttgttagtcaccattaattcccacacgtagataattgtctaggaaaataactgttaattaacttgaccaagattatattttgatcagtggtcgatcaccttgaatattgtggtagagacgcatgcatatgatcagtcgtggatatgagcaccgctgataatgcaaatggcgtagatgatgcccggaagatagccgaggcaggtgaggaaaaggcagatccagaactccttctgtacgtacatgtatgtaacacgccgaatcaggtcaggacccatcacaatacacatcatcagatcatgcagctacgtctatatatatgcatgcatgtgtgcatatatatgcacatcttgatca

SEQ ID NO: 61041 - DNA, 7393 bp, Oryza sativa
caggtgcagctcgttaataatcaggggccgttaatcgcctctctaagctactatagccccccttagcttgccgatcacacgctggcacaggtgatacgtacgcgaaggcggcacaagcaggagtgatatgactgcttctactgtgtgctgccaacgccgatgacttgagttgtatcatcagcgcctagccatacatatacagcagagtcaatcgccagtcgtcaacgatttcttgttaagttaaacccaggccaatcatgtttcgattatgatctaacataatccggcggcgtcgtccacagttttctcgttggtctgaagctaggagtagactgcacatgtactgacaaccgttactctccttggctactgtaccaggactcaaacatgccgtgtcctgctgccatctgctttctcggctttcgtgtgtacgcaggtatctctgtcgtgtgtttaacgtatagcgggttggtttctctcttttttttttcttttttttctaggatcagacctatcaacgtgtaccaacgccacaaagcaagtccaaccgtcaatccaaattagacacttcaaacacccgtatagccaagtttctaacggatttagcaagttaaacttgttactcactctaatggcctctctattaaccttctccaaaataacaactggacctgtatatcagcctctactccccttctacttcctcccactccattatccaagaaaccaacatcaagaggagctagcacgatggcagcatcgtgcaagggccaaaagtggggatagcggcgcaaagaggagccggagatggtgggactttggttggcggcgaaagtaaatggagatggcactgtggtggcctttggaatcggtgctaaggattggtgtcggagagagagagaggcagcggaaattggcggcacgggcaagggctaggagacaatggcgaggcgcaacggcggatggtggcaacacttatcgatttgtttttcgaaagcggatcggatggcgtctgaggcgaatgccgcaaccgtggtggatggtgcatctccaaacgacgactcgggagagagactgtggggacaggagagagatagggagatacagacatggagcgatgaagccaaggccagcaacggcgaggcacaccttcttcctgagcttcggagcagtagaggagggtgccgaccgacggcggtgagggcaagttagggtggtcgtggggtcaagaaggtcgggcaccctgtcatcggccatggcgacaggtagagaaaagagatggagatgcgaaagtgagagagtggagaatggcgatgagagagatggtagcagctgaccaaatttggttaagttgagcgcatgtttggcgagtaatatggtcagtatgattgagtgtattttttatccatagttgctaaagttttttttgcttagagagtgaaataaagagactattggtgacgctttaaattaacacatgatatatagtaccaattcagctaccacatgatctgcttttacgaagggggtgtaactcaaatggataggtttctagctcgttgtgaaacctaaattcatgggctcgtatttgattaattatttttcagtggtaaacgatgtaccagtaaacaaacgtagctcgtacattgtacatatatatttattggtactctacaatacaaccaaagaggcaatgaggaatgttggcagcgagtcagcgactggccaggcgtagcaatcagcagatcagagcaaagtcaacgtaactcaaaattactactaagatcctactccagtatatatgtgaagatgtcaatatacagctggtacccgttttctgacgatgtacgagagataagaaagtcgaaacccagctacgtcgtcggtactaattagcgcgtggggcaacgtgaaagtcaccggcgccacgtgaattcacatttgttcgttgccaccggcaattttttaaggaagccatcccactttattaatctgcaaacatatagttacatcattcgctagaacgttgagaaaaatatagagaccccatcgacccaactataaaaatttttcaacttagaaacatgattagctagaacatgtgccatgcaattaacttccctattacaatactcaatcaatggagactttaacataatcacataaaaaaagtatggtatttatagaaaaccaacgccgacgttgttcttgaaaaacttccatcttgcatcgttgccaccaccattactgtatcagcaacataaggtaagtatttgcaacaaccagctacaaaatttccatgtgcatctcatatgatcgactactccggttcctcctatactagtggtggatctagaaaattaattcgttaatgtcatagcatgcaaattatatttagactatagtgttataacatatggataaacagtttaaccataagttttaccgaaagtcgtcagtgtcgcttgacatcgacgctaacactttagatccgcccttgttatgtactcaagacgatgtcaaagtaaacatctacatttaccttgaggatttctttaggaggtttatgctatcctttccatgattttgcatctgtttttttcttcgtcatcctataatttagtgtaagagcaataataaatatagctgatctagcagccacctgaatccttttaccgttcaccacttgcttctttcccaccaaagaaatcatccccgataaaaccagttcagcaaaacccacttcataattatttctttgccgccggctttgctttgcgttggcttttgatagcttgtactattattcttcgtacgcttcccggcccaaaatcccgcacaactacacccagcagcacggcccagtggcccacccatattgatgggccggtagtaagccccatccaaacaagttgtgggccctcatgtcctacgggcctcgcggacccggcccggcggctggtctaccctccacgccgccggcctgtccgcctacgccgctctcatctccctcttctctctcctcctcccggtgcgctccgtactaaccatccatgtctccgtcgtcttcaccgccgcctgtgctggcctcctccatatgtccacggtctccaggtgcacgcctgcgccggcaaggtcgtcgtgcggcctggggatgtgttcgtgacacgccggccgatgtggctggcgtgtgtatacgccaagtgcggacacatggtggccatgacgaaggcgttcgacgaaatgccgcaccggggcgtgccgtcctggaacgcgctcatcgtggggctacgcaaggaacggaaggtttcctcaaggctcaaagggtgtttcatggagttgcggcgcagggacaggaagtgccgctaatcggtcaggtgatagtgccaagtgcactgagcgcaggtccgtacttatattacatcatctaattataaggtggaactgtaggtgtgtgcgctgtgcctgagcaacacgaacgcccttcttgatatgcatacaaaatgctgctgctaagcgcttcaaggaagcctgtgttgagtttcttgagttgaggcccatggttcaggggtggcgtggcgttttgcctgatgatatatcatttgcctacttcattgcaagattcagcatgcctagcatcatatattctggatgaacttgtcagagtataggatgctaggtttatgaggcctgagagatgctgatgaacttttcaggtaggaaagctcgataggtggttaagactgaaaagtgagaactttagagaacagagaagagagaggttaaacgtccttgcaaaaattaagcatcttcttcagactgaggaatacagaggtgaatatccttgctaaggaatctgtaggagatatgctagcacgagcagaacatatgctgtgctctgcctaatttctttactgatttatgcagacatgctgatcagctgatgtacaccagatcaggatgatggacaaggagagcatccttcacaacacgaagtcgttatttggagattaatctgacagccgtgtgggttgggcctaaaaaggctcacctgcagcattccagggctgattataaagtttcttctttgatcttgtaggtttggcagaaattgtgtttttgtgaattgaagtgtgacatccattgctagactaatgtcactaaaaatttgtgttttcaggctttcaacattcagtagtggaatcgtagcaatttgctgaatcatcatcaagcgagaaaaagcaatctcttgggataggcttggagaaaactgacaattatatatcctaaggcaatatcaaaaagatctaccataatatttctggtacttttcttttatggaatgaattcagttagttatctttgattcatgcctagatttctcatactaaagttttctaaataatactttacctttgaaatgatggtagttctgtgtattatctttttagagaacatgaagaataagatattgataccaaaatatttcttccatacgtttaaattttttttaaagaacatgaagaatattggattcagatttttgcaattctaataaaaattttattaagtgctcatagaacataaaaattgcatttttagctgcgggatgggaggaatatgttaaaggccacaaaatttgattccactgaggtaaaatggaacctttgtgttatcaacttctctactctctttaacgaatacatgatatttacaaaccagttaaagaagtagaggaaaaataataatcagttctgctatacggtaggtagctgataatgctacacttctttactataatgtacactgctagtaagtataatctcagcttcagcaaaaatctttttcaactaacctacatataataagggccctccctccaatgggaaaaaaaaaagaagaaacaaagagaaattcaaatgcaactgttttagcatttatccatccttgcaatcctgagcttctttacgctgctcaggaagagtctgtaaaaacaataaaaaaatgagtaataagttaaatcagaagtagaatgaaacgcaaatggatcagttaaatatgttaggatacgtactcccatgggacgtccccaaccatcatccagtccccgtcctggtcttcataggtgaggacatgggcagccttctggccaggaacttgttgatggcactccataacatcagcatctaatcatatcaaacatatatgattatatacaacacccgacaaccatcgccatgtgtatatcatgacgaggtgagattggaccacatgaaaattgaattaatatctatcgatcgatttcgactcgacgtgccaaacaagaactcttgaaacaaaagctttcagactcatccgttggtggcctgtcaaattgctctagcaaaatggtactagttgctaatactactcgctgccgcgcgcgctcaagaaatacaattttggatgatatattgtattgttctccaatgctgaactgttcattcatatttactaaactaattctctctttctcatgttttatacaatcttctaacccttcgaaattgtagtgaaatgcagattaattggttggttgcatacttacaggtgatgggcgtcttgaacatgtggcagagcttgatgaggaggctgtcatacccatccagcaagagcaggtcgagcttccggccgatcgggacgccctccatgtacaccttcacgaacagcgttcgccgtcggcgagcgccgccgccgccagcggccgacgccttctgcaaggcgctcctgaggaacggcttgatcggcggccaatcggcgtgcacttggctgttcctgcatacgccgcgatcaccgggcgcccattcatgttgaaaggtctgttaattaatcaactaattgatggagatgatgggtacaagcgacccaattggccaatgggatggagtactgttgcgcaattaattttcgggtgcactgtatctccaagaaacagtaatggcaacaggaatcttgaagtggttttgtagagacaggaataatcgaattggtctacaagtttggctcatgtgagaaatctgactgtagctgttgatgtgtgtatttgtactgatgatgatcaagtcccttatcagaaataaaagcgtacgatgggtcattgacatatcaacagattggtgcgtgtgatagaacggtttgtctcattgtctgatctaattaaactgcagtgaacttgaagcatttctcttattttcttttatgtagattacaagttttggtttgtactatagtagtctaggtaaatatgcagctatgcactgtcgaaatgatcgatgcaagtgatcaagatctacttatgtgaagggataggagaaagcgcatagtaagatctgaaagatttacatatgcatgtgggaacagtttgatcaaatcaatcgtgtgtttcacaacaggtaaaaactcagataaagtttttttttcccttaaacttaaaaaacttacataagccccatcagactacatatacatgagaagcatgcacgatggattcgtataaagaaacggagatttttccctaaaacaaaacaagatcgatagatagaagaacatagaacatcaaaaactagtataattacatatcggagtatgtatatatgttcgaatatattttaaatgaagaacaaagctatatgtgtttcaatattgaatcgaaagaagaaacgaaacaaaacttatcaaactaaacagcatgaatctttgtagctagggagaggtaattaatcaaaaagcaggcttcgcggcaagaaactaagaaagaaagaaatctaataaccttggagtagaagggatgctatcatcagcagcggcggcggcggcggcggcctgcaggagggaggacgacgacgacgtcgagaggctaagccctagccggagatcggtgctgaggtcccgcctcgccgtcgccgccgacgacgtcgtggacagcgccgggtgggtgctgctatccatggaggaggacggcgacatgccaccgcccttgcactcctccatagctacgaatgcttacgtagaaattaatggagagatcgagagagagagagagatggatcgagttgagaaaaaaacaagcaaggaaagagagcagctagcttgtgatgtgtatatatagctggaggtgagcactagctagaaaaagccaaactatgctgaactaaaaatttgtgcgcatggtagagagagagaggattaattaaagctaaagagggaggcattaatcaatctgattagatagattaattaagtagttaaaagaacggtggaacaatttggcttgctttatgcaagcgtttttgttctcaattaaaaataggctgattctttcctgtgcttgatatctaggtggacacaactggtt

SEQ ID NO: 61042 - DNA, 5974 bp, Oryza sativa
aatttacaaattttgagaaaatgaaatttaacaaatccttaaattattatgtattcctatatatcaatctactctattttttggaatataattgaaggggccaatctctctttttcgattactgtgctaatttcatattttcacgataaattgggtgctttgtttaccatgtctgaagtataataataaatattttatataatattatgtctctatctctaaaagtataatagtatttcctatacatatagctatcaatctacacagttataacttagtccatctttctttcttttttctctcctgctaaagtagtaatttgagaacttagagtgaatgggatgtgtacttctaataagcttctctacaatgtaatagatgattaggtaaaaaaaatgtgatgatatcttcttaaggaggtacaacttgttttgatgttcagttggtttcaacaataatgtgacttagatcgttaaggataaacattgcatggttcacgatcgagcactgttttcatgcagtgatgggaattggagagtatagtattaaacattattctgcgtatcaagtccagaaataatgatgcaagatatcacttgggagaattaaggccctgttcagttcccaaaacaaaaattttcacgttgtcacatcgaatgtttgaacacatgcatggagtattaaatgtagaaaaaaaactaattacacagattgtgtgtaaattgcgagacgaatcttttaagcctaattgcgaaatgatttgacaatgtggtgctacagtaaacatttgctaatgataaattaattaggctaaataaattcatctcacagtttcctggtggaatctgtaatttgttttgttattagactacgtttaatactttaaatgtgtgtccgtaaatccgatgtgataaccaaacaaaaaaaatttcccaactaaacaaggcctaacaagcgctctaagcttattcaaacaataagagtcaaagactacttttattgattgcatggtagatgcgtagacggaccactatatactacatgtgtgcccacgcatggcaaagagtactactagaaaaatgattttttatggctaaacgctccgcctgctatttagggcatactgttgatatttgatatggtcacggataaatccgtaagcgcatatatacgtttgtagcatttcacccagagtgtttcatgagtatagtatttgtttttccctgcagggaagacgacagtgtaaaaaataagttgatatattcgtaatcacgctatatttaatatataatagtctatcagggttaaataataataataataataataataataataataataataataataataataataataataataataataataataataataataataataataataataattgggtagtgtgatacacagaagaatcatctcaataaatctactatctagtgaagagagacaaaggagatagctatggttctatgtatctaggcactaccaagagaccactccatattggtcggccagcgtggttataccactttatgaactcttatgtcatacccaaatgtgtggaatacaaaggacaaattaacatggttgtcaccaccacctctcgcctaccttactttctgtggtgcatggcatttaatcaatctacgcaccatgcttacattgctaaataatgtcactaattcctctgggactctcactttttgaatggacaaaagttagaactagtgcaatccactaagatcattggaccgacgccatagcatatatcaactagcctaaacgtgcatagtttatgaaagaggtataaactactgaccatatatatgataaagcagtatatgaaatacgaacacaattaaataaaaaagataattctattattgagttcatagtcttacaataggaataggagtataatactaaagacatacccaaatcttcgagaagtctaggaaaccgaagaactattctaagcctaaactccactaaactagagagtaatacaaatgtagaatagacaggttgcttcttaagtgtgtgttgtgaactgaagaggtgatctcctttttatagcctacttatgacagttgattaggtcgataactcccacaactgtcattaggaggtaattagtgatgtccacatggaaggtggagatgagaggcagcgatggcggttcaaccaaaccagggttcagtcacccctgggctccacctctctccaccgcctttctctagaggttgccatgtgggcccctaaggtggtgcattgcagatgtctgacttgtgtgccctttaatccgtgtgctctcacatgattcgctggaggtgtgttcctttgcatgccgatttatttctctttcacttttattgtataatccctacatccatagtatttctccaaaacaagtggaactaaattatttgtaattaaaatacgtataagaaaagttagttctccttttatttgttaaggtaattggaaatcggcacttaatgtctttcaacacctgcaaagcggacaaggagaaccttcacccgtctgtgaaaattgaattttgcaagctaccaccctaaaagccccgtatgtgaaaaatatgatttttcacaggcggaacagttaagtggcccaaatgcaaaagcaatttctggcataaaagaatgtagatccaaatatcctctaattaacataattcactatgcaattccaccatcacaaattcaaaataggtttgtctaaatcacaaaatttcagcaaaggacatcgtcattggcatcccagcgttggagttgtaccctctgcagtgtctttggtcagcgtcttggggaagaagttaaagcaacgcaacgcctcagcaaggatggccttgacgacgaggacggctgagagcttcccacagcgatgaggatggtcgcgacaacaagggagagcttctcgaggcccggcagcggatgatccatgctcatgaggcccaacggcgacggatccaccgctcccgaggcccgcggcgccggcagacccgcacgcttgatgcctgatctgcactctcgaggccggtgacggtagatccagcatgcttgaggcccagcggtggtgaatgcaccacgccgttgccatcatggtatcggttgtggttgttattgccgttgccatcacggtggagatcctttagtctcctaggggcccgctagttgcgggcgtggtcgacaatggtggcgatgggtgggagtggaggaggaagtctgggtgcgatgatgagagagaacggaggaggaattagaccgaggagagggaggtgttagggcaggagatgaggatgtaggagagcctgctcacttgggagatggagtagagagagccgagggaagagagatggaggacttagccatggttggctcttgttctgaatttaatagcacgcttatatttgcagttgggcctctttagtcctgactgcgaaaatcaatttttacacgtgaggtctaaagtgctctgcctgcaaaaataaaaacaatgttttgggaaaaaatcgttttttatagttagtgtggctcttttaacacacgtttaaagaaatggaggtcagggcaaatcccaagccttactaaatatctattaacattacactgaaatatgccatgtgtgtaatcgtaggtaccaacatgatttgaatcctaagccaatgggtagactcatatatatatacacttacaactctaccctcacatctctgatgcttccagagaaaaaggctatttagccacacgttccgttgcattcacacattttatccacacaatctcctctgaaaatggacactcgtatacctgtatcctgaaaggatccccgcccccaaaagctgagggctcacagataaggtcaccaaccaaagcaatcctcacatcaaaatcaaagtacatatatacacgcgactcacgaaagctccacccatgaatctgtcaatgatcaagttcaattaagtgggctaaataatcaggtgtcttggtttagatatatattgttttgctgcgggttgtatgaatgactagtatatgttaattaatataagaacgacgagggttaaaatattatgaaaatgatgtgaggaagatcatttgacatacttatatgttgaattttatgttataatattgtagataatgtgccttttgtttgtatgagatttaatatgctttaaaatagtaattactaatagacgatgatgtaacatattaatgggtaccaactatataagtatattaatggggttagctttagggtgtttttgataggaggggaaaagagaaatggagaagatgcgtaaatcgagatgaactattagcatctgactaattaagtattgattattttgattttaaaaatagatcaatatgattttctataagcaattttcctactacgtacatgattttttttcaaaaaaaaacataccatttaccaccaggagaaacgtgcgtgcagaaaacaagcgaatttttcttccaatccgctactgcaatgcagccttagttaagccgaatggaggtggaacgttataccgggccacgaatttggccgtgggcatgtgacaacaaccctagcttagaatctgttctgttccctatagctcgtcgtcgactggtcgtgtctgtcctgtactatttggttaccagcagcactagtgctgtagtgcgcgtacggcctgtggagtgtgggatcgtgcacatctcgtggaatatgttctctctatatatactgagtgaggtcccctagaagcatctaacaagcaagaatggaaaggctagaattaagacttatttcaatccctctctggctgtgtttagtttctaaaattggggaaaagtttggaaaaaattggtagtttggaaaaaaaagttagaaatttatgtgtgtaggaaagttttaaatgtgatgtgatgtgatgtaaagttgagagttggagggaagtttgatgtgaactaaaccatgcctctgtttattgttcatccgtttcaacgattgatcttcgtggagaagcacacctgcataagaagacagtggcgtagtcgttgatgtatatatgactctgatatctactaaagttttgttaattttagctattggctactagattatcatgtgcacggttttttaaatattaataaacgatatgattattttctacatggaagtctcttacaaatttaagtaaatctaattttaaatgtataacaagcgacactaaattaattatgtaggatatttgtcttctccgatgagtccagcggccacttgctccaaccgctgaaatggaactgtgccggaaaatctgtcactagcttttatctctttgagcgtacatatttatcaatcggtaaaaaaaaaaaaagaaaacaagagattgatctttacgtttttgtttccgcgttcatcaagagaaggtcagcatccaggcatttccatttttctctcctctgaaaacttcgtctccgtgttcacccaagcaataattccagagagtccagactccagagaactgtggtagacagtgatcatccctcccggagaacctgcatgctgtcgatcgatcgagcaagcgatcgacgacggcaagttgcgcgcgattcgcacaacgacaggtaattctcagagctagcaagcgagcacacaccgcgcgtcgcgatcccagcttagcttgttcaattcagaacgccccgcgcgcgcacccggccggcggctaggctagccgcgatcgatcgatcgatcgcggccaaagtccatatattattcttccgggcagaagctccagcgacggcgacggcaccggcgtaccagtgcgcgccccgcgtcgcgcgtcgccgtcgttcttttgtctagcgatatcgagcacgcgaaaggacccgcgcgcgcgtcgccgtcgccatcgcgcgcggggggggggggggggggg

SEQ ID NO: 61043 - DNA, 725 bp, Oryza sativa
ggctcgggttttctggtggaagtcctgtgtctaagcgcgtgatggtaaatgggaaagaatgcttgatgtttgtgagagaaggtaaagcaccacaagaaagtgaggtgactagtcttgtgaactgccagggacccggaacatccggacagaccgggagaaacctccgggtgggaatctctgtctctcaaaaattcccactaggaagttccggccgttttgccaggaagttccgggccaatggccatgcacaagacatgaccggaagttccgggcacaaagccaggaggttccggccagagggtctttactatgattcatatgtaatttccaaaaattcagagggcaaagtggttgcctattttaatggaaattacaatgatgagtaccgcacttgtgtgtgggtgccaaaggctttggtaactaacatcaagggacccaaacttagacaagtttgggttcctaaatcccaagcttgattttcttgtgtaggcatactcctccggtggttcaagttgggttgtggacagtggttgcactaatcatatgactggagagagaagtatgtttacaagtcttgatgaggagagcggaactcgtgagaatattgtgtttggagatgatggtaaaggaaaggtaattggtctaggtaaaattgccatctccaatgatcaatctctctctaatgtttttcttgtcaattcattaagctacaatttattacctgt

SEQ ID NO: 61044 - DNA, 716 bp, Oryza sativa
acaccataactaaggccagtgatcctatgcagtcgtctaggctcgtcgatttgtgactgataataatagacattttatgtcaatataatcagctaatattacttagatgatacccctgtaatttactacggaataaattttttaatgcattgctttgcccatatgttttaaattacatatttatcaaaatacttaacatatgtttacaattaaatagataatctgtcgtaataatttactcgacaatctgtttcaaacaaaatcttggaatattgtaaaagatgataatatatatgtttcaaacagaatcttacaatcttttctagacagacggtggccggcctaggctacaacacacggggggcggcggaccggcggtacagcttaggcaattagttagccatagtagccagtttaagcgattgaagaatgaagaccccgggcgttgacgtcacgcttatgactgcggcggcgaaagcgtcaaaagcgcggggcccgattgggtcgcacgcgtgcccggaaaaagccagcccgccacttaccctccattccgccttgccaagccacacaccacaaacgccacccggttttaattttttttcgcgcacacacgcacgcacgcatgcacctgcaactttgaacaacgcacgggactcactggtgctggtactactcgcttagccgatcgacggatcgatcgatcggaacgccgagtc

SEQ ID NO: 61045 - DNA, 4126 bp, Oryza sativa
ctgcacccccggtcgaatggcgaacagcggccgccgctcgccgcgccctccgtcttgacgacgcggagccggtggtagcagtaccagaggccttggtggcggaggaccgcccaccagcatctaggcgctgccgcgccgtcatgaccaaaatggccacgtcgtccagccaacgttgggctggagactccgggtcagggacgacgggcgggtgacgcaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctcacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcacaggcccccctttgccggttcgaccggggaccctgggtgagattctaagctcctagtctgtggaaggttcgcgagaatggaagaagcacaagacacgggcgatgtatacaggttcgggccgctgagaagcgtaataccctactcctgtgttctggtggatctgtgtatgaagaagctacaaagagctggagagtcagagagcttttactctagaaaccctctcctctggttctcaatccagcctccatcgttctggatcccttctctaagtgggcaaggtcctccttttatacctcaaggggataccacatgcaccatctctctcttttgtgtggggacttatcctatcttccccccaacttgacttgccttctcttcataaatggacggagatttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcacgttcgcccttcttcatgcgatatcttgcttgtaatggttaggatgaagcctggcatatatctgaccgggaccaacgtgccatctccaggaggtaacacgccggctccggctagggacgagtgcttagagactctcatcctgacgggatggggcgaggcgtgtgtcagaccgcctgtcgccacctaacccacgatctgatcggtctgtgactggtcacagaccggataaacgagcgcgctgcactgcgttacatgcggcgtgacgcgctcgtccaaaccgcaataaatgcggttaggtgagccctgctgcgctcacctaacccatacacgcggcgcaaaatctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccagtcccatgtcaccgacagatagatagcccaatatgcaattcactctttaaattgtaaaacttaattttaagattatactaaaatttatgtagcttttttttaatattggcttttaagttgctaataacacatatataaaagttttacaaataaattattttctgatcactaataggatacttatggcttataataagcttttgagcaaccgatgaaactcacctttttctttttaatggtgcagccattgcacacatttcatataaagaactctcatttttagagaaaaaaaatgggactaaaacttacaatgcgtaattaattagagaaaactagacgaaaatcatatctaccacagaggcacagacacatcattaagtagtcatcaactaacttaaagttatgttttatagtttggaaaacatacacgtggaaaccgagaaatatgaatcgggaaaatatggtaaagaacacagccttagtcacagtttcgggctgtgcagacagaaaaagggacgcaacgcagtgatgctgctgtaatcttttgttttccttttgttttgaactaggaaagctaggcttcccccatttcttttattaaaaaaaaattaagtaattattaattcttttccttcatttgattcattgtgaaatatacttatatgtatacatatagttttacatatttcacaaaagtttttaaataaaacgaacggtcaaatatatgctaaaaagtaaacgatgtcaaatatttagaaacggatgaagtatcagatatgacaatgtgtgcttacagaaatgtcccccatttccaatacgaaacgaaaccttgtgcggcgccgcgctccgatccgtgcggccattgaaggcgagcgaagcaagcagccaaaacccacgccggggacctcgcccctcaactgactaccatggtgtcccgacctccagctaagccccagcaccagaatgcgatgcgaattagagcaaggtcaatagtatagccaactaccggctacaaaaatatctatagccaatctaatagtccatttatacaatagttaactgtaaaaatatactacactattaatatccggtcacatctcttatacacacataacatattggagtccgtgttgcagccggctacaaatctgtagcgtgctttcttctctctcttctcttttcttctcgatgtatggttatagccggcttatagcctgctattgtacctgcccttacacaaaatccaatcctatcctgcatgctctgctgcttgctacggcgtcgccgtcgcgggctctgctccaacaaccaatcgctagctgcatccgcatccgcatcggcatccacatagcatatgcataatgcatttgcaattttgcatgcgatgacctgtaactccagatgcgatgaacagatcagggccttggtccctgcactgcacctctgcttcgcgtattgatttcagatatatgtagatggacagtcagagaaccaacacatgtgcgcttctttggccgcatgccgaccgctaaccccaccgcaatccaatggaatagtctccatggatgcatgcattgttttcgagtatgtttaattattatatcgtcggtcattccgcgttgattcgatcagtctttgacagtctaacgaatgtcagactgatctgcaaacaaaggacaaatttttagggtaaattaatttactcactgaattcagggacatggagaaagagacaacagctaatccagtataagaaagatggggcacagatcacgcacactacagttcacacggttattattctgatcggcccaaccgatccatgattgtcatggagacatggacccggcagtgtacagacgagcagttctcataattccattccttctccggatcgatattaataagaagaaaaaaaaagattctgacagccaaaagggcgatgctgttcaggatctatgccatgttcttagcagtttgtccaaaagcttcacgtggctctcttcttaattcttattcagctcgccacactgttgactgaaaaattggagcaggcactgcagggtggttgtctgaatttgatctttgtatctgtttaggtagtagccatggatgacaaattgttcgttgtgatatggtttgagattttgtgaaatttttggtgaattttcagtgatcggttaggagggaggaggaatggggaaggcggggagatggctgaggagcttcttggccggcggcaagaagggtggcaagaagggcgaggcaatggcggcggctttgcccggagaggcggcgaaggagaagcggtggagcttcaggcgaccggtgcacggcgagaaggcggcggcggaggcggcggcggcggcggacggcgtggtggtgggcgaggccgaggcggggtttgatctgtccgcgtcggagtcggagttcgaccagaagagac

SEQ ID NO: 61046 - DNA, 2694 bp, Oryza sativa
ggaaaaatgtcacgcctagaaatttagcccaaatttctagactattttgtgtatttaatccctgtccaggaccagccagggtacacaaaatgacaagtaatatacagttccaaacgtaaataaagcgtaaaatacttacagcagaggcacttagtcctcacaccgaaagagaacgacagcagcggaaaaagcgatcctagcggggcttcagctcctctccacaggcaaagctcaattggggtctgagccttggtcttctaacttcgtcttcagctcagaagcactacacttctgaaaagggggaaataatagcaaggctgagtacaaccaccgtactcagcaagccacaccattgatgcagacgtacaaggggaacacaaggatggtttgtggctatttgtataaaggcggttgtaaaacattttattgagaaaaacagtaaaactgttgagtaattaaagtaacattaaatctccactgatcaacgctacaccacgttgaacaggccccaaccaacccacctgaactacagtgcattgagtcaatttattaaaagtgggactaatcaccggtgaatcttggtcgatcgccccataaccgccggccacgggcttattcgaataagttttaacttttgggcccacagagagaaaacacgccgcccccgtccaactgtacccacaagacacgaattcacacatgtcgccatgccccaaaggtttcaccatgatactggaaagggggaaatcgtgacaagaccctgcgcataaccctcccctaaccatccacaccacgctaaggtttcacccccacccctcaaaaggcagtgggcggtctctcttgcgccgcagtgaatccggcagctggacaaccggacaccccggccgacccaactccatcacgcccaccctcgccaccggtggctaggaaagggtcaagctatacttcagatcaagcaattacccactcccgcttgtggtaagcacggtaagtctcccagggtttcccgtgaaccggtccttaactgcaatgggtgcgaccagcaaaaccatgcacccacagcccaccattcagtcgcattttagttggataaatacgaccatgaaacatggctagatgtctcgaacacgcagctcattctgatcctaaaaaggtctaatactgcagttatcccatcaaatgagctagtggtaattaagcatggctaagcatataattctagctaggtcacataagtaacatgagctagtcaatttatttgatgaaccctgagttcctctcgacactcaagattgttgttggcccgatctttcggtgagttcagataactacgatttgggagaaacgttgacgacccgactacaaccgtacaagatgttgtgttgcgcctttgcgatcgatacacctctccatgggttgttgatcttgccggtgcagatcaaccctattcctgcaagcaaatcgaagaaacaagcaagaacaagataaaagcaatctgatattgcaaataggaatttaatacaaatgataaattggggttccgaagaacaagcagacggacggtctagccgacacgcgcgctgcaagcaagtagcaatggctaaactttaatctaacaaaacccgagaaaccttgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgacgcaacacattgttcctgtgattctggccacacgagatggaatttagagaagaggctggatccgttagaaagagggctccgagagctttctatcaagtactcacaggccgaaaacggaggtcgtatgcagattcggtggccgtttgaagtcagcagtgtagtaggtggccgaatcggattccagcacttggagtacttgatctcgatatcttcttgttcatccatgatgtcagcaatgattgcatccgtggtagccatggtcacatcattattacccagggttgacaaaggacagatatcaagtaaacatggcacaagcgagcagataggtaatacccacatcccatgtaattagcaaaacatgcatatttatttgcaaacggtaaaacatttgtaaagtaggatcaaaacgctcaaggggaatgtgtgacctgcgttgcttcttcacttggatcttctgaacacttttcctcgcgaccgcgaacttccgaaacgacggaaactacatgttggcacgcaaaacgaggaaaaactctaataaacaccaaggaaacagtacataaaaagtaaacaaacatgtaaatctcaattttagatgaattttgcaagttgaatggtttgggcgattttatgtggtttgggcgccagggcgcaggcgggagaggctggaatcgtgggcgacgtggggcggcatatgcgcggcatggcggcttcggctctggaggccgaaggtagaaggaagagctgacaagtggggtcttcgggcccacctgtcggcgaaagggggaggggagtcagggggttatttagactttacgcgaggggaaggtgaaatgggccgacggcttaagagaagagaggggaggccgactgaggaagggggaggagaggggcgcgggccgcgggagggg

SEQ ID NO: 61047 - DNA, 9775 bp, Oryza sativa
gggggggttggggtgctggttatggctgcccgctcggcgccggcgttggtggattcctcgtgtgcttctttcggattgatcgatcttgttggctgcccgctcgggaaatggcttggtgcgtttgcgtcaggagtggtcgccggctcggccgggtgggtcgatcgagttgtaggggccgccggccgcagcatcacatgctcgcctgctgctttgctttcatctgctgcgcagaggtaaaggggttattagtgaacggacaagatctacaagttttcagtcatgccggcacggactttccatcgggcctggtccagtaaaaaaccaaaaaaccgcgggcctaaccgcctaagtcatgtatgcaatcgttgtgtgggctagaaccaaactcctgcgctttcgaagcccaataccaaccgaatagcagcgacgacgtaacgcggcccgtacgcatgcggtccgctctcacagtcacagcgtacgcgagcggagcacctcgcggcgcggcccaaaccaaccaagtgcacgttctgcctgcgtcgcgtctcctacacgttgccccagctgtagattggcggcccacacgcaaccggcggccgattcggtgtcacccgccagttcgccaccgaggaggcgtcacgagttgcaatgaacgatgcaatggatgttgacgttgcaggctcagaagatgcaacgagttttgaagttttccggtcgcgttgcagctgctccggctttgctgacgcttttcttttgctactcgcctgatgatagaaccttataggttgacaacaacgagagcgaaacaaggtgcattgttgtcggttgtccgcttccggttgtctacgacgaacaggcgctgaaccgtggtggattcatcaacacgactacagtaccatctcacttcccttacgcactgcacagtggactctgccggcgctctctcgcaaagctggactttgcaacagtcgcaaactcgagtacaaatctggacttcagctggtgcaccgctgccgctagatctgtgaatgcaagtctgcaaccacaacactttaaggccctagctatcggtctgaaacagagagacgctcattcaactataccctgttactattactatatgtctcaactctcaaacttgcgtaaacttatcaaggatgtgcccacaggtgaacaggccacagtctacagattcttgtctttgtccggttaacaggccccgtatcacaaacgggtcccggtggggacaccgccgcagccgtcgatgggagcggatgaacggctaaaatgcatcgtgatccggatctcggccgggaccgctgctgctgctgcgagagttgtagtaaaatccagcggtcaggagctcaagaagcgaaatacccgggcagcattcaattccgctgtacgcccgcttggcagcgccgctgctgcaccaccccgcatccatccgctgcggccacgagactcggtggcattgcttgctggctcgcgcgcagatctggtccggtacgacgcgtgcacggtggtgggggcgacgcgtctgcacggtcgcgcgggctcccccaccacgacgcgcgcccgcgcccctgcccgatcgagcgccgggacggggacggagacgcgattggctcgtacgcgcgcggggggcatgcgtgtgcccggcgccccggcgcgcacggacgcggagacgcaacattttgtcccggggttcgggacgtgacgtgctccaccgatcggggttcttgtcgctgaatatcggtgaagtgtcggctcggttggagacgagtagccccggtgtcgagttactgttcctctctttggatttactctactggctatatataccgtgttggctgtttacccgccggtaattggaggtttgctacgatgcgtacaactactcaagcgagtaaaaacaaattcttttaccagtggctgcatccatggttgcactgcatcaaacgttcgtgcataaagctgagctcaaatcattacgtactccctccattcaaaattgatctacatatttcataggtacactaagaccaaaaaaactaataactctctcatactatatttattctagcaacaaactctatgcaccatccctactattttcctagacaatagcaaatcaatatattgcatgtgttataaatacttataaatacttgtgtgcatagatgcatgtatcaatgttcatttactccaatgcacaaataacgaatagacttaatgaatgaacacaaatatatagatcatttagtaataacctcaaaaaaaactatatgtagatcaatttggaatggagggagtagtatgtaccgctgtgaaactgtgaccactcctcatcccgagaggcgagagtcacggtcatcgtagggtacaaaaccacaaatcacgatgaaaaatgcgtgtgcatgtccgatgaaaaggaaagaaggaaaaaagaacgaaaatgatatacatatgaccctgttgtccggctactgtgtatgactctggtcacatggaaagacacagacggtaaaagtctcactccgtaatagaatctgacatacgtagtgatgccataacggagtcggacgctagtcgaacgctggattcgtatgtatagcagcgttcaacaaagaaatgcgtgtgcacgttcgattttaatcagcgaattattggtgtggaatttccgtgcctgaaacatgggcacgcatctgttaaataattaatcgactctcgggctcaccgctcacgcgaatgcaatcaagcgccaggtgattaacaccgtacaggggcagttagcacagcggagtacgtcacgattttaattcagggcttaaatgaggttctgactgccagcgtggaatagtactccgtgcttgtgagttttgacgtggagatggaagcttcacaagctagccttcgattgcttgtgcctggaagagaaaaaacaatttcagggccctttgaatcgtaggaatgaaaaaacagaggaataggaaaaacacaggattctgataggaatacaattgtaaaacagaggattgcaaaacacaggaaaaacacaggaatggcagtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttcataggattgaaatcctccaaaattcctacatttttcctacaaatcaaagtggcctcattttttggccttcaacctcacaagagccacagttacgtgacatttcctgcccactctctgccttgatttgatgttttattcgttcttggccttttcttaatagtactagaaacggttcctttaatggagtagtatagggtgtgttcagttgacgctaaaattagaagttttgttgaaattgaaacgatgtgacgaaaaaattaaaaatttatatgtttagaaaagttttgatgtgataaaaaaaattaaaagtttgaagaaatagtttgtaactaaactcggccacagccgatcgatcaaacaaggatctcgtgtagtagtgttgaatctaattatacattctatacacgccaagtaggaatattgtatagtgtagatccacggctcaataatgtctccatacacatatataaaaatcgattagtagtactaggtgcaacgaatttccacggcgcaacatttacacctgatgttcatttgtaacattttcccggtccacagagcagtaaaaactcaggctatgcacttcatggcttctttatttccttgctccatttgggttgccctcgcagcaaaaccggcaagtagcaacagtaacctagacgagagcagcatgtctccctgtaataaattctgcaagcaaactaagcacaatatgggctctctcgcagtagatgagctctgtggcttgcatgcagtagtatatttgccaattgcaatgcaagcctgcccatggcatgcgatcatcttgtgcagatgacacaaacaatatcaggtcgcccttgaagcaattgcgtgtactaaaaaatggcaaggctgttccgtcgaggagcgaggaatacgtaagaatctactcctacgtacccagctgccatgctgctgcagccatgcagagcaacagaggggctagttgtctcgtccatccatattcactgagcggccatgaagtactattcacttctcacgataaattacacagaccgtagagatatgcgtgttcatccagctagccttgcgtgcgtgagaattgtcagagacatatagtagtactattaagttatttaagtgtgtttttaggtgttaataacttgcagactggtcccaggaaatctatatggttttagggtgtgtcttagcagtattgaaaacagtgcgcttcttcttcttctcttcttggctgaccctaagctagcttcaaaaacaaaacagtggaaaggggcagtagggctagcatagcacatgcatgtataaaaacaggagtttaatttgtatcattttccaaaggaaaaaaatgcatttggaatgcttacggtgcatgatacgtatatgtggatgtcctgccaagaatcccgcacattacgattgatgccgtattgaccaatccatctcttggtttttggagctaacaataatgccaacgaaaaccggcagattctttttgcgcgcccgggcatgcacgaaacatatccgtaagcatgtgaaagggtatagtataggccaccggatcaacaacagtagatagtacacatacgtatatacgtcgattcgattattactgtggcattaatttaccacttcagcctcagtgtactgcaacagtgagtaaaaataatctcttcacactgagatgatcaaaggcccaagattaattaataaacacgagcatatgcactttgaggatttgaaaagtctggattttcagtttgttttccttctagttcattatttggatataattatgggctctttgaatctaagtaagaatatactagctagtagattatttaggttgtgttcttttattgaagttaccaactcaacaactctcgcctttcttgtacacgctttttaaactactaaacggtgtgtgtttttataaaaaaaaaatacgtaaattgcttttaaaaaatcatattaatctattcttaaaaataactaatacttaattaattatgcactaatgagtcggtccgttttaacgtgcatgaaagattagttcccaacgccttaaaacgaatacagccttaaagagctaaaattctaggagaatttgaggctgccagagcctagaatccctctggacacggcctatgtacttcaggaacatatcctatcctatatgtacacaagcattctcgtgcacactaactaataaattcccaaaaattctttaaaaaacacatatgtatttttatagtattacatctacgtgtaaagtttcatctttaaattcatcatacataaaatagacttatagtcttaaaattgtcagtttttcttaggactaaaatataataaatttaatgttaacatattttacacgtaagtataatattattgaaagtatatgcacatatttttctaaatttttcgataatatttattagttgatgtacgcgtgaagcttatgtatacatgatatattatcgtgtcactctgcacagatatgcagcagtactcttttgtctgcattaagtttttttctgcacgtatatactactccctccgtttcaaaatgtttgacgccattgacattttagtacatgtttgaccgttcgtcttatttaaaaaaattaagtaattattaattcttttcctatcatttgattcattgttaaatatatttttatgtaggcatataattttacatatttcataaaagtttttgaataagacgaatggtcaaatatgtgctaaaaagtcaacggtgtcaaacatttcgaaacggagggagtataccactaggagattactgtgccgagctagaaccttaaagatgagctagagtaagtaatcagtggaggagtattcactaatcagctagcacgggtgcaacacgctctcgtgaccacccccccatcccctctccttggctcccactctttaagcggcccttgtcctttcagctcctcggtccctccccctccatctcactcccttatatcgctcgctcactcgctagctcgcaccgcgccggccgggagcacgcacgcacgcattgccatcgccgtgcgcggaggaggagaggagatcgaggtctcgaggtcgttggttggttggttgcatggcgagcggtggcggggagcacttcttgcggcagctgagcgcgagcaacgggggatacggtggtgcggcgcagtatcagatggggcgaggggtggtggcggaggaggaggtggagctcggcggaggaggcaggaggaggggctcgaagcggtggtcgaagaagagggcggggaggggcgggtacggcggcggcggcggggggaagggggacgcggccgcggccgcggcggcggcggcggcggtggccgggaggaagcgggtgatggtggtggtggacgacacctccggggccaagcacgccatgatgtgggcgctcacccacgtcgccaacaagggggacttcctcacgctgctccacgtcctcccgtacgccggcgccggcagaggcgaggagaccccctccctcgccaactccctcggcacgctctgcaaggcctgcaggccagaggtagcgtatacgcgtatacgtacatcatacgtgcatgatgtttctttttttttctttattttttttagagggatgcatgtcattttgtgtgctgtttttacttttgtgctctaatatgtgttttcaaattacaaaattttaggcgcttcgattagagaatcatgtgtctgatctctgctgtctagctttggtcattctggatttggaagcatctgcttggaggcaatgcacgagggaattattactgctagctcacaaagaattagaaaaaaaagcttttgttagtgtactggctcatgagaacttgactaaactgaaggataaaaataaagtataatttactgtacggtttgtagagttatcaatcctgaaggtcacctgagagggatagttgtaaagtattatttgttgggggacaatcatacagtagatcagatcagatatcagaacatacatgaaaaggggatcgtattccacttttcatggatgaacggatcttgcatcttggcaggccaaaaaggttcgagtctttgataaaagttaaaaagtactacctccgttccataataagtgcataagtgcagctccgttccataataagtgcagccataagtttccgcgctcaactttaatcgtccgttttatttgaattttttttataattagcatttttgttgttatgagatgataaaacatgaatagtactttacttgtgacttatgtttttaaattttttcaaaaattttttaataagacgaacggtcaaagttgggcgcggaaaaccatggctacacttattttgggacggaggaagtaattagaaaagaacaatttgtggggctcatgctcatcccaggttctaaaaccattagtaaaatgcatcagtaaaatcctacctaaaccggccgtaaacaatggcattatgagatcatatcatcattccttccttgatttgcttgcattgcttgaatcaaaagtcagcacttcaatgtagtagtgtactactagtagtacatccctgcgtaagagcaacagtaccgtgcatgaagccatgaactattcctttgtcctactatagcatgtgcaaaggagggctcatacgaaatgggtgtgaatgtggtaggtggaggttgaagcacttgtgatccaaggaccaaagctggccactgtcctcagccaagtgaagaaattggaggcgtctgtgcttgtgctcagccaatccaagccatcccatttctgttggttgagttggtaagcatttctcacctcctaccactgtagctctatctttctcatccctattggatgtgttaaaaatgtgaggctcaggtcaactatgaatggaaactggcggggagaatatagtatcatggtgtcagtcagtccctagtgttattttaaaacaatgcccagattaatgcatatggctaggttccaatagaaacctttagttgtacatcattttttatatcgtacaagtatcagtttatcaggatacataattaccactagatctaaatttatggggagagatctggtcatcttttatgataagcaggcccactaacaagcaatgagtaaactgtttgggaaataatcctccttcaccaccgttcaatagcagggtcccctgcctttcgggaaaataacaccaggcagcagcctccatgtgctatccataaatcacagatgctttccttgtccttttttggtcacaactcaaccaaatgaaagcaagactcctacacttcactcacctaatttttgctacgttcacgtggacaatgtaacaatcaccatcaccaacacattgaagttgagtcaggaaaagttactttcatcttgtcgtaaactatagctatggtccttgttgagcaaatgcaaatgtctgcctgcgattttacagcatcctgcggagcagcagcgaggagttcgtcgagcaatgcatcaaccaggctgagtgcctgacgttggcagtgaggaagcagagcagggcgtcggcgggtacctcatcagcacacggtggcagaagaacttctggtcctggcttgacaaagccaaggactattcaattttctgccaaggctttcaagtctctacataatcatatttttacccccgtatatctgccattctgttttaactgagtgcgccataaaagcctccccgctgccatgttgcgtcaccgtgcaagtgttaccatccgttgtaaagcccaaaggagccctagatctgaccaaaccctacttcccatcttcttttcaagttcagtttgtgtaatcttgtgctgtactattgtgtaatgttgcataaatggccgttttctgttgtcacgtgttttacacttttactttcataacaactcctcaacttaacactactgctacaaaccaagaaatcaagagcaacatcaggttattttccataactgaaggtcgcatttccaatgcaacagctagaaacatgaagatctaacagctagtaacatttttagttcaaatcttgaactggagtgtggctactgaggggggacctcgcttagctctctctcacttaggagcaggagaggacgagaggtgcagttgcattggttggtttcaggcttgggcgtggtcctctttaccgctattctctgaatcctagcacacacctgcccgtggggcaccgccttcaatggtcgtgggcctagggggcaaacaaccaggcaaggatcaagatccccagtttgccaccaatagcctgatggcaaaaccaacctcctcaaaatattgcagctaatgcttatggtagctcatactagtcatactacatctcacacttctcacttaaggactggtaactcacaatttatgcacagattgttatacaatagatagtagatcattttttttaagaaaatggaaatggtttacatctccagattctaccataaggcgcacggccaat

SEQ ID NO: 61048 - DNA, 6924 bp, Oryza sativa
ggcgcggcgcggcggcgagtacggccaccacgggcggtggtcgccggcgccgtcggcgatgacggaggtgatgagcccgagggcgtacagcggccacttcgaggacatggcgttcgccgcgacggcgcacagcagcccgcatcacgcgtcggcgtcgtcggagctgctgtgctgcccgagctacatggccaacacggagtcgtcccgcgccaaggcgcggtcccagagcgcgccgaggcagcgcaccgacgcgctggagcggcagccgagccgccggaagagcggcggcggcggcggcggcgccaagatgcagcggtcgtcgtcgtcgcacgccgcggcggcccagcgcggcgcgcagttcccatggccggtgatcaagctggacacgtcgagcgcgtcgctcaaggacagcgagtgcgggtcgacgagctccgttctcaccgccgccaccgtctacagccggacgcggtcgctagtcggattcgaggtgagttacgacttccgagacatcgtccatgtttttttctaacgaagatgaaaataaagttaatgtatgtaaaataaaaagttattaggatatgatttattgagctttaactattacaaacttaaaaaatagatttatttaatatatttaagcaacttatatatataatttttttaaaaaaaacgtagagtatgaaaatagaggtaaattctactactctgtctaaaaaaataaactctagctatgaatatagacatgtatgtgtttagattcgtagctaggattgattttttttttctttggaccgagggggtatatcttagtgtgaaaaacataaggaaaaaattattcactcgcacttgttctttgcatgatccaggtgcgcaggggtttgtactgagctacaagaataaaaaatgccattgccggacgaaccgggagcttcgccaatcgccatggattgaatgttcgtcagtttgctcgacgtgtgatggattcaggatcatgaactgtacattctgtgtaggttattctgtgttgtggtgactgtaacataccaggaatacatactgctaagtgaaagcgaaatgtaataagcaatccactgcaatttcttccaaattccagtgtttgttccaatttcttccaagttttttgtgggcctactcgaggttactgggctgtacttgcacacatcccacgagaaaataggccgaaaagaaagcccatatacctgttcatgggctaactgggccggcagctcatctaccaatcagaagaagggccatcgttcttaacttctcgtagagcacaccacacgctttttcgccgaataagcgaaacgacatatttgcaaaggaatagtaatttgtgaataaaatttttatatatgtgttcttagtgatctaaaagtaaatgctgaaaaataaactttcataaaaatatctcaaaatgagctttaaattgaagattaaaaatttaaattttggctaataaatataagtataaacgaaaagatgagacctcatctcactctcatcagccatcatacaggtttcatggcctggttgcttcctacagatggcgaaacaaccgaagccgttgtgttgctttcgatggcggaatcatggctcagagacgcgcttagcatggccaaatttgacatcaactgatgaggaattgaggataagcgtcgtgaatggctgaaatcgacaggtattcgggttgtttcttcagcatcacaacatgtcaggcagggacacgacgcacttgtccagaaattttttattttcttcctgggtcggcgaagaagatcgaccaaatttcgttaagattaggcttgtacagacatcttattgctcgtgatctggtttgctgacgaagcaaaaggaataagcccttttttgatggacacgagggtaagagaagaaaatggtcggtttgtgagatcgaactgtcaaagaagtcacattcaggttgaaggataactgatcaattttttgaaagaacatacatcatcctcgatcctaaaatatatgactttgttgtcttttcgcataatatttaattattcatcttattaaaaaatatataatttaattttattaaaaaaatatcatttattttgttgtgtttttatcatcaaataaattataatcttaatttatatttttatatatttatactattttttaaaaaaaatataaatagtcaaacattatacgaagagtgtacgacatctgaagtatataaaaagtttgaaaaaaagagatggcgtgttctaccagtttgatgagtccatacatctgtgagagatgcaatgaatgaaagacgagggtaataatttctggtcacaatcgtctcatctccccaactaatcaagtaaccattcgctttaaaagctagtagtagagcatccacacttgtacaaattctcaggtagaaacatgaagagaaaaatttggaggggtaaaacaaaaggtgacaaagtttgattaatgaaaaacctgaaagctaatctgcaaagttggcaaccgatgccattttcttctacgaacttaaaatccaaagattcttccgcttcccaaacattgccagattgcctaaggccgagtttagttccaaactttttctttaattttttaactttttcatcacatcaacactttcctacacacgtaaacttccaacttttccatcacatcgtttcaatttcaactaaacttctaattttagcgtgaacaaaacccaccataaccgtacaaattatcaggtactgtgtctcctgccagaagaaaattggactggtaaaacaaagagtgacaaagtttgattaatgtaaaacctgaaagtctgcaaagttaaaagatgatgtcatttcgttactactccctttgtcctaggacaatgtaattgaacatgaggcttgtccagatacattcttctaggatggatatttgctatattccgagacgaaggtaatacctctattttattttaagtgcagttgtggtttccatatccaacgtttgattgtccgtttcatcatctaataacaataaaaatgctaaccataaaaatttttaaataaaatagacgatctaatgttggatataaagaatacaaaactattatctttctatgatctttctgagacggaggtagtagaattaaaaaaaaaaatcatccctttccaaacattgccagactgcctaactgtacagtcacggcgccatctcggacggatcacgcatttgactttgccttttttttcgacttcttgctgccgagtcaattccgggaaggcctccataaaaactccatctcgatcgtctcatctcatcgtctaccaacaactaaccgccatctctctcctcgcttttaaactcccgcgaaacaaccgctcgctcacacacacacacccagagaagcgagacaatctgctgctgctagtggcggacagagtccaagaaggaatccaagaatcgagagaaatcgagatgctcgcggcgaggacacgattcgccggcggcggcggcgcggcggtcgtgctgctgctaatcgtcgcgtcgacggtggccaccagggcggccgtcgccgacgatttcttctcccctctcagcccgctcctcgcccctgtaatcggtaaaggcaccttctcaaaggggatgatttctttttcttcttcttgttacaaatttgatggtttcttgatgatttggttggatggatggatgggacgggagcagggtcgatgtgcaagacggtggcgtgcgggaaggggaactgcacggcggcgtcggggttcccggggtacaggtgcgagtgcgagcctgggtggaagcagatgcacgtcggcgaccaggccagcttcctgccctgcgtcatccccaactgtaaggcttccgcagctcgcctctgccctttgctgctctcacaatctcacatgctctggctttctgcggttcttgttgtgtcatcaatgtccagctgaaatacggctgttcctgtgtccgtgcataactgcataccaacctaacttttgatcacaacgaattgatgtaggatgttggcatgtttgtatctgcaatttgggtacggttgttaggcatgatcattagttttctaatgataaattatagtgcgtgaaagggtatgtagcctagtggttgcagtgacctgagtagcaccctaagatcctgagttcaaatctccatataagcgaatttcagcctgttcaataggctaagttcctactttaaagatattgcatatatctagttggatgtagaggccggctaaaaattacccttctaaaaaaaataaaaattacccttctctaaaaaaataaaaaaaattgatagtgcgtttatggccaatttgcactgggagtgtgcgcgtgcactgtagttagtgggttgaagcaatctgcagaacagtaaaattcttaccaatagttggattcagaatgaaatgaacatccgaatgttttttttttcaagtcgtttcagcttgtaagttgtactgacatgccaatttctgaacataaaacaagtggcatctgcggtatgctgcttttgatgcttcaagcaactaaagcagattggcagcaatacggttgtttgtagtcgtgtcctgaatgtgcttttccaagcaaataatgtatttgaagtctagatgcacaaaaactttaatggaccaatcagatgcagatggaatgaattccaatttcttaagtctgtttgccgtcccggcatggcgaaaaaagtctgtttgctgtctcttttactaagacaaccagttaccataatttcaacatgcgtctccatcagacaggaaaaggctagattacttaaaaatgctcacgcctttgtgtcatcttcagagactattttttgaaccagcagcgtcatcttaagagttcctatttgttcctacattagaagacattcaagcgattattaaacatcatgtttactaatgttatgtggcccatatcagcttacatactcaaatgttatttttccttgcaggttccattgaccgtgcatgttctaacactatagcaccagcacctgcgcctttaccatcacccaaaaatttctccctcccaacagaccgtaactactgcaactggctgttatttagattttccttttaaaaagacttcctcagaactttttgataaaaataccatttccatttcatctgtgatctgatcatcaattcaccattgactgtataattgtgtatgcatagcctgtcaattagcttactgcggttcgggaggcacatgcaagaatgggacaggcctcagctaccactgcgagtgcagtgagggtttcagtaaccttctgaacatcaccacaatgccatgttttcagaattgtaagatcaaaggactcaagccacttgtccatgattgtgcaccgtattccctagctaactagtgtcaaaaatgtcattgtttaaggttcaatcggtgcggattgcgcaagcatagggctctctccatcctcaaactcttccagttctcctgcaccaccgggatctgctggcatatctaacaatggtaatgcacctgcatatggtataacttttttttttccagatgtgttctataggacatgttctctatttgcttcatgggattatttagaaaaagtataccatttctattaactttgttcgaactttgcaggggcgatttcacataaaattctacttcccttgctgattttgggctcactgatggtctgtcaggctatatagatagagaatggagcatacgtagtacatttgagctagattgtttctgccacggacaggatagagcagttagcctgttagagatgtacaccttttgggatgtttgaagtgttgtccagtgtccacgttatggttcttttattctgtgtgagatttgatcacattcatgtgaattaaaatggaataaactgtctctgtgaataactgaataaagggatgtttatatgggcattactttgcttgaaatgatctaggactacaaaagcaatatgatatgtttttatggtgcttatacattacaaaaggagaatattttctccagtagaaatttgtaataaaatcgttgcaagcctagctgattctttcttgcttggattccgcaatttaaaatgaaatctgtaaggagtactacaattcaggcaagttcttgtatcaattcggccagggaataagttcactttaactccctgaactaatgaccgaatctaattcatatccttgaaccgtaataccggatatatcgacccccaaactattaaaaccggtgtaatttgactctctttacggttttggagggtggttttattgacgtggcagtgttgacccggtctattttttgacgtggtgcttaggtggtattagaattaaaaaatatatataggtccattcgtcattagaaaaattagggacccacctacatgtgggtcatcccctccctatccttctcctccctctctctcccgtttgtcttcctctcactttgctcgtcttcagggggcaggatctggagcgacggcggcggtgagggtcggagcggcagcggcgatggcggcacggcgtcgaactcctcctgtacggcagcatcctcatcggccggtgctgctactcatccggggttcatgtatggccgcatccccatcgccctcgctcgccagatcagggagcggtacacccggcctggcgccattgccgagcaggccggtcatcggtgcgcacgaatgcacgatgtactcgtttgtggcagagcggatcaccatggctcagttcttggcggagccgtgtcttgatgaccggagacaagccggcaagcacatggacgctcgtcgtcacgggtcgccacagcgagagatcccccatgtacacgctgtatgtatatatacaaggacatc

SEQ ID NO: 61049 - DNA, 16424 bp, Oryza sativa
  unsure (1)..(16424): unsure at all n locations
tatacaaggacatcgacacgtatatcttagtagtatcaacgcagatcaatcgatcacaagaataagctagctaccggtggtgctgctcgtggtggtggtggtggtggtatctttgtcggcgccaccaccggcggccgtgtccagtgcgccgctcatggtgtgggtgtggacacggaccggatggtggcgtattgcgggtcgtactgcatgcagggccaggagctgggagcgcgcaccgcggcaggtgtcagtggagcccgacgatctggaggagttcgacgccgtgcagccgcagccgctccggccctcgcccctccgccgccgctccgaccctcaccgccaacgccgctccagatcctgtcccttagagctgagacggcgaagtttctcggaaggaagagaaacagagagaaggatagggaaggaggagctgtgggtcccacatatcggtgggcctcacaaatatgtttttgtgtgaacgactaatagggcccacatatatgtttttaattctaatgccacctaagcgccacgtcaacaccatagactaggggcctatttggtacagcttcaactcctaaatataactccaggagttgagtctggagtggagttgtggagctgtctaaacccagcttcacaactctattacattttgtgatagagttccactcaactccactcccagttttgatgaagctgaaactgtttagctggagctagagctgtgccaaacaggccctaggtcaacaaaaccaccctccaaaaccatcaagggagtcaaattacaccggttttaatagtttgggggtcgatatatccggtattgcggttcaaggatacgaatcagattcactcactagttgagggagtcaaagtgaacttattccattcagccagtattgatactgggccaatatgtacaatgggccggtaacctactcaccgtcagcctatatagcttcttgctcgttggcccattggtctagctatattgcatcagtacattgttcaatttttttttcattttttttcatttttgttactggtcagcagaaggttcctagtagtagtggaatggagtagtaatatgagttgtgaactccaagtccaagatagttctacagagcatgaaaacattgaatgactgactgaaacttcacttgggagacgatgaatttcgtgcactagcgtgacaagtttgatgaggaactcggagaaaacaacaagcatggaaaagttgcagattctgaagatgatgcggtggcaagtagaataataaaattatgtgtatagagaatcataaaatggaccggacatcagagtccataacaaccgccgctgcaggcaatattcagctccgggagcaccaaattatgggggctctcagagacatgtttcgttgtctcccctgctctgattttttttgttcgcaattatggggtcacgtggcaagcttccatcttttcagaaaatggaatagtagttaaaacaggagtaaacaaaacatatatagaatcaagaatttagaaatagtagttaacacagtagtaaacaaagtatatgttgtcatatgttggaaccgaaatagtcatagttagagatgatttacaatagtttctaccagtagtagaacccataaatctatgattaaggccacatctaatgataataatattagtcataaaatacttacggcagagaccatcgtagagttactcaacagtttaacataggagtaaacgtggtactagtaattaacaataacagcatgctgtcaatgtttatcaccagtatctccaatggttgcttgcatcgatcctctagggaaggttaaaatcggattgggatcacatgcagtcatagtagagactgcaagtttagcagttggaatcatttttcatcatcggatcatggcaatcaacggctgaaacaaatgctacaggtgtattaaacagtatttgctacagtacatgctacaggaacgcactttgtatggtcctttgtgaacagtatttcggaaagatctggggcgttaatttataatccaatggtgtcggtaggactgcttaagttgcagtggctcccaatccgttaaaatcaagcagggaaattgaggtagtgtttcataccgacgaagataataaagattaagttggtgcaagtaaaacaagcaagccattagttttacggagtacaactggcaactgaaacaaaagagttgttgagtcgttcagcgaatcgctcgtccttgtctcatagccacagaaattctattgtatccacacaagtgctatttactccattttctagtgtctccgtttttttctcttcctgatagtctgatacagtagatgatatacctgttcatcacttgtttctgcagagaggcgagtaaaaagggctccttgctgtaacaacaagcaacctcactcccaagaatactgttaaaaaacaaacagatgtgaatctttcacagggaagcaggtgaacggtgcaaagacatgcgtgcccttttcgttttgagaaaaaatagggagagaaagaaaccttcttccaacatttttcgctgttcatctgaaaacacatcttttggctattcaagcaaagccaaaaataaaaaagaagaagaagaaaagaaagaaatgcggaggggccttgaataataattgcaccctgataaattggagcatcgccacattactccatagccttttggtgtcgtgagctcaatccttttttagggttcttgtacctcctctggccaccgtcatagtaggctttaaaaaatgttcagggacagggctcgttgtcaatcactgacaagagctagtattcccaggaaataatcacacaacagctgtaaccagaaaattactggaacaaaaaataaacaagaccgcgtaggtgtagtatcgagaaaaaggataatatgccatttcattcattcggtgagtttcgacgaaataccacccaatacgatgcaaagaataaaatgccactccatagattatctttaggatattttgtcactttaagaggtttcaagaccaaaataccctggagagagaggaagagaagagaaggggagggggggcgaacgttgaaggtggcggcatccgtgctcatcgcctatgagcggtaagcgagcgcgggcagcgccggaggcagcgagcggtgcgcacacatgggcagcgcatgaggcggagagcgcacgcgggcggcgtcggaggcgagcgcatgcacgttggggagccctccacgtcgtcgtcgtcgcctcctccctcctatcagtgctgccctcttccctcatcgccgccgccgtcctccctgatcagcaccgtcgtcttcctgcccatcgcagtcgtcgtcttcctccctcgttgtctccaccgtctcccccccccaccatcaccacggtccgcccgtcgcaggctgcccccatgcactcgccgcccatcgccgccgagcatgagccccatccggctcaacctccccctctctttcctcttcctctctatccacagccataggtattttggtcttaaaatcccccaaagtggcaaagtatcctaaaagtaacctattaagtggcattttatcctttacaatacatgtattgggtggcatttcgtcgaaaccccccaatggagtggcatatcgtcctttttctcgtgtagtatgccctatctgctgagaaaataatggattatctgtttttttatactagctatgtgaggatataaacaaataaattaactactataaaattttaaaaaaagtttttggcaaaaatcttatatagataaaaacttccgtacgttaaacttataatttgatagcttgggaactgtgcaaacagtaatctactcgctccgttctaaaataaatttattttccatatatctcacacataataatcagaaccaaaaactaaaatatcattgctttattaaattccaatgtaattactgcctatcttatctactcccagtacatttatccattatactcataaactccgaagcaatgagtatttgaaatgaacttattttaagataaaaacttattttaagataaactaataaaagctaaaaataagcttattctaagatagagtgcgtaaaaataaacctatttccaaccccgaagattcagttcaaatttgaagtgtcctaaatccccagcgtaatgttcagagagaggaaagaatccatttcttgcaattaaaaggtggctcctctcctcatcttgcgtgcctgaatgacacgaaatgctgccttcttctgcgaaagattataatgaaacgatgattgaactactctaccaatacataggcctgcagataaagcccagctaaatgcaaaagaaaatgagcattctgaacataaaaggacacgaaatggggaatgccgaaatattcaggcttccctctctagggaacttatgatgatttgacgtgagtaaagcagcagcagtaacataaattagtgccaccagcagaggcagcagtgccaggagtgctcctatatcagtaggtcgctgttcattgacatttgtatacaaatcgcagagatatgcttgtttttatctttcttgtttcttgttcctgaaagaaagctgagctgcaatcctgttgctctacaaccccctcctctcttatccaagctactgtttgttttctgatcttttggggttaggtctagctcctttctgtggatttctgcgctctcatatactcctacagttcatctctgctgcccaacacatgctctatgctgtgtcttgtagttgaagttcgtgtgtgatcaaaaagtttaagttagtgcttttttttgaaactttattttaagtcagtactaatgtgacaatgaaattgttactaatgtgacaatgaaattgttgtgtgaaatactgtagtactgaaatgtgcatgcacgggtgcactagcctcaagaacactaacacgcatcagagctgaagatagaagtaggagaggtttttcattgttcatctacctaaagatgtttgaatagcaagaattgaacagagcaagacgatgatgtgcagctacgagcaattacaaagttcatggcaaagatggaacaaattagtagggaaaccactccccaaaaaaacgcaagggaagaacaaacaacagagaaaaaaaaaacaaatgaaaggagaggaggaggagaaacaaaatggcagcattaacatctctcgccctcgtccgctccctctttttgtacacaacaaacaagcatctacttacagcagcattacactcgatgttcaatctccaagaactcaacaatgtcgttacacacaccaacccatcgaagcctgcgtgattgatcgatcttcgcagcaatgtccttcttggctgcagtattgtctcttgctccgtgcagcaatggcgacgcagccgggaagagcaagcttgggcagcttagcagcaatggtcatcaatggcggagtggtgaacgagaacgacgcttatgtgcattgcgttggtcgtcccaaattaccgtcagggcatgaagagcttgtcgccgcacttgcagcgccacgcctccgggtagtactcgagcgggaagctccggcctggctggatggccacgtgcaccggccggcatgggtggcagccgccgcaccggctccggcacgtcggcggcgacgaccccggccccaccagcctccgccgccccgccaccgccaccgccgatccccagctggagtagtacacctcctccgccaccgcaccgccgccgtcgccgctcctctttctcgccgaactgcacgcccctgcaaacacgacggccggcacgcgatcgagcgcgtcagaacaagcatggaatgcgaagaaaccaacaccgagttctcgacccataccgagggaagctgcgaggaggaagacgaggaggatgaggagcggcgaggcggcgaccgggactctccgtcggcggccgcggcgcgccgaggccatggccggtacgtagctcgcgagatctcgagacgagcagcttacagctagcgcggcctactgtcccggcagtagtgaggtggtagctagagggagaagagaagtggagaagcaacaagcagcagcagcacgcgtgcgtgcgcggatcagctcagcttcagcttcgcacgagtcatgggtgcctgcggggtgaaagaaagaggagacgacgcagtgagagagcgtgtgtgtcgccaccgtgtcgcagagggtggcgtgcggttggcgaggcggtggatggctggcttttctcgttctcgtcgtcgtggctattctacttggggcgtttctaccatagggctactggcagtctgcgcggtggtggcgggggccgtcgcccgtcggtctcggcctcgcgattcgtgcgggaccggggcctggcactgcgcgcggtggccgtgcgcgcacgcacgcaccgtctgatcgtcgtcgatcgcgtacggccgccgtccgtccgatgctcccctgctgcatgcaagcaccgagagatcggtcaatcgttgtgcagtgcaatgccattgccagctagtacccctccagtagtaaaaaaaaatcatggtgttctgctcgatcgtagtactcctccgtagcaatggagcagacacactattggcggcctggaatcccggatggcatgaagccgcttcgtgttgtgttgggccacgacggcgagctcgtgcgtatcgatagtagtagactcggggacagttcaaaaagtttctaactgctgcagtttcttcaaaaattaaaaactctcttaaatagtctagttttattttaaattctgagacgttgtaattgtagaatttagaaactaaattaaaaaatagattctagaaaacctagttttttcatattttcagaagctagataatcagctctttcttgggattttaagttcccagacaggttagtagtacatcgtagggtgattctccaccgaatactcgtcgttgcaggtttggaacccgtaacgtgacaggccgcgacgatcgatcgattgagcacgcagtttgtgcggtgctctacactacagaagctcgtcgcgtccccagctgctcgaacagtttttgtttgcttggatctgtcaccgagaggcgccatttgatatagggtggctagattcctcctactagctgcaattctgcaaaggccgtcacatcggagacgtcaatccttcatgacctgctcctagtatagctttctctcctcgataatttcatcggttagagagggccaagtacacacttggtaccacatggctctgacaatattgctcttaagcaccgaccgatctgctacagtacttgcttttttgtaaaagatgaaaaagcagaattgaactcactcatggccaccgctagagtagcacgcctccaaaatactcgaccaggctaccatgtcatgcaacatgcatgcattcggcctccgaactttgctttgtgtttagatccaaagtttagatctaaacttcaatcctttcatcacatcaacctgtcatataaacacaacttttcagtcacatcattttcaattttaaccaaaatccaaactttgcgctgaactaaacacagcctttgtattctcctgtaaaaattttcttacggctgctagcatgagggcttgtttagttcacgctaaaattaaaaatttggttgaaattagaacgatgtgacggaaaagttaaaagtttatgtatgtaaaaaagttttgatgtgatggaaaagttaaaagtttgaagaaaaattttgcaactaaacacggccgaaatccgaattcagatttggccgaaatccgaattcagatttcctgacgtggacgtgacagccggatctatcccggaatccaagcagaaattactaacgaaacattaacccgagacgcatgtactactatgatcaaattaagggcacgtttcacagttgaaactgtagaaatgttgcatggatatcgataggagaggaacagaccatcacgtacggcatcaccccgacagaggatcacacgagccccccccaattttnccccaaaaaaaatccaaacggccttgaaacgccttaacaactcgcagtaccatgcactagctattactccatccatatctaaatatttgacgctgttaattttttttaaaacatatttgaccgttcgttttattaaaaaaaataaataattattaattattttcctatcatttgatttattgttaaatatacttatatgtatacatatagttttatatatttcactaaagtttttaataagataaacgatcaaacatgtacttaaaaagttaacggtgtcaaatatttaaaaacggagagaatactactaagggctaaaggaacgatttgtcataagaaaaaaaaattaagtgtgtactaaagccgatgtatgcgggagacttaaaaaggccaggccagataaggtagtctatgtgcacgatagtgcaggaaaggcgaaagctatcaacaaacgagatcatcgatcacatgtcgtacgtgtactcgtgtcgattaattgttccgttgctggtcaaaacgggtctggatcctcctagctagctgatgagaggttgaaggctcagtcatccgatgcgatttgctcccggttttgaacaaaagaagggtcagaccaatgtgacataccaagatcgctgtcccccagtactcccaatcatgttgctagttagcagagaaaacaagcgattaacgtgcattgtgatgttgagagcttaactggtgggaaaattagtacctatcaagctgcgtgtacaacgtaaaagtttatatcaattttgtttcaaactaaaggttttgtttgggatcagcttatcaattagtatgtccagtcgtaaatacttcatttgatatttagggtaatatttagtcaaaattttaaccaccaataacatctgaagtgtttgtttttttaataaaaaaagtacgagtagctaggtatattttcaagaatattattactccctctgtttacaaactaagcacttttgaaatagtgctcagtcatacctttttttaactttgattatcaatagtaaaaagaattaataaagattgaagatttaagaatgatattactagatatattgttaaaacgactatcataatacgtagcaactctttttattttaaatattttccttacttgtatatatgttattagtcgaagtagtgtattggagggaagccaaaagtgcttacgtttgtcgatgaagagagaaccgtagtaacataaacatataaacttattacttctatattttctaaaattattatagtataaattaatggctaaaaaacataaattttactcagtaatatttttctttgcatcaaaattttacaactggatgaaatggcatgaagtatgcctgagtgtggaaaaaaacataagacctattcgatttacatgatttctaaatcacaggaatataaaaaacatagaaatattgtagaaatgcacatgcaaaataaatgattggaacatatgattttttttctacactgagctaaacaaaagatgatagagtggatgtgttttcattcctatggaattagtatattttggaggattggcacagtgttcctacagaaaatttttctttgaatcctacgaaacgaatgcatgaatagtactatttctaaggaactgagatttcctacgaaacaatgcatgaatagtacttatttctaaggaactgagatttcctctaggaatctttcaaaatgaataagggctaagcaaggtgaaacgatcgatagagtagcaccaaacggtatccgtatactgtgcacacaagtggatgccggcaattggatcccatcgggccaagcgatcacatcgaaatgaccaaaagcgaccgagcagctgtggcccgtgcccgtgtcgtgtttggggcgcgcttcctactagtgaaggctcgtctcgtccattattcaagcgagaccacgctagaagtacgcgctacgcagtcacgcacgcatgtgccacgcagaccaaacttggttttcgattacttcctacttcctttgttctattttaagggccgacatgatttttcgtatctgaatttaaattttttaaaaaaatttaaaaatataagtcacgagtaaagtattattcatgttttatcatttcataaaaacaaaaatactaattataaaaaaattgaaataaaacgaacgattaagttggacacgaaaacttatgattatacttaaaatttaaaatgagacggagccacggagggagtatcttcgattttacccatgtcgcctggcgacggccttttgaccgtttgcaatatatcatcaaaactcaattttcttttgatatacagtagtaacgtgtaatccttttggcgttccggggggaaaaagaaaaaggcaccgcgtcgcacgtacgtactcctctcgtctcgtccgtccggtgcacgggggctatgcgtggaatgagcctatctgcctccccgcgcagcatgggatgggagctctagtactaggctcgattggtggaacagtgcccctacgagtcgtaggctacgacccccgatttgactgctccctggggcccccgcgtcccgcgcgcgaggatgcatgcatgcaatcactggtgaacttgcgtgcaaccccaccatgctgcacactcactgtgctgcgagctgccttacttctacttctaccgtgcagtaattaatcgtcacaatctgaatcacaaatgtggattgtggaatcacaaatttgtgcgtttctttggcgatgtaaacgccgtgtttacttccaaaataattcttcaaacttcctaacttttcgatcacatcaaaactttcctacacataaacttttaacttttccgttacatcgttctaatttcaatcaaacatttaactttggggtgaactaaaccagccaaagtaaaagtatttgtcaaggtgtcactcatgtcatgctcttttgggtttttgcataggggcatatgcatctccaacgcctgcaaactctctagcgtacaatccaacacgcagtgatagaccctggctcaggagtagtggcgtagcgtagcgagcggcagtgcagtagtagtacgggaaaggcgcaatggggtatccggttgagggggaaaagggctgtgtgaccgtgtgggtgggggagcaggagagggtgggttggctacacactcccgtgaaaagggaggacggccacacgtgcaaacccacacgggagctctgtctctcgcagccttgacagtactgctccttggaccattccatacattggcagtgtttagttgttttagcgattttttttttacatatacgaagacacatttaaagtattaaacgtagactaataacaaaataaattacatattccgactgtaaactgcgagacgaatctattaaacctaatttatccatcattagcaaatgtttattgtagcaccacattgtcaaatcatggcgtaattaggctcaaaagattcgtctcgcaatttacatgcaaactgtgcaattagttttttttttccacatttaatgctctataaatatgtctaaacatttgatgcgacggaaaagttaaaagtttaaaggtaactaaacacaaccattgttttctaccccatcgccaactactcctattggttgattactgtcgcttgtagtaccatgattgtattcacaccgtagtgtagttgtacacttgtactcctacgtagtactggcgcagtagtacctgtctggctgtctcgagcgttcactgtattgtactccatctattttataacgtaagattttttagcattatccatattcatatatataaaaagttttatattattaaacagagaaaatacttagcatagtattgtattattgtattagcaggggattgataattgattccagtgttcacactggtggagaaaccatctttggtcagtcgaccaaaatccacaatagttccggttccactaaaaacagggactaaaaatcatctttagtcccggttggtggctacagtgggtatatttgatcttaccaaccgggactaaagatcatttttagtcccggttcatatgttgttaggggctgtcaggccctcccgtaatctttagtcccggttggtaacaccaatcgagactaaacatcttaactttagtcccaaccgggactaaagttatgatttttagtcccagttgttaaacaaccggtaaaacaaagcctctatccacgtgcgcatgaaagtctcctattaattccatccttatctcatcctctcccatccagtcatcctctccatcttatctccttctctcctcctttcctcccatccttctcttccttcttctctcaccccatctcctcctcccctcattgttctgaagatattgtagatctgaacaagtgtaaataatatggatgttttgttgtttgattttattcattctatctatgatttaggctttgtcgttgattttattcattcgatccacgagcgaaagctaaagaacaataaaaaaggaaaaatgccaaccggatgaaaggaaaaggaaaaaaacaaaactttttagtcccggttggtaacaacaaccgggaccatattttttagtcctggttggtaactccaaccgggaccatattctttagtcctggttggtaactccaaccgggactaaaaatcgatctttagtcccggttatttaaaccgggactacaaagggttaccaaccggactacaaagcttttctccaccggtatcagtacaaatatgattaatcggcgtgctgggtttcaaactcctgattgatccaacccattgccgcttttgttcacgctaaccccatgctctgcaaagttagaaacggaccagctttacgagttctctcatgagggttctccccatcacggaaacggccatgtgagacaagcatggaagaaactgagtgccaaccatccactgcatgctcgcgttgcagcgcatcaacccatcgcccagctcgtaaaggggaacgaagctcgcatgagcaggagctaagcagcggccaccggcgatgtatagaccggtcaaacgtttcccctcttctcgagtggcccccaccggtcggtcggagagcaaagtgacacgtggcgacacacaattgggccaacggcgtcgtgaacctctcgctgaccggcttcgtggctggccgtattgaccgggccgagcgtgcggtcgcggatgggggcccaaccggccccgcgtggtggggccggggggagggaatcgtatccccgacacgtgggcccgtcatgtggtcgtttccgtcacctcggcatggggtgcacgagggggtgcacgcctgctgctgctgctccgtccaatggatgatgaatgaatggccgcgtaaattcaccgtcccttttctcccagtccccacacgctgacacgcgcacgtacgcgcggtgacagacatgtggtccctgcgtgtcagagtcctgaccctcactcacgtactgtacttgccagatcgtgtactacgggctacgtattgccagatcgtgtcagagtagcattttgcaccgctacagctctatctctcctcggtggagcttcagatccaccaaaaatagaagcggtgctgggtggagctctatcataaaataaactagagatgtgaaactaggtgtttagggagctacataaccactccagacccaactcttaaggctaaatttaggagttgaaactttaacaaatagactcctaactccgtattcgctccgctcttaaaaaaatcaacctacaaaagaatgtgacctctcgatagcacatattgatttttttttttgatggtggaagtacggagtacataactccatactcctagctgctacttgtacttgtatttccttttttttttctcttcgaaatggtgcgatcgatctagctagtttttgagtagaagcatttgtatatggtgcgagatgacaaggtaataagtagtaggagtacgtatgttcctcggtcgtggctgatcgagcacgaacctccgcagtagctagctagctggatctacgcacaaaagaaatactaccagtatatagtactccatccgtttcgaaatgtttgacacagttgattttttagcacatgtttgatcattcgtcttattcaaaaacttttatgaaatatgtaaaattatatgcctacataaaaatatatttaacaatgaatcaaatggtataaaaagaattaataattacttaaattttttgaataagacgaacggtcaaacctgtgctaaaaagttaacggcgttaaacatttcgaaatggagggaatagtaaaaaacaagccggtgatacgtcgtacttccactactatacatgagtcgcgattgaacatactcctatgcatggctggatctgtcacaacgtatactacatgtcctcggtcggatgcatcaactcacgcacagtacccgcaaagggacaagacgcggtacaaccgtacaaccaggcaaaccccagctagcctttgccgttgttgtttaagcagaaacgcagcagcatcgatatgatcggactacacctactccgatcggttggtacgttgacacgttattatgttcttgcggatatatcatggacttgatggcgagtagggatcacagtcgcacggtgagacaacctgcttacacggttattataaaattaaaagtgtgacgatcgatcagctagctacatctaaaatgagatgggatatgtataataaatttagacaaaagtctaatttaacgtgtttagatttattgtattttattctattttaaattaagtatttttagtacgaagaaagtagtggtaataactgataagtgtacgaggattgagctgacaagacggtttacttcgccgtccggatcaagctggcatgtacagtgtgtatgcgtactggatcgattggctagcaagcgcaagctggagtagaatgcactagttgaacattccaatcgagatgcattgcatgcatcacacgcacaattaaacgcacgcattgtacgtagacttacatttacacacggcactccatcgatctctccatctgcaaaacactgttcgaatgttgggctggcatcagctagcttgcccatctagcagtacgcacgtgtacgttcttgttgcagtaattgaagatatccactacacatatatgcagacatgcagtgtagttaaagtactcttccatctctgaaatataaacgctttcataattattcattggaattaaggagatgagagaagtaaaatttaaatgtgaatggttagattgagattatgaagttgatcaaaccaattttaaacttaaaaggttgtttaagagggaggaaacagtagattaagatataaagatgcatgtgtgtccacagcactaattcctctggtcgatctgccaccactgtgtgtgcttgcatgcatggctgctgttttgccatagccacacttgtacacgagtgaccaatcaatgcatgcacgtctacttctacctgctcgatcgattgattgccatctgcaaccaccgtacaccggccggtgaccggccggccggcgtctcctgccctctgctcctttcttcttcttcctcatcctcttctctgcaagtttaatttggttcaggaccacatcctgtgatggaggagtaatagcttgtccgtgtggtactactccctccgtcaacccctggatttttgtgtccaactttaactgtccgtcttatatgaattttttttataatttgtattttcattgttgttagatgataaaacatgattaatattttatgcgtgacttgtctttttaattttttttcatatttttttcaaataagacgaacggtcaaacgttgggcatggaaatcagggtttgtcttttttgagatggagggagtacgtgaggactggtccagtgaccaatagtccaatacatagctctcgatttgtatggctggctggcattaacattcgccagtaatggcttgctgtcgaagagttcgatctgttgatcgatacgacatcggtcaagacaggactgtatgaacaagcgacagtaatggtttgcaccttgggaaccaatcaatgtgtgtgctcgcagttgcaggcacggttcctgcagggcttattgcctttgacctggacgacatcatggtatgtataggactcgatcaggacacttgaaggttaaattcacttgtaaagaacggctacacaatgatatatgcggattcacttacggaagtgctaacgggcgatcgatcgcccagcgacaagggtagcgatccatcccccttccccctccctccctccacctgctttccttttttggcaccgcattgggctgcag

SEQ ID NO: 61050 - DNA, 16694 bp, Oryza sativa
tgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggtgaatttgtgtatttcataccatggtgccccatatgagtgtcctatatatatatatatatatatatatatatatatatatatatatatatataatttgaaaatttttaaaaatttaagagaatttgtgtgttttataccttggagcccgggcaccatagagtcccatataggtatcatatatatatatatatatatatacacatatacatacatatacatatatatacatatatacatatatatatatatacatatatacatatatatatatacatatatatatacatatatacatatatacatacatatatatacatacatacatatatatacatacatatatatacatatatatatatatacatacatatacatacatatatatacatacatatatatacatatatatacatacatatatatacatatgtatatacatacatatatatacatatatatacatatatacatatgtatatacatatatacatgtatatatatacatatatacatatgtatatacatatatacatatatacatatacatatacatatatacatatacatatacatatatacatatacatatatacatatacatatatatacatatatatacatatacatatacatatatatacatatacatatatacatacatatacatatatatatatatacacatacatatatacatatatatatacatatatacatatatatacatatatatacatacatatatatacatatatatatatacatatatatacatatatatatatacatatatatacatatatatatatatatatacatatatatatatatatatatatacctaggtgtctatggcattaactacattgctatgtaggacttttagcttatgtggcactatattaattaagagagagagtgaagagaggaagaaactgggtctcatgcaagacacagcttcaacacgagaacatatgtactagacactatcaagttttgcattgggagaaaatagtgtctttataatagatgaagaataaatataattggtagaaaagagaaatgttgtatttattaatggcccactttaagaaaccataggttgtagagtgtagtttctattgtgatgtcttattaacatggcaccatagacactgcttatgggcactatggtttggactgccctaaaggaagtcgtttaggataatgtttaagtcaaaccttgagaatataaataataaataactctcaagttgttgagtttgaaaatgtaaaaattatatgaatagatttgtcttgaaaaatgctttcataaaagtatacacatataacttttcaataaatatttttatagaaataagaaggcaaagttgtgttttggagaccgtgttgctgtctaaaacgattttctttacgagtacggagagagaatgtaccaggaactatagtctatagtaggcaaagttgcggttttccatgtgaaaataaatgtttcatgtgtttctccgcatagaacgggccagttcttcaatcactacccacgtgtgtaattatccatttttattttgttattatactattaacatatctgatgatttatttatacatacacatgttgattgggacctctcacatggtggtacttctaaccacacaagaatgtgactaaaatacatttaaagatgaattccttatatatatatatatatatatatatatatatatatatgctgttgaaaatttacccaatcctttgttagtgagacatatcagcggcttagaaaagatttaggtgaatttccagtgacagagaaccagaaggaatgaaaatgatacgctgaactgacggtatcagaaaaggtagaattagtctaatttctccttttatgccatttgttttcctagtaaaactactgggctacatgctgtttcaccaagcaccttcacttaccaatgtttaaatcaagaagcctggaaattacgcacactcgatcgggtaaggtttcaatataatggaaattttaggagatttacttatttatgtattattggccctccatctaatcgagtatgaatttagggggcatacaagtagctagctatgtgtgtgcatatgttaatccaaaaagtaattttctaatattacacttttttcttttgtgcaaacttcttgtttgaatacggaataaaatctgtgaacaaaatatgaatgccgaaagcaacatagtactcctcttatggcctgtttgaaacattaatgcatgattaattaattgatcagtagcatattaatcgcatgtaaaactgattaactcattaatgcatgattaattaaatagtaactattgtaaattttaaaatagattttttttctatttttttaagagtactatagaatttctttacaaaatacactagttagagttgaagtcatgaagcacactgatgcatgtaccaaacagcaatatataatgccagcacgacagatatatatttggattcaccatcggatcacacatatcggtatcctcggaactgcaggaatgaatggagacatcatgcacaaatatactcataccagcagatttctaatcaaaagagccccggcaacccagcgaaatgagtaccccagctagctagctagccaccaaagttcagctaccatcgtcggcagagagaaaaaccacgccccagatcaatggtttcccagatgatgatgcatcaagcatagcagctagcagcctagcacatctcgtcggcgtagcgagtttggttacgttgcagctaccggtgtggctgtgtgctagctacgctggcctcaaatatcccccataacgagttgacgacatgagcgacagccacgacgatgctctggcgcgcgtagtggtggcggcgttttttctcagatgtacgagcacactgcacttgaatctgccggctggtccgaccccagtggaagctccatggacaccgtttctgaactcatctgaagccccacgtaaaggtccaataatgcaaaaagtctattcgtggacgtcctcttatttttatataacacgtaaaagttaataatttttttaaaaaataataataagataaattaatatgtgatatatcaatttaaaaaatatgactttaaattcaacttacataagtagaaaaaatgatttcgaatagaataggtaattcatagtaatatttttccttcaaatcatatggatcaaaattaataaaaatgatatatgtacaaccctaacattcgactcctctatacgagcagggctgagtcttattatcctcgtgttaaatatagcttatatcgtgatgaagcctgacatgcgcttgctagcgtggctcatgccattacgcagtcagataacaatcgtgcgataatgtcgtacatatatttaacaactttctaaatataaacttatatattcgtgaatggtataaatatatacaccatatattgatctatcttaccaattatatttaaaaaaaatgataactttttagatgatagaagacgtcccctcgtaataatgcataaattcatctcccaataatgcatctcggtcgatcagcttctctcaaccctctgcaataattcccttgctcagttatgcatgcagtagaaaccagaactctctgcgtcaattaggtgcctaatcacaatacacgggccgacagcgcagcacacacacatgcaattatgcgcattattgctagctaattgacgcaagaggagactttgagaggggagtgcaataatgcaccctgagcaacaaatcgatatctctcgggtcgtcgacggtcacgtcgatcgccacatgatctgttctcgtggggggggggagtcgtcgaagatcgagtggttactaccgctttccactacgggggagattcaggcggtgggtaggtggcgttgctcctcgtcttactcttgtccacggttggctaggccataggatttgcgacttttgacgggcagccaggagaagattgacacatgtgcgaactaattggaccagcgacgagcggcgttgcttggtagttagcgagtagctgctactgagctagtcttcgggcagaatcaagaggtcgactcctatttttgttgttccagtcggtagagtactaatgtatacaattcattagcatataatcctccattctaaaatactccatgcaattaattagtacctccccatcttttacttttttaaatcatccactgtcaaaatctctaatcccattaaatgcatacatagtatttattagagtatgattcattcttagttttgatgttaatggtatttacgtctaatattttagaatagataaagtactcacatgctctttctagcataggttgttttagctgtcgcacaactactctttaaatatgagttgtatcaaggctttttttttcgtatttttagctcttttatgtttgtacataatatttgttgtgttcaagtgtcgtatatatagtaccaatggctaagtggaggtgtttttttctttctaacataggagtataaattaagggcataactttggacaaccttttagccttttttttggacaacagtcgtatttggaatcaaagtgatgtagtcttgtaagcaaaagtatgctacttttatcatacaccttccggttgtccaaaatattcgccatcaatcttcccaaaagttttggtgtcatgaaaaacgtttgtaaattaaaattttgagaatttgtcaacccttatattatattactagcaaaaatccccgtgcgttgcaccgggtgattacagagtatgtatattgaccaaaaatgttgtttggtttagcaaaagtgcccgtgcgttgcaacgggaagcgtacatatcagaaaaatatgcaattaattaaaatacaaattcgctgaaatatttggtatttttaagtaggtatgtgtataattaaataaatttacaagtaaagcaagtgtgagaaataaaatgacatggttaaatttaattttttaattaagttctccatgattagttatgctctttgaaattttattggaattttcagagcttaattgctaattttaataatacaaacatcatttaacaattatttaattaaaaaaagcaagaaactacttccttttatgtttgcttcgaattaaacatattcaataactataattgttataatgcttcggaaaaatgaagtaccaaaaatgaacttcttctatttttcttcggcccgagggacctaaaatagacttatttctgtcccttccgattggcccacggccttttgaaaaccctaaccctaatcctcccccaccccctccccctctcccccagccgagccggtcgcctcttccactcctgacgccgcctctccccctctccctctccccaccggcgccgcttcctctcccctcccctccggcggcgctgctccctctccccatctcccgcctctccccctccccccagccggccgcctctcccaccaccggcaccgcttcccttcccttctccctcccttctcgccggcacggcgcagcgatggagggctgcggcggcggtggcggcgctgcccttcccccatgttagcagccgcggcttcgcccacggcgagcggcggcggctcccttcctcacgctagcggcggtgacggcggcggctctccttcccgtctcgccggcacggcgcagcgacggcggggtgcggcagagatggcggcgacggccgtccgtccctctctccctctccccgtcggcctcgacggtgacgatggcgtcggcttcgtccgagggaggatctgtcggcggtggtggccaccacaggcggatccggcagcagcgctccctccgccgcctctcttctcactctggtggcggtgttttttttttgcaatttttttccatggctattgctaaccgaatcggattgtgtatggacgaaaaacagacgaaaattagatgtgacgaccggaaaaatacgaatatttatattagttattgatatggtgtagcgcccgttccgtcatggcgcctagcgggaaaattatctcttaaaaactctatttgcgaaatctgtttccttgcttgttgtctagtgtccgtgccatctcagatgtcaaatcctcgatctatcgtcaagttcaatcccgaatccaaatccttcccaaatcaaatccctccgcaaaagtctattttgcctccctcgggttcgatgggccgaatccctctcggcccatctccctctctctctctctctctctctctccctctccgccgctctgcccgtgcgttgcacacgcgtgcacgtgagccgcgccgagccgagcgccctccgccctcgctgccgcttcccgccgacgccgccgaaatcgccgcgccgcccgttgcttcccacgcgcgcgcgcgccatggtggccgactgcctggtcgctgccgcgcctgcccgcgcctgccgcccgtgtcgccgctccgctccacaccgccccgccgtcatcgccgtcgtcacgacccggcccccgacactccacgcgctagcctccaagggacggaggcagagctcctcctccctctgccgcgtcgcccccgctccctcctccttttcccaaagtggcaaggggcaagctccctttctgccttcctttttccttttcccctccccgccggcgtcatccgcctctgtcaccgttttggccgcgagcgccgagcgccagctcgcgccttgaccgcccaaggtcggtttccaaaccgacatcgtcgtcctataaaccaaggcgccctcccatcgattcctcctcccgtttcgctcgccgccaccgcgccattgccgcccctctgtctcgcctccgccgttcatcgccaagcaccgggagagccggtgcgttcgtggacgcggaaggggactccgggagctcgtcttcctcctcttccccggcccgaggccggagagatcactcccgtgccgtcggcccatcgtcactgcgccccgtccgcacggtagtgcatctccccgttctccctcctcaatccatctcttccccttagtttttggtagtagcatgtgtagcctccccgtagctagccggcgccgccccgactgctgtcgtcgctcgccgtgtgctcgccgccgtcgccgctcgagctcggaagcgcctcttgtcgccggcctccctcgatgcgtttcctcctaatccggcgcaagggatgggttcccgtatccgagtagatgctctcgccgccgggaatcggcccctcgtgacctcatcgccgtttcccccttttctctccgccggttgccgccgccgcaatccaccgccgtcgagcatcccccggtgaatccgagccgttggctcgtctcccctcgtcccgtgcaacctcccggtgtgctcgctttcgcctgtatcgccatggttcgctccactgctcgccgccgtcgtccgccgtccgttccggccggtgtcgtcgtctacctcccgccggcccgcgtggcagccatgtaggcgccacgtcggcgccacctcggccgcgaccgggtcaagcagaccccggcccgccgcttccctccgcccctcgcgggcgcggtccaccgcgagccgtgaggctgcgcgtgggcacgccgcaccgcgtcctccgtgaaccgcgcgcctgcgccgcgcctccctccccaaaccctagctcgccccgcgtgcacctcgctcacggtgagccgagtcgccgacaagcgggtcccacccgggaccacgcgggatggacccggcccaccggctctctctctctcccctccccgcccgcgcgcgcgccttgggccgccttcttgggccggccggcccattaagctcggccgagccgccccattctctcgggccgcgccctagccgcccgtggaagtctaattttcctccctccttcttttcttttcttttctttttcaaaaaggatttaaataaatcctttttcctttagaccaaaaatccaataatcttagaaattcaatatcttcccaaccgtaagtctgtttgactccgttcaacttccaaaattcctcaaatctcgagatctatctaatggcacgcttagaggtcattaatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacgatcaccttcaaacttaaaatctgagaaacatcttgggtaaaacttgggttttacaaaagacttggaaaacccgacacctgggtcggtgcttgcgaactaaatgaatttctaaaaccgcggaccggggaatgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggcttgatgtttggaaaatcggcggctgatgggatcagccaggcccgggtggccatttgaaagctgttggccgggtgccaatcttgatcaattcaaaagactgaaacattgcacatactccgaccggacgagacgcactgtctcatccgtgtcatttgagaagcactcccttagttgtttcggaaaagagtttaaataaaatcaatcgcaaaaaaaaacaatagcctttctttgaagcatgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttccctttcgtaatgcagttgtgagctcgggatctgtccgcagcccaacatgactgtactcctactctataataaagagacctctgttgctgtgatattttgtcttcctgtgataccagcactgtttcctgggactggtatcgattaacaggttaatttggagcgtcacgggctagttccactcgggactagttcggggcgtgacatatggtttggtatttcatatgtcaatgacatgtgaattatggtccatttcacaaacacacagaagtggcaaatcacttttatttcaactactgctggaagggcaaatctttaaatatccctttggaaatttgtcgctgaaaggaatttttataataccaaaatttaggtattatgtaaatctacaaaaatagaaggtcaaatgtctcatggttgaaccggttgtaatttatttttaatttttttagtaaaattatataactgtgggagcttccctacaatattttccttaaaataaatatgtcaatggatcattttccagatgcgtttgtggtaggcagaaagagaagaaaagatacttgtttttcatttgcatattttctgaactattaaacggtatgttgtatattaaaaaaattatatagaaaagttgctttaagaaaatcatattaaactttttttaactttaaaacagttaataattaatcatatgctaatgacgtaccttatttcacgtatcttttcaatcttttttctactccttgacacataacaggacaaagagagtaacttttgtttcttggcttattaaaaaggatatctatatagcatactccatccatttcgtaatatttgacaatttcaactaaccgttactctaatttgaccactaataaatcatttgatcacgatgaacatacacgctttatatatatattaaatagttttctaggttggcacgtgcgaattgaaccagcaagcagcgctgctgatctagtcttctggaagaatccagcgcggtagagtacaaatgtccaaattcattactccctctattttactagttaaaacatttttggttcccataaaaatatcctaatttttcatctactttctcttctaaaaaaaaattacgaaaatcatgctataaatcatttgaaatttaacattccacctcataagtctttttctttgcaaaaatacctcagtgtgcacgtgcttaaccaaatcagccgttaacacttagagaaaatcccctatgtacccatgaaagttcacctaatcccttctatatccctgaattttgttcaatcccctacatacccctgaattttagtttggatcccttccatgccctttccgctagttgaccgttagttgaccgttaaattcttttgaaaaagtccattttgccctttgctatgaagaaacataataaattaatgaagtaaattgttggaatataaaaatttatcggatgggattattatatttatgaatatgtgatgcaccatattatttgtgacaagtttatttttacatatgatataaaaagttaatacttatttattagttattaaaagttctattatgtagcatatgtgttttcatagtaatacaacaaatttgtttattactatcagaacacatatgctaaaaaaaatcttttaataacttaataaataagtattaattttttatgtcatatatacaagtatatttatcgtaaataatatggtgcataactatctcataaacataatagtctcatataacaaatttctatgctgcacaatatactctattaatttatatatatgcttctttataccaaagggcaaaatagactttttcataagaatttaacggtcaactaacggtcaactagcggaaagggcatggaagggatccaaactaaaatttaggggtatataagggattgagcaaaattcaggggtacagaagggattaggtgaactttcagaggtacacaagagattttctctaacacttatgtagagtccactgtaggctgagctagctgagtcaatcttattaaagtgctcacattagatctattcttcatgtttcattgatttttttcctgcatatagcaaaactgagtgcaacaacatttaagctctcatcagcaatctatttatgcaatctctaaaaagtgtgttaagactatactcctaaatgtatttaattttggtaaaagccacgtaaatgcctcacaatttttaaaaacatatcgattcaggtaagcacgtgtgcacaataatgatttttgcaacgaaaccgagtagggagttggcatttgcaacaaaatgatttatggagtggaatgtcagatttcaagtgacttctggggtggttttgcaattttccctcagtcaatcataatcttcttctaattattttcacatattttctcaattctcattaaagccttcataaatgcttatattttaatattgatgggagtagctacctctaccccgacctcatgttgtacagagtattactctctccgtccctaaatatttgacgccgtttaactgttgtaaacatatttgaccgttcgtcttattaaaaaacttttgtgaaatatgtaaaactatatgtatacataaaagtatatttaataatgaatcaaataataggaaaagaattaataaaagtatatttaataatgaactaaataataggaaaagaattaataattacttaaatttttttaataagacgaaccccactcccctccaaagttttgtagagtctgttacggtgattaagggagtatgttaaattaagagcaatgctacacgtactaaatttttcttactaaacttttactaacaatcatctcaaccgtttgatttaagtagatggaagttacaaaaaatctaatgcactcatagcatgacacatcagtgttagtaagaatttagtaagaaaaagttagtacgtatagccttttcattaaattaaataggatgtggttatggttatggagacgatagagcaggtgaaaaaaataaataaatgagaggggttggttgagatcagagaataactagagaagttgctattatgcgataaattttgcactaagctagctctgtgattgtcggtattagtccaagataatgtagagaggattggcttcttatttctctttgcattttctttgttttttttaaggaaccctattggctttgcttactattttgaattttataaataaaaagaaagtttttgttacaaaccagaaaagaaaagaattcaaaattttatatagccaatctatcgtttttttatcaatcgaaaaacgtgattctctttaaccttatttgcttctagattccatagctgcgtgattctccttctttgatgtaaagcagtaaaggcatacatacatacatacatacatacttacttatcagcgacacacgtgccagtttcatctttctctcatagactatggtatgtccttttctccaaccaaaattggatgaacttttagatactcgtggcacgcatttcaaattgctaaacggtacgttttgtgcgaaaactttctatatgaaagttattctaaaatataatattaatccattttttcaagtttgtaataattaaaactcaattaatcacacattattaccatctcgttttacataaaacacttaatttttatcttcatctccatcttcagaagattccaacaccacctatatatcactagtttacaccaaagttcatcgttgatgtagttactagtgtactacagtaggcgttcgactaatccatccataagttaattgattgggggaatttttttttccaattgcaatcagcttattgttgaatagtcctacattggttgtggaagggcaaaggacctaagatataactgggggagcccctcacctcaatggctagcttttggggtgggaaaggccctttacgatcctacaattggtatcagagccttgttttcctctttggatttttatcgatctagagtttttgccatggctactcccgctaggttttcaactaagcctcatgttttcgatggaacagatttttctcattggtgtagtaggatgcaatcttatattatggctgaagattatgatatttggagaaaagtttctcatccttatgtgattcctgaagctattaatactgctgctgaaaaaactgcttttgaaaaaaattgcaaagctcccaatattcttttgagtggtatttcttgttcggattatgatcgtgttgctcatcttcgaactgctcatgagatttgaactgctttgagtaatttcatcaaggaacaaataattttaaagaaattcgtcgtgatcttttcaaaaaggagtatattaaatttgagatgaaacctggagaagttttggatgactatctttctcggtttaataaaattttgagtgatcttagatctgttgattcttcttatgatgctaattattcacaatatgagatttctcgccactttttgaatggtcttgacatgtctatttgggagatgaaagttatatctattcaggagtctgttaacatgtctactttgactttggattcactttatataaaattgaaaacacatgagatgaatgttctttttcgaaaagttgattctaagtcgagtgctttggtttcttcttcttcctctttggatgttgatgcttcttcatctaagtcttcttttcttgctgtttttaatgccacctccgatgatcaactcgaacaaatcgaggaggaggatttggctttggttgctaacagaatttctcgagttatgaataatgccaggaacaggaaaagaggtggtccaaatcgttgctttgaatgtggttcaattgatcattttcgtttgcattgtcctaagcttgggagaggcaaaagagaagacaaagatggtgagaagaccaacaacaacaagcccaacaacaacaagtcaaagggttcatcccaagggaggaagctggacaatctcagaaaggcttttcaacaagtttgcgccgtcttcgagccactaagtgatgtagatggtgaaagtggagatgatgataagggaaagaacatctccgatgtttgcttcatgacgcgtggtgaatctgacacagagtatgaagataatgaggtaagtgcttttgaggaagctattaatattttgagtgaaaagaataagaagtgtgagaagatgtatagaaaacaggaatttatcattgaatctcttaaatctgaaattgctagattaaaatctgttattcctaatgatgatgattgtgaaaattgtgaggttttaatgaacgagatttcaaaaattagagatgttaatgctgcacatgatttgaaaaatagatcttctcttgcttgtagttttgctttggacacacgcactttggatgagttatttttagctaaaaagttgttgcaaaaatatcaacttgcttttcatgctagtttgatgtttaacatgatttctgctaaaaagttaaaacaacctcatgatgttttggattgctcaacatgtaatttgaataagttgaaattgaaagatgctttaggtcgtgttgagtacatggaagatgttgtgaaaaacaatgaagggctttcttgccccaaatgtcgtaaaagcaaaggtatcatggtagattgtgaaaattgtgctaatttggaaaaagaggtttcttatttgaaaaattctttgctaagattttctgatggtaaaaagaatctcaacatgattttggatcaatcaaaggttagcacacgtaaccgtggtttaggttttaatcctattgctcataattctagacatcctcctgttgtgttaagtgttggtgctagaggtggtgtgattttggttaaacctgatactaacaaaactatgtttaaatctgctggtatcatgtctaccttgaatgcatcttcttcaaaatccaatgttgtgcatgcaaaatctcctgttgttgcttgtgttgctaaatcttctaatgctaccaatgtgtcgaatcatcgtgaaaaatatacttgttctttttgtggaaaagatggatatattgttggtttttgtttcagattagctcataaacagaaaaaggagagagaaattgcttttgcaaaatcaaagtggcaaaaatatggttttccctcgaggaaaccggtcagaccgcagtgggtcccgcggtcagaccggcgaccggtcagaccggcttctaagcatcggtcaaaccgggcaccggtcagaccggcggtacagaagcggtcagaccggcccccggtcagaccggccactatacctcggtaagaccggcctcggaggaatttttctgaaaattataaaattgattttgcacgtggatatatgcctattggatcttctggtcgtgtatctcagtactggattcctaaatttttattatcatctaaccccagtactgaggcttcgacttctgcttgtgtgtaggctttggtggcaaggaaggagaacgtgtggatcgtggattccggttgttcgcggcacatgaccggtgataaaaattagttctcctccctaaagaaggcatccaagactgaatcgattatctttggtgatgcttctataagtgccgttcttgctacatgtttggttaaggtaaatgaaaattttgaattgaagaatgtagctttggttgaggacttaaagtacaatttgcttccagttttacaaattgttgatgaaaattttgaggttcactttaagaaaactggaagtaaaatttttgattattgtggtgattctgtgttgaatatttctcactatggaagtgtgtttaaagctaattttgaaattcctatttcacctgtgataacatgtttggttgttaagtttgataaagatgtgatgttttggcatcgtagacttggacatgttggttttgatcatctcactaggttaagtggtttggatcttgttcgtggt

SEQ ID NO: 61051 - DNA, 8711 bp, Oryza sativa
acgcgcgtcgccgtcgagctccggcattctctcctctccgctacctttattcggggcgatcgacgtcgcttgcaccgagaaaacgaagcgattttgctctactctagactagctagcgagctagttaccgctgcttggactacatgggatgggatcgatcttggccttcttcttgggcagctggacttgttgaggcctctcgttgccaagtcatcccttagcaatgctatctctttaatgtacatctctcccaaaaaggtgaggagttctgcagtgtccacgcatgctctttctgctttgagaatcaacaggggtgatgtggatgacacctagctacatataaatgtgtaagggttttcatggtctgcagtttcgaagccacatgattcctgtaggatatcaggatagatgtgtgtggctcttgttataaagtataacattttggttagttacatctttgtttaattagttttccgtacacgaaaatcacttttggtccgtctggaaaaattgtttttttatagtgtctgtttgggtcggtgccaaactcaagttggaaaacttaaattactgtgaacgtttttgccgtgtattttgatccttggcgacatttatggcattctacacacatattttttaaaaaaacaataatgacccacatggcatatattatcttctccacatttttgcataattagtcttcccacactttgccaaagtaatgtgtgtgaaatgttgtagccaaccagatcagtactagcaagttctctttatttgaggccactagtagaataaacaaaataaatatttatcttatttttcggtttgttggtacctcataaaaaactatgtatatttactatttattatacataattttgctgctatcagttgtacaactacaaattgaactcgctttggatcaagttgcgtagtgcgaaagaattcaagtacatacatgcatctcaaccaagagccacacgtataacttttgtgtgatacttgactgacacgtgtcttcatggtgactcatcaattagaaaaaatcttcgtagatcgtgcgacggggttcaactatgtccacactcaagatgcgcgacaaattaactttgtcttatatggttgaagtcaattttaatatattttgtgatgttggcatgatggatcaattggtggtgtacacattggagatgcaaaatgttgaactcatagccatagaattcaacttatcccttatgctctagaaaggatgtgaattggcatatatgcactatttaccacataaagtaaaaaaaaatagacatacagaatcaaaggcaatgtcctatatgctcctacaaaagaatcttgaacaatcttatgtgtatataaagtgaaaaaaacagtgtatatttatatctttatatactctttaactatgaacaaaaatcatcctaccactccaaacttttaaactaacatttatttcctgtcaccctctttctcgggtgaacttcgcaattccgtccatataaccccctaaagcactttacgtaaatcatccaatatatatgatacttaggcaaaaataattttatggagttatatggacagtgttgcaaaatttgacaggttgcttagagcaagtactgtaagcccctaaacacttgcctcaaaatgccacataatcttatatcatgaggtggaggaaaaaagaaagtagagatagtaggagacacccctcatgcaagggtaacctccacatgaatttcaaaagaaatgagaggaaaagaaagagtgaattggacaaacaaataaaatgaaattattgggactagctagtgtgctagaaagtttaggggagggggtacatgaatgtatttttcagggttaattagatgactggttttctaactttgggttctaggcagaactttggatatttttcctatttatatttgcaaaaaacaattaatttgaggtttatctatatatatatataatatagtttcaacctctaaaccaacaccattacgcgtattaagtagtgatccactatcagaacactcagttgatatttacatttaatcacatgttgtacattaatgcatattttttcacagcttttatttttgagatgagtatatgacttcaatttgtctctgacttgtcctggactcctgctggttgaccatcagcagaagtactttaaagataaacactatggcaattaatcatcaacacattcgacattagagtattcaactaaaccataattcactggtagtgtttggaataatcaaactaatgctaggtgaaatgtgtattcaactaaaccataattcattgatgatatgtgttatggtcataatctagaatttccacattacaaattaagtccatatataagcattgtgaagaaaaaaatatgtattgaaaaatttatttgtgaagcacctaaacaaatccaatgtgggaatggatatataactaacaaattggatagtgcatgatcttcatggcacatatcatataagtacaggcacatcaatggttaggtgtactagttttaaaagctagaatgtttattttaagaaataaggtgatcattatcattactgtgagttcttgcattggcaatttcaagaccaaaccctcctaattacattttttttctattgcctcatgctactaccacacaacatcccttaaccaccgattaataaccagcatcaatgccggttacagaatgcagcaagcaatcgaaactatcactactagttgcccaaccacctccccacaccccacataacgctgatgcaccgccgttgttgttgccgtcgtcttcatcttggagacacggatgccatctttgtcaccaagacatagctgccgagccgcaccctactcctcccttaccctgccaccgcccccacatttccatctctctacctcctcctcctaccaaatatagcaacctccaaactggatcaagcatggaattttacgaattcttaggttttcaaaatagtgtaatgaaaaaaagaagtgttttgaatcatcggagaggccatggaggtcctatctcctagcggacgcgagatttggagatagaggatgtagtttttgtcgttgtactaaatatatgatacccttcaagtatggaaacatatctaaatacagaatttcctatatataccacacctggtacgatggatgggtatgaaaagaatacaacctaccacacctagtacgatggatgggtatgaaaagaatacaacctaaggcaaaggttctattaggatatgatcacctcatatggcaagactttgaaaggcctactcggacaagaccaagatatacaaagtttatctccaagaatcctacaagaaaaccaagattatgggtacaaatatacagacctcgtggtgaagagaggattgatcttaacaagccaagtcgatgatcatgacaagttcctgattagaagatcccaaagagatacatgtaggtataaattagagcctctctacatattgcactctatacacatctacatatatacaataactaaaaggatgtagggttattatcctaagggaggctcgagcatgtataaaattcttttttgtctcggtgtgcatacgagggtctacgaggcattgcctttacacaaacaaccctagatagacttaaaattgtagtcatggcatcaaagtgtttacacttttattgttgcaatgatgtgactccttggaaataaaatagggtagtcaagcatagagcagggtggagaggtgaggaaaatcagtgcacggaaagcgagagtgggggaactagaggggccgataaggagaaaacaagaggatggcagtggttcgtgaactctagcctcagagcggatagggccgctagatctactgacccctagctggatctggcactaaaaggcgacgggggagggagggagtaggcgtggtggaaatgatacatcctcatctctagttgggtggatgtaatgttgattaaggagtcacttattggctatctactattatgtccgtgtctttacccaatataaaagggttcgagggctaaacagatttttgtaaaataggactctaatatttttaagataggataacgtaaatgggttacaatgaaaaatggattatactatgttgcagtatatatatatacccatcaatttcaaagagctaagtttcagagtaaactttattatgtttatttagtaaaggcacgaggacagcgcatgctctgatcgtacggtgtgaatagaaacccaatggcaaagcttgagctgtcttgtggaaagaaaaaaaaaaggaaaaatctctcgtgatgcgtacagctaccaactgtagcaggtacatgcacctgattcagttgagcaccagtacactgcactactcactcctagtataggatcatatcatattcataggagagagtcatatgaaaacacactgagtaataaaatcataggactataaataagtatatatacttctacataaactactccggagatagatagccatgcatgcaggcagcattacctgctgctggttgcctctgcctcctcaatcctgacgccccggggttccgtctccggctgagaaattaggctagccgacaagagctcgccatactccctcgtagctcaacatggcttatgtttaatgccccttgcatctctccctgcagcgcatacacatgcccggctcccgagaaagtaagtcaccgaggaatggaggagacgaagatatctgattccctgcgcctgcttttgtagcaaccggtggccgggcggggccgggatggtgatgccattagcgctgacagtggtgttgtttgttgttgttgctgttgttaggaccattagaccgatcatgcaaattaattaagggctaatttggattactaccctactaaaatttgccctaccaaagttttggtagggtagcaaactaaacatctctactaaaactctaccaataccatacatttggctttgtctatgaacttgtctcttatgggtaaattgtggcttcaatccaaataaacatttttaactctaccctactaaagttttggtagcccaaaatttggaactaccaaaattttagtagggcagcaatccaaacatgccctaagcaatcaaagccaagccccaagtcaaagcaaagctagggggtgtagtactgtacagtagctgcagcattctctctcttctatctcctctggcggcagtgtcaatcattagtggaggtatgtggtacatgtgtgacgcgagggggggcagctttatttatcatcgagtggaagcaaggactagcagtagtactactactactaccttgctgtgagtgtgagacagtgtccgtcgtccttgagccttcccatcaccggtcagccagtcacactgccaggcagtcatgctgccatgcacgcacctggagtacctgggctggatctccgccgagcaaaagttgctttggcagcagcaaccaccgccgcttttgcctttcccgatcgagcctgcacctgcacgcgccacaaacgaggaccaaccaaaccaacccccgtggcaccgcagttaccaggcacactgtgttggctatagtttcactcatgtcatgtcatgcttctgcgctgcggtctgcattgtcacgacggatgccggagctggacctggcgggggagtatcaccaagtacacactagcgcagccgctgccgctgccgctgccagtgccatgccaaccgcggggcacgggatggaggagtatcctgtagtattcatcatgatgcatgcggcgatccatcgatcggtttggtccccgccaatcaccccaaccatccatttatgtcgtcgcgccccgccccgcccgcgcgctgagacacgcggctgcgtaggtgtgtaccggtggcggggggtgccccgagcgtggaacgtgaggcagaggggcagggcctcgttttgtcactggtcctgagtaccaggcgaggcgacgccaagcgagggaaaaaaacaagggagggttagactaatgacggtggagtggtggatacagatacatgcacggacggacggactcacgcacgcactcacgcatacataccgtggattgacgcgagggcggtgcagggaacccggggcttggggctgcggctgcaaccgctgcgttgcgttgcgtctttcttatctgcttgtccattccgttcccgtccgctaggtccccccacgccacagcctcttatcccacacgcggaccaacagcgccgccccgcccgtcccccgcttcaccttcggcttcgacttcggcttcgtttcctcttctcttcgtctctccctccctccagcgaaagaaagagagagctcacctcgcgttgcccggccggccgcggaggagagcacggcttcgcattcggctggagctctcgtctctgcactcggagtacagctgcaaactcctccttccttgatttcttcaccctgtctccacggactgcacagatgtgggtgcaacgcgatctttcgctgcctccggtttagctctccggttgattccgatcgaggaagctgatgcatgtgtttgtatatggctcggtgttttgtgtgtgcaggtccgacggcaacgacttcgccgagctgctgtgggagaacggccaggcggtggtgcacgggaggaagaagcacccgcagccggccttcccgccgttcggcttcttcggtggcaccggcggtggcggcggcggcagcagtagtagagcccaggagaggcagcccggcggcatcgatgcgttcgccaaggtggggggcggcttcggcgccttgggcatggctccggcggtgcacgacttcgcttctggcttcggcgccaccacgcaggacaacggtgatgatgacaccgttccgtggatccattaccccataattgacgatgaagacgccgccgcccctgctgctctcgcagcagcggactatggctccgacttcttctccgagctccaggcggcggcggctgccgcggcggccgccgcgccgccgaccgatctcgcctctctgccagcctccaatcacaacggcgccaccaataacagaaatgctccggttgccaccaccaccaccagggaaccctccaaggaaagccacggcggcctgtcggttcccaccacccgagccgagccgcagccgcagccacagctcgccgcagccaagctgcctcggtcgagcggcagcggcggcggcgagggcgtgatgaacttctcgctcttctcccgcccggccgtcctggcgagggcgacgctggagagcgcgcagaggacgcagggcaccgacaataaggcgtccaatgtcaccgcgagcaaccgcgtcgagtcgacggtcgtgcagacggcgagcgggccaaggagcgcaccggcgttcgccgatcagagggcggcggcgtggccgccgcagccgaaggagatgccgttcgcgtccacggcagccgctcccatggccccggccgttaacctgcaccacgagatgggccgtgacagggcaggccgaaccatgcctgtccacaaaaccgaggcgaggaaggcacctgaggccacggtcgcgacatcgtcggtgtgctccggcaacggagctgggagtgacgagctgtggcgccagcagaagcggaagtgccaggcccaggcagagtgctcagctagccaagacgatgtaagtaaatggtatgagatagatatgcactgcataaccagctgactataccttcgctgattctcatgataaaaaactggttctattcaggatcttgacgatgaacctggagtattgagaaaatctggaaccaggagcacgaaacgcagccgcacagctgaggttcacaatttatcagaaagggtgagtagctcacatcttcagtgcatggatcatcctgcatccatttgcttcaaagttcacatgtcagtgcattgatcatcctgcatccatttgcttcaatcccatgactcgactcatgctgcaattttattgactgtattgcaacccaacaatctttgcagaggagaagggacaggatcaatgaaaagatgcgcgctctgcaagaactcattcccaactgcaacaaggtaaagataagccattccatcgtcttgctccctctgagatgcctctgaatgaacatttggtcaattcaggcatgctatgttttgcagattgataaagcctcgatgctggatgaagctatagagtacctcaaaacccttcagcttcaagtacaggtacattgaaactgccttcgaacaaatgtaccatgattgtcgggtgaatatgtacatagatgcattgacaaggtgcagttgtcattgacacagatgatgtccatgggaactgggctgtgcattcctccaatgctattaccaacagccatgcagcacttgcaaattccaccgatggctcatttccctcatctcggcatgggattggggtacgggatgggcgtcttcgacatgagcaacactggagcacttcagatgccacccatgcctggtgctcactttccctgcccaatgatcccaggtgcgtcaccacaaggtcttgggatccctgatacaagcaccatgccaatgtttggggttcctgggcaaacaattccttcgtcagcgtctagtgtaccaccatttgcactttggctggtcttcctgttaggccaag

SEQ ID NO: 61052 - DNA, 5841 bp, Oryza sativa
  unsure (1)..(5841): unsure at all n locations
gcaaactgaaaataaaaaaaataaatttctgcaaactgtccttctccccgatttatataactaacctgtatagatgatcaattatataagtacatgcatgtccgtccatatatactcccatttaccaacaagctccgagatgagatgacgacgacgtctcctgtacgcatatgtgctgtttgttgatgtgaaccggttggagggttttagatccgtcctccgatcaacgcgagaggcccgtggacacgtttacacgcgaccacccagtagtacgtacacatgtcgtgattaatttcgcagacccacgaacaactactcgcgggtcatgtcaaatcgatccatcaactgtttgcgagcagctgagaccgttagccttgtcttccaaagcgccgcactagctaacggccaggtttgatccggcaaatatagtccaaacgagatcgatcggtttcaaatcggcctcaaggactttcaaatcaaagctcttcgattcgatctagctagctaattcgaatcagcaaaagatcacaactaacgccaaagcgcggttacatatatatatatatatatatatacataataattcatatgcgcctatacatgtcgtcgtcgttgttgtctgtatatgtacgtataatctctccagctcgttgttaatcaagtgctattttgacatcgacgtgtatggtcttaaaacgtccgtgtgatttattagttgattgatctgataatgctgcagcgcatctgtaacatggaaataaacctgtcaatatgcgaatcggtgcttcgatctgttattcagagttatttcagacaatgggtaagctaaggggcctcccctcttattgataagcattatatatggcaattgccgtaagttttctaggattcagcttattaaaaccctactccataaacattagaaatcaattaatacaattagctagtgttttacaagtccatgtctcctaaaataaaggatatcacaccttatactagcttaattaatttgtgacactcttgcatggaggaaagttctccattaattaggtgctctctctgtacagtaagctggccggaagtaatggtcaatagatttaattatgctgcgtgctacgtacgtgtctacgtgtgtgccttttaattatctgttccctcttgcaccattattctgcccttttcaaatcgtgcctgaagtgtaggtatacagttggtgaccccaggaaaggctacaattaagtgctgactagctagacggttactgtgttggtgaagatggcaagtgctaactaatctgcagtgcatgtatagttggtagtgtaccctgcaacgtccatggccgttgttagttgtttggcaggtgatcgagccattcggtgatgtgaaggtctaaacaagtggtaacgttgtaacgagacgtctcctgccatggtgccactgccaccttcaactatctcctaattgttgcttgttggctactaccaactagctagctaggggtttagatcagtcaatgtgcatgcatggttcaacttaaatgaatgctctgtgtggttttctttgttacatgcatgcactattccattgtgattataactgaattagcatataagtttgctaataagcattgaacatcgttttctatcttaattagtacagtaaaacacgtgtttgtcctctctaattacaaatgcagtctctaattacaaatgcagttaatttggtcttgttatagtttccaattcttctggaaatttagctttaatttgtaagcatgacttcttaggtactttgtttccaaacatgtaagtactcgggacatataagataattttgacacattctacatgttatttaattagcataacttcaaaatggcctacctacattttcaaccggagcatgcgacaatatttcgaataataagttaattattataggaggcgtcttcgtccaaggcgtcactagcgaaggcaataatgtccacagctcaagatttcatcgacgcatgcagctgtactacgccaccggtttggtagcttgctagctatacgaccgcgcgagagctagctatcaatcagatcggtgcacgaatcctgcagacacgtcatcacggcacgctacggtagtaaatcagaattttcaccagtgatctaatctagctagcactatataattccaagttttgagccctgtcaatcgactgatggatcgctcaataactagttaattaggtatagttacatatatgtaggcagcgaatcccccattaattttgtctacgtagctatagctagctagcgtggactttatattggctatattgttaattttttgcacgcgcgcgacgggatcatctggcgtcacgtatatgcatatttatgtatctgcgagaggtagcagtagcagacgtaacacgagtggcgacgatcgaaatgaactgggccatccccgttcgacgggaacgcgcgcgcgcctgtatgtaccgcaccgacagtgcggagaaagagtactactcgcggcacgtacgtccccgcgcgcgcgcggccgagccatggctgttggtatcgaccactccacctcacgcttgtcaccgtcgacctcggcaacacgtacccacgcttgggcgagctagctagctagctagtgcgcggccccgcctcggtcgatcggtggctggatggatgtacggtggattggtggcgcgcgcacggattatttgggcaggcagcgcgtggtgcactggtgcgtcgcgcgcgcgctggtggcgaacgtgacgacgtactgcgtgggctccggccccgcacgtacgtacgacgacgacgcgcgctccccgtgcagggcacgtcggcgtcgtcgggaagggacgtacgcggggtacgtgggggacggcgcgcgtgatagggatgctcgaccgccgcggcaagcgacgtcccacccgcgcgaccacgcacaccgtttcgcgcgcgcgcgcgcatgcatatgggggccggaggatttagccgggccggaaggccggatgcagggctgacacaccgcccgacaaaaacggggggcgtgtagntgtagcgaccgccccgccccggccggacgtcgtccatcgttatcgctagtacgacgcgacgtttagtactgtacctgcacgtaaacccctgcgattacagaaacagacccgtaacattagtctcaacggttttctgcctagcaattactactaagtaatacactctcactggtggagaaaccctttgtagtcccggttcgtaacccccctttagtcccggtttccaaaccgggagtaccaatccgggactaaagatcgctatctttagtcccgggtgaaataaccgggagtaaagatcgatctccaaccgggactaaagatagagctgaccttttttttttttttgcatgcccatgttgctgcatggtttatatatatatatatatatatatatatatatatatatatatataaaccatgcatatatatgtttcaatacatatatagaaaatctgtacacatgcatatagaaacatatgtagtcatgtattaattacaattcattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacagtgcaggcctccaggtcgatgagtaaaagcacccagtggaatctgcaatgtgcgtgggatgcattacatatgaaacacttagcaagttcgtacgggaatgaaatttggtatgtaggaaaacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattaatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctggggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaacaactcaacttcgaccttggagtatcctgctggaatcggcctgcagtggtaagtacctgaagggtccgttgggatggccatgcccgacgccaccttcatgttgtgagagattatttattagtaatcaacatatataagcagcaacta

SEQ ID NO: 61053 - DNA, 2785 bp, Oryza sativa
cgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgtagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttattccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttcccttcgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgttaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtgttaggataaatgcgaagtaacatatatatatatatatatatatatatatatatatatatatacacatgtatacatgtatatatacacatgtatacatgtatatatatacatgtacatgtatacatgtatacatgtatatatatacatgtatacatgtatatatatatatatacacatgtatatatatatacacatgtatatatatatatacatgtatatatatatatatatatatatatatatatatatatatatatatatatatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgataacggcggtgtggcggcatcggggcggcggttggcgcggcggcgtggcggcggcgtggcgttgtggggccgtggcggcgcggcgtggcgtggcggcggtggcgtggcgtggcgtggctcccggcggcgtggcgtggcggcggcggtatttgcgcgcgcggcggtgaaggcggcggcggcgtg

SEQ ID NO: 61054 - DNA, 14261 bp, Oryza sativa
ccaccccggcccccgccgcggcgcccaccaccccaggtccggccaccgcgccacccaccaagtccaccaaggcacccggccaaggccaccccgccgccggcctcatcatccccgccgcggcacacgccgagccaccgccgccggagctcgcccacccggctcgctcgcctgctccgccacccacccgcgccgtccgctgcccgggaagaagaagagagagagaggggaagacgtgaagaagaagtgaggatgaagaagagagaagggagagggaagaaggcagggctgaggctgacatacggggctcacgtgggccccaccatttagaaattactctctccatttcaaaataagtatagttttagcactgttcatgtccaacatttgaccgttcgtcttatttgaaaattttttatgattactacttttattgttattagatgataaaacatgaatagtactttacgtgtgactaatttttttaatatttttcataaatttttcaaataagacggatggtcaaaacgatgaacacggatttctatgtctgcacttattttgggacggaggtagtatttttttatgaagctgacatgtggggacacgatttttattattttttcgagatataattgccacgtaagcaccatgtcaatgccacgtaggatggagacctagtcaaaccagccacgtaggcgccacgtcagccaaaaccaccttccaaaccgttgagggacctcgtttgcaccggttttaatagttgaagaaccggttgtatctggttttgaagtttgaggacgaaaatcagatttggtgtaaaattaagggacctcggatgaacttattccaaggattaaataggcttaaggtccaatcgtcaaaatcctaatgtgggtaacaggataactagataatgcccatttgcctaaacataaccagaaaagaaatgtccattttgattcccttaagggtcaaatctagtttgtatccctcaactgtaatcttgatccaaactattaaaacaagcgtaaatgtctccctctatgtttttaggggtggtttttgctcacgtagctcgttgacctaatccaaccgacacagtcaacatgagtattttctttctttctttttttctcatcctctcggctcttgttctctccaaccaaaaaaaattattcaaaaggaagcaggcagggcagcacattgtgagggaatcaggcggcggcgcacagttctctcccttggcaccctcctttccctcatatgcaatggactcaaaagggcggctgcagcgtatgccggtggattaggtttcgagggtggatccagtgagagcaaaggtggtggggtgacccaaggacgctgcttcgctcaagtccacatgtgcttcgcctcaaggccaggatgccgccgccctactcgagactaggtagctgacttgagactaggccgttgtcgcgcgtcggggccgcccagccgctgctccaccttgggtcacgctgtcactctatctcaaggctgggccatcgccactatgcttgaagccgcactaccgtcccacctcaaggccggcaccctgtcactccacctcgaggctacctagacgttattttgttccgctgctacgccttagagacaccccactgccgctctaccttgggctatgccgtcgctctttctccaaggcgcgctgctacaactccgccctgagtctccatgtgcctgtgtggagaaaggagagggaagaaagaaagaaaggagaaagaagtgggaggaatcactaacatgtgagctctgtatattgatttggtcagttggattaggtcaacgagccatccaagagaaaacaacccttaaaatcattgagaaaatcatttttaactgttttaatagttaagagatgaagatatatttttttttatagaaagagatgaagatatccgatatccaatatgataggaatcagaaaacgtatatttttgagggagtcaatgcggacttattcccaccagaaactgcagcatattggacgcagtggttccttccgcggtagctgcgcccgcgcccacgggaatgcgattcccagcccattccacccccttcccattccggtgggccattccgaatccaaccaaccaaccaaccatcgaacccgcacccgcatcgtatccactcctctccagtctccccgccgctccgcatcccgcagccgctcgtcagcgacggacatggccgccgccgccgcagccatggccaccgccacctccgccacggcagcgccgccgctccgcattcgcgacgccgcgaggaggacccgccgacgcggccacgttcgctgcgccgtcgccagcggcgcggccgaggcgcccgcggcgcccggggcgcgggtgtcggcggactgcgtcgtggtgggcggcggcatcagcgggctctgcaccgcgcaggcgctggccacaaagcacggcgtcggcgacgtgctcgtcacggaggcccgcgcccgccccggcggcaacatcaccaccgccgagcgcgccggcgagggctacctctgggaggaggggcccaacagcttccagccttccgaccccgtcctcaccatggccgtacgtcttcttgctccccttctcttctgattctctcgcggcggagacgacatgaatgggaatggtggtgcatggattggggcgcgcaggtggacagcgggctcaaggacgatctcgtgttcggggaccccaacgcgccgcggttcgtgctgtgggaggggaagctaaggccggtgccgtccaagcccggcgacctgccgttcttcgacctcatgagcatccccggcaagctcagggccggccttggcgcgctcggcgttcgagcgccacctccagtttgtgtgctctccccgctgtgcattcttgattcacttgtgaaattcgattgtgctgagcgtttccggcgaaggtttcaggggcgtgaggagtcggtggaggacttcgtgcggcgcaacctcggcgcggaggtctttgagcgcctcattgagcctttctgctcaggtgtttattgtagtgtgcaattgctgttttgtttttgatgattcagataagaatacggtgatttcggtgcttaggtgtgtatgctggtgatccttcaaagctcagtatgaaggctgcatttgggaaggtgtggaggctggaggatactggaggtagcattattggtggaaccatcaaaacaatccaggagagggggaaaaaccccaaaccgccgagggatccgtgagtgagaaattgccttctttgttggattaattgtccattgtgttacactgatatgccttcaccatttttagccgccttccaacgccaaaggggcagacagttgcatctttcaggaagggtctgactatgctcccggatgctattacatctaggtttgttatcattgtctttgtaatttacctagttcttcaactatggatattaggtgctgtagattgttcagatagatgcacattgtacaacaatctaggtagattgattgctatggcttgttgaattaactgtttcacttgcatcattgcctcagcacatatgaagcatatggatagattcttcaatcatttatccctcaataacacaattttgacaccagtgcttctcctttttttcatcctgcttcatctggctatccacaatataattaagcatacaaaagaggcactctttgatggacaattcatagtgttgtgggttaatattcattgcattctttgagggacaattcgttacaccctaacatgaactagtaatgattggggtgcttaaccatttgttctgcatttcctccattttcaggttgggtagcaaagtcaaactttcatggaagttgacaagcattacaaagtcagacaacaaaggatatgcattagtgtatgaaacaccagaaggggtggtctcggtgcaagctaaaactgttgtcatgaccatcccatcatatgttgctagtgatatcttgcggccactttcagtaagttatatatatttaattaactttctgttcccaaaatacactgcagcacttcattgcttcctgaggtcctcgattcatttttcggtagacaggaagtagtattcatttgcactttttaagggattaattcaacatatccactggaaatatacatatcctacacatcctgtcaacatacttgctaaacagcattttgtttgagttgactggcatctcagcagccaattactatctttaggggacaagccacattcttaataaatcctgtcggaaatcactttttgatttttatagattagtgttgtcatagaatttggcttggtgatctacttggtaaggttaactgattcacaagtcggacaatttcttcaccaatctagcagtatgtttaagtgtgttggtacttaattctaaatgtcctgcgcatggtaacatatcatatgcaaaaattcctcagtaaccgaaatttatactgtaagttttaactgtctttacactgttaattttagacatacttcttccttgcttgttcattgaacttgtttcccccttccacagagtgatgcagcagatgctctgtcaatattctattatccaccagttgctgctgtaactgtttcatatccaaaagaagcaattagaaaagaatgcttaattgacggagagctccagggttttggccagctgcatccgcgtagtcagggagttgagactttaggtacttataggaattcaaccttattattcttctaacatataaatgaactaatctttcttgtctagtttgcatttattgtggattaagtttggttatattgttcttacaagtttgtggtattattttgtataggaacaatatatagctcatcactctttccaaatcgtgctccagctggaagggtgttacttctgaactacataggaggttctacaaatacagggattgtttccaaggtatcgctgtcaagttgtttattttgcgactatatgattacagtatcctgtttttcaactccagctgctgttagactgtcataataaatctgctactacatgtttgcacactatttgactgcatttaaaaactcagatagcctatatttttagttgcctgctactgggtgtatttctaatgatcccatcatgtttgcagactgaaagtgagctggtagaagcagttgaccgtgacctcaggaagatgctgataaatcctaaagcagtggaccctttggtccttggcgtccgggtatggccacaagccataccacagttcctcattggccatcttgatcatcttgaggctgcaaaatctgccctgggcaaaggtggttatgatggattgttcctcggagggaactatgttgcaggagttgccctgggccgatgcgttgaaggtgcatatgagagtgcctcacaaatatctgactacttgaccaagtacgcctacaagtgatcaaagttggcctgctccttttggcacatagatgtgaggcttctagcagcaaaaatttcatgggcatctttttatcctgattctaattagttagaatttagaattgtagaggaatgttccatttgcagttcataatagttgttcagatttcagccattcaatttgggcagccatttactatatgtagtatgatcttgtaagtactactaagaacaaatcaattatattttcctgcaagtgacatctcaatcgtcagcaaattcagttactagtactactgtgtcatacaggaacacatgagaatgcagcaatctgtttagactcttcccagacatcccccactataccgtttcagtgtgatctttgtgaaaagaaaaagaatgcgactattgatacagtatttgactacctagattattgtatactagtgtcaagctatattcctcatggctcttttctaaaacaacaatacaaattgaagtacaagagtacttaaaatttatatatcccaaggaccgtgccaagcagtgttcttaattaatttgagataacacgatcctaggaagaactagtactagcaaacaattaacaatcaacacaaaccctttggcttgaacttgaaggatgccatcatcatgcatgcaaaatgtacaccacacacacatgcatgtgctagctgtgatcacttctgaaccctttttttttttttaaaaaaaagcctagcatgatcacaggatgacaactgaacacacacacaaatgctgaaatgcctctagctgcacacacattgtcatttgtcaaaggcagcagcaatgaatgcagtggagggatttgatgcacaagaaactgaagcaggtcaccgaggatgagggatccctgcctcccttgctatgcctcttttatctttgactgcatcgatctgcaattctgcatctctgtctgcatatcacgtccctagctgcagcccggccggtgaacagactgaagacaaccatggagatcatcggccatgcatggacagacaacaagggcacaatcattattagctagggttcattcttgcatggatccaacattgcaagtttatgccagccagtagcttttgagccttttgtttctccagctaattggtctggaatggattactgaaattttcagatctctgtcagctggccagccctgcatgcatggaaacaaggcaggcaaggaggaaacagcttttgctgcacagcatgcatttagtagtagaattcatggagaggccaaggagttgtgaattgtgtggttatacatgaggagcagctaggtaggggtcctcagaatgatgtcttgcatcttttgtcgtgcacacatctcaatgcaatgttgtatgtataagttatagctagtccaatgtggcatacagctaaaatggtagctagctcgagctttgtgtctaccgttcatcgaccagctctttattcaggttgatgactctattagctaggtgcatttggcctctaagccaataattgttgaaatgtttaattctttgttaatttttaattaagaccgatgttgaactgtgcatgaatgatcaaatgccttggggtttaatttgtttactctctccagtgtcctagcagctagcaaagatgattctattttgattaacttgactacacattctactatgtgaaaacacacactcacatattgatccatcttctggccatcatttgctaggggatccagatctctgcgtatgtaggggattccgagaggcagggagcagcattacgtgaaacatggatgcctagcttagatttgcaagcaagcttgctctgcacataaagagcagaggaccctatgtttgtactaacgaatggaattatatttaggcattggacattcggtccgagttgctccctccgttgagaaattcaaggcgtattagtttttgacaatattcaatattaaagtgtgaccattattttttataaatagaacactgacaactatcatattaacttcatgtaaaatcttctaaatatgaatccattgacaccacttgtatcacactaaacatatatattgtttgtttatttattagtcaaagtttacaagtgttgacttttacaattactacatgcatggtttatattttccaaaggagggagtaaattatcggatagtcaaactattttagttgatcaaagatgaaatattcaccaaaatagagtgggacaaattataaaaagcattgaatcatttttattaaaaaaagaatccagtgtgtaaattgcaacattaaaaaaaaacttactaaaacattcaaataacaccacatgcaacatttgcaaaatgacatgctaaaacatgtgaaaaatacttattgaaatatatccaaataataccatgtataatgtttaaaaaatccattgcacttacaaaagcgtaatgatccaaattagcattctctccaagcaaatcgctcagctcgaaccaacccaatcgtccacactccatacatggcgtctcctcctgtggtttggctgttgttttcctctctgcccctaccacactttcgcgtgttaggaacccgttggttgcagcggggcatgctaacgtgctgtgagagatcaggggtgctggatggtgatggtgtaggagtcggtacatgggaggacggtgttaggaacctaagcacttcatggggtagttgacactgaggatctgacaaacttcctgtatggcaattgcaagcaggtgctgcctggaacttccattgtgacgatgaaagcggaggcagggtagtatggagacaccgtgccattgccactgtgttggatgaatgagccgggtgagaggttggtggtggcacacgagaggaacaagcgaaagagaagtgtataaaaaaatagttaatccctaccggttcaaaacggtatcatcgatcggtttttaaccggcagtgacacgagcgtatcactatcggttcgttcaaccaaccggtagtgatacaagatgcataaatagatcaattttattgggttcaatcctcacggtggtccatgccatgaaccagcagtgaaacatcacagccaattcatgccatgggtcagcagtgatgctaagcatctctactggttcatggcagtttggacaggaaaattcattcaacccctatggacggatagggatggagaatcactgctagctcaagccaaagtggcagtaacaataagccaattaatatgtgaactcatcaaagtattattagaaccgtatcaatatatgcgtataattatgggcattaggatttaaaactagtcagtatccacaacgactcaatcactatactaaaagtgattctctaatttccaacattcagttatgagtttgctcagaaagtcgcaaagcttaattagttccggacaatcgtgtgccgcgcggaaaagaaaaggaaggagaggttgacaaccgtgagcccgtggccacaccctgttttcacaggccacgacaacgtgagatgaaatgtgatgatgcgaattgaatcagcaggcgatgagccgatcgatggatgatagaggcgaccgaccgaccgaactgggaatgaagcgaagcgacgtaagcgatgtcgcactactgtcccaatctgctccctgctcaactacgcttagaaaactgtcaaacttgtaaaggagatcgagcttagctgctgctaatcgcaagagcaagacaacgttcttttatgtctcgttgctgtcataacccaagtaatctttaatgatctagttgcagcgcgcacacacacacacacgcaatgacgcaaattgatcataattttcttttcctgaaaagaatcgaaagggcctgcactgaataaaagaatcctgcagcctagctaatgaacattcagatacacaagcccagagatagatatatatatatatatatatatatatatatatatatatatatatatatatatatattgtttctttaaatatgattgtcccattgtcatctgctatcctgatgagctcgaaaacgaggcagcccgggtatgtctcatgtgtgcctgctaaaagttggtggtgagctataaaacaatgcgccgcttgtctgaagaaaggccatgcaatgcatatatgcagtttgatctgcagcgagcggtaggaggagagcagtttgcttttgcttccagctgaatgctgctgcatatgctagctgctcgttccctcgatcgcaatcttcactcgcacaaaaggggggagatcgagctggctctgcctgctttatgattcgtcttgtctccttcgatgcatcgatcggcagcttctcgaggaaaccttaacgagaacattttgtctggttaatggccgtcgtttcgatttaatttgtctgattatccgatcccatcagttaattgacttgtaattagcctatacgtcgcccaagttgttaattagtattgatatataaagttattagaagttttaatcatatgacgcatcgattggttattttttaaatcatatagagcttagataaaaacaagactccatgttggtccaccttactaattattgattttgaattacggaattaacttaataaaatgctaaattgagggttcaaaatggtacaacttaatattcattaattttaaattattgacttttaaaaattagaactaaatagtccacaatatttacaagaaaaagttcattttacttccccaaactagttgattagataacttagtacccaaaaaatattttacccctaaactattgaaaatagttcactttactatttaataatatttttcttttatattatgctttatacaagttttattctataggctgaaattttttaagccatagatgacaccattatctaagttcaaaaatattttcaaagtttttcatgactttgtttgaaatttaaaatcttaatgtttaaatcacttttaagtgtttccaacctatgtaacaacgaggaaacatcctttaaaaatgttgagatgccagttataatgcatctatcattctttcaaaatttcaatgtaaaatatgacttatatagagagaaacgaaaaaggaaatatataactttagagatgaaagtggaccgttttcagtagtttatgatgtaaaacaataaaaaacacttcagggggtcaagcgtttcggtgaaattgtctgagaaagtaaaaaggactttttattttttaatgttatgttttatttaattacaggcttttaatatgatctacggttatcataattagatctaactaactaatcaatggctcccacatctttcagattcgcatagaagagtgttcaatctatctatctatctattatattattaaaacagctttgaaatgagggaccacgttcgctgcgggggctaaaaattcccacattaatcggagaaaaagaaaagaagagtccaagtagaaatactccctccatactcgtaaaggaagtcgtttaggacatcgatacaatctctaaaacacaactttgacttcttatttctataaaaatatttattgaaaagtgatacaggtatacttttatgaaagtatttttcaagacaaatctatacatataatttttatattttcaaactcaacaacttgagagttattcatgatttatattcccaatgtttgacttaaacattgtcttaaacgactttctttacaagtatggagggagaacaatttaaaaatagctgaaagtcggaattaaaaataagcaatattgaaaaaagagtccatataagaacccaacacgagattaatcaaaattcggaataaaaataaaataaaatacaaaattagaaaagaaaaggagagttcaagtaagcatacaatttaaaaatagctgaaattctgaattaaaaataaggaatattgagagaagagtccatataagaacccaatacgagattaattaatattcaggataaaaataaaaataaaatctgaaattagaaaaaaaagagaaaagaatagttcaagtagaaatacaatttaaaattaactgaaattcggaattaaaattaagcaatattgaaagaagaatccatataagaacccaatacgagattaattaaaattaggaataaaaaataaaataatatccaaaattagaaaaattaaaagagagttcaagtaggaatacaattttaaaacaactgaaaataaaaaataaaaaataaaaatattaaaagaacaatataaggaattaattaaaattttaaaaaaattctgaaactagaaagaaaagatttcaattaggaatacaatttataaataactaaaattgttgctaaaaaaaataaagattattgaaagaaaagatcatctaaaacacatgacgagataaattaagtaacaggcctataaaagagttaataaaaaactgttaatacgacatataaaaactgttaataaaacaccaaatagaatactaataacgattaaaaggagggacaacaaataggccatgaagcaagcaggcaaggcggttgccgggacttctagaaagtaaaaacaataaaccccattgataatcatattcgatttttaaatctcaatgataataaaaaggagaagcaacggggcatggtgtataggagtatagttgcagagctgtcgacggttggcgggacttctagaaaataaaaaaaaagaattccaaagatagttatattcgatttttagaatgccaatgacaataaatagtaggcggcggatgtgccgtagaggagtataggggcatcgtttaacaagacttctaaacattataaaaaatgaaacccacgagacaataaactctaaatactacaaggtccaatttttaaaggttcggaacttctaaaaagtaaaaaaaaaaacccaatgataatcatatttgattttaaaatctcaatgacaataaagaagggagacaacaggcgagccataaaggagtacaatggcaaagcggctgacggtttggcgggacttatagaaagtaaaaaataaacccgaacgataattatgttcgatttttaaaatcccaatgacaataaagagaaaagagagtggacgggccgtagaggagtataatggcagtgtttgacggtacttctaaaaattataaaaacaaaacccaacgagacaataaactctaaaaactataagatccaatttttaaaggcttaataaagaaggatatgacagaagtaagggatagcagttggtgtgacattaaaaactatataattagaaatacgtggatgataaggtttgatcttttaaagtcttaagacaacgagatagctatttaataaattttaagtaaaatcataccgaaaaatatatgattttgtttgtgttttagtcgcgcaattgcgcaggccacccagctagttagtaaagaagagggagattggctttgttgtgtacgttgcatcaagctttgcacgtgaaaccacaaggatggacgagacttaattttgttttgctcgatatgaattgaatgcccggagtatgaatccaaaaaacctagcaagaatcttatcaggggagaggagaaaatgtagaagctggttcagtgtaggtagctagtgcgtgcccccttgccaaaagcccaaaacttctctcaatggtttgtgcgtgttctctctaaatattttatcctcttacatcggtgccctagctaatataagttaaccatattgacgggctttgccccccttgtcaaaaacccaaaacttctctcaacattttgtgcgtgctctcttaaatgttttatcctcttacattggtgccctagctaatgcaagttgatcatattggcgggctttgtgggggagggcgttccattctcttttaccgtctctccttcaatcctaaagacgtggatatatagttgagtgctgctcggctgttagggtttgtttttgaacggttcggttgtaacttatttgttggtccagtggtggttaatcacacttagcggtgaccggtccggtgttagccttctcccaagttctgtgtaggtacttgatatcggtgcgtagaggtagattatttttaggaaaaagtacgaattacctcccccgaactatcgcggttgtccgaattaccctcctgaaccacaaaaccggacattcttcaccccaactatgcaaaccggacgaattacccccctcaacccaatccgcggtggttttggtctacgtggcgtacgcgtggcagtctagtcagcattttagttattaaaaaaatgtggggcccacctgtcatactcatattcctctctcttctctctctcactcttcctctctctcttctctcactctctttctcactcaggcgctcggcagcacgggggacagggagcgacggcggtggtggggtgcggcgaaggaggcgaggcgaggcgacgacggcgagccgcacgcgggcgcggggtcgaggcgacgacggcgacgggcgaaggacgacggcgcgcggtgcgggcgggactcgaggggagatggcggcggcggcgggggatgaggcggcgaggtgcggcggaggagacgaggcgaggcggcggtggcttacgcacgcggacggggatgggaggcggcggcgaggttggcggcatgcacggcgcggcggggcggggcgcaaggaggcgacgcgacggcggcagcacgcgggcacgccgcacgcgggtgcggggtcgaggcgacgacggcgacgagcgacggacaacggcagtggcggaggaggaggaggagaggggtc

SEQ ID NO: 61055 - DNA, 6777 bp, Oryza sativa
ggagggagcgatcaccccccattaggagtacccattcacttatgcaagatggataatttggtcgttttctgtagtttccgcgaaggccttccatataaagtcaggcccggcaaagcctttgaaggcctgcattacttatgtaacacaatgtggactctgtttgtttgtctagtactgggcctcaattagctcttttggtgaattctctcgtcgttcttttctggacctaatcctcgttgagattctctgaatatgacatgttactagctccttccacacaaattaattccctgtgcatcacgttgttagtaggggctggtttggtgagaattttcagaatatgccatcgaatacgcaccgtttttaggatagcccactcaatttgtactactctcaaaacatgccatttggacgcgaattttcttcagtccgtgacactccatcacctgaagccgcgcggcgtcagttcctcttctctagcgacgtttacaagcgcgcatctgggcaccgccagcgagctcttgttcccctaccggcgaggtcctcctcccccacaccggcgaggtcctcctctcccataccggtgagcttcttcacgcacgacggcgacctcctcctcccccatgcccgcgagctctagatcggggagcggcgcgtggagacctcggcggccagatccccacggctacaagccgccgcccctcgtcatcctattgccgccgcgcccgagcggccgtcaacggtggggctcgatggcaatggctggtggggcgaacgaatggtgaacggaattgctgcgccgacacgaagtgacggtggaaggacgggagtgtcacggacggtagaaaatttgcgtccaaatggcatgttctgaaagtagtacgaatcgagtagcctatcttgaaaacggtgcatattcagtggcatattctggaaattctcctggtttggtttgaggcctaaaataggcttaccaatatttggcaatttcaatagtgtttaggatatatttggtttaaagccaaattttggcatgcctaagaaaatagaccatttcaatagtgaacttaggctattttggcttcaattcaaatacaactttacattaccaaaattagccatgccaaaacttactaaaatttggcattgacaaaatttggtaaggcctgtttaggccataaaccaaaccaaccctagatcatctctgttggttttgtctctggcagtgaatggatagctcaagtgctgagaggtgtgaaaatggatcgaagaagagttccctttgtatgactgaaaaccgtttgagttcagagaaactattttaaagtcttgagcgaacatcttttctttatttgcattgtcattcaaatgattaaaaaaatacttcataaacgttcaataaagtagattaatactccctccgtattttaatatatgacgccgttgattttttaaccaacgtttgaccactcgtcttatttaaaatttttatgcaaatataaaaatacttatgtcatgcttaaagaacattttgatgataaatcaagtcacaataaaataaattataattacataaattttttgaatgagacgaaaggtcaaacgtttgttaaaaggcaacggcgtcatatattaaaatacggagggagtatgtgataaatctgtctccagggagttggatgactgatgagatcgcacttactgttctctctccttctctctaggttggcttgaattcaagatctgtactattaattctcaaattacgcatggttctttgattgttattctttagatcattccagaatcgtgcctgatcaacaacgaagaaattccgattcacagataactgaatcgatgcatggcaggcagagctctcatctaggatcgcaaccaattgtagcgatcctgatagggatgtgtttcaacggatacaagataaatgtacggactttccgtaaaaacttacagccacttattccatacgatctgagccgcgtattctcgatccgatggtctgcgttgtcccgaaagaagattgcgatccacttggggtgccctttaacggagtacacgtaaatagtaaggtcttttcgttaaaaattaattcaccgcatgatctgaaccgcgaattgccgatctgacggttctcgttggtaccatgggatcactttgaacgactcactaaatagaagggccttttatgaaaaaacgcacgctctgccgccgccgtcatctccgacgctcctccgtggcggccggcggccggcggccaccggcgctgctcgtcgctgccccttcccatggccacgcgaggagagcaccaagctaactatgggtggtcgccgcggcagcatccttttctaatgaaagcgacctcgcccgctctggcgcggcagcgtggagcggcggttgctcgcggcgtgtttgacgaaatgccgcgccgggacgacgacgccatggccggggcatccacctctgggaccgcgcgacgcgacgagtcttctcgcgtctgcagcggaaactccgtggtctccgcatgattcgtgtcttcgtgagtcgtgacacgggaggggaggcggcatggacttcttcaggccggcgccagcgcacatgtaagaaccgaacgattcgctcatcgcttttgtcatcatctaaccaacgatcgatgaaaagcaatgtttatcctgatggcgctgaaacggacaatgttgccatcagatcatgcttgatttctttttaatttttatttatcgacagcgtgattcatgcagcgtgtgcgaagtacaccagatctcagcaaacttttgtcaaactcaaacacgacgccttgttccaggggtgtcaatataaatagcaaaaaattgggggaccgtaccagcaaaaatctcagattgcgttgagctgaagctgttcgtgtgactcttctacaccttccaggctatccggaatcgggagggtttcccaataggaaagcaactcaggactcaggagcggcgtctgagaggtttcagagatggagaaccagttccaggtgagatctctgtaccctaatccttttctcctgctcttgtttgtgtcctgaccgacctgggatgccgaggacatgttgcgccaagaaaagcttcctttctttcccgggcatgtttcgtctaggttttcttgatcttgtttagggttcgtgttgaataggcggaagttgtacatgcgaaattggaggcggtattatgggattgcgaatctcctccggaaaattgatttagctgctttggatgattggctttgggggtgaaactgtgcttgtaaaatctcagatcagattaggcggtcaattattcgatttgctggtgggtttggtactcgagagcaccccaaagttgggagctttggtatatgtagcatggaacttgctatccagtcctcaacatggtgttctagtcctgtttgagaataatctaaaggttggagttaaacagtacgggatatctgatattttaaatggtacaacatagagtttagaggtccttatttattgaagaaatgtttccactatcaccatcatgtctagatcacccccacttcaataccgttgctctgttgatactagaactctagaagtattgaggccccttaaaggcttcaagcttgctgtcacttggttgacctgatgcagtcttattatataactaattacttcatttataatggtttttccattttttttgcatccacttgctttggagcatttgttgggaggttcttttcctaaggatatctgtgtcctgtcaaccagtcctggagcattactagaattgcatggatttcatcacttctgtttgtttttgcattccttagtcttatgaatgagatgacctgatacaacgtaaattatgttagatgtttaaactagacctcagatagtgggttatacctgtttctacttgttctgaagtatgttgtccattgctaatttaggatggcaaggaggaggtcatcgaagcttggtacatggatgacagtgaagaggaccagaggcttcctcatcatcgtgagcccaaagaattcattcctcttagcaaactttcaggtttgtgcatctattgctcaaacaatatgtttagcttttgtaactaactcttagtagaactagtgccaaattgccaaaaaacttgccagatgttaatgtggtgcacaattgatacaccagagttaggaatattaagctggcgcctgaatgctgatgactgggagaatgatgagaacctcaagaaaatccgtgaggccaggggatactcttacatggtttgcatttcagaacttgttgtgagtttccattttttttgttcgcaaggttaatatgcttttccttgtgcaggatatttgtgatgtgtgtccagaaaagctgccaaactatgaggctaagctgaaaaatttctttgaagaacacttgcatactgatgaagagatacgctattgtcttgagggaagtggtatgcatctttattatactagttgagcacttgataactagtaataacttgcttccagcaataatcatggtggcatgttttgtggttgtcacatacttctttttctcatgctcctctaggatacttcgatgtcagggaccaaaatgatcagtggatccgtgtagcagtgaagaaagggggcatgattgttttgcctgcgggaatgtatcaccgcttcacattggacagtgacaactacatcaaggtatcttttgctttgttcctttgttcccacaaatagttatgttataagcatcaaactgactttgacgtgaacttatgcgttttaagtatattggtgaacagcggtcaccatttttctgtcatttacttaagtaatctgttcatttcctaaacctatgttccatttctatgctcttatcaaataaggaacatcagtccaatatggttttttccttactatgcttctgcaggcaatgcggctctttgtgggagagcctgtctggacgccgtacaaccgtccccatgaccatctgccagctaggtatctgttctttctgttccttgttttcctctttatctctggcttatttttccggttattgttgactcagtggaggttttgcataatttcagaaaggagtatgtcgaaaaaattatcaacaggggtggaactcaagctgtcgaagctcgttaaaggcatatcaagatgtgcttcctagttcggtgttctgttacactctacagatactgaataaactgtgctatcagctgttgcaatgggctcctaccgacatcttacatcatttggcagtattttgcacaaacccgcttaaaatctccctgaaaatacgcacgtcaccatgtcagagtgtttatatacaataatgacacttcagtccacagtcagcaagggactaatgacaatcattgtacttgtggtgtgtgtgatgaaaccacaatgatcaaaccgagtgtctgaatctctgaattgttttttttagcacaatgattgtgtaccaaaccctctgttgctgtgtgcggtggctggctcacctgatggcctttgtgctactcctgtcgtcttcaaagtatctgacggtgctgaccaaaatctttgaaatgatagtgctaatgctgttgattaccgaaaagttggggcacattgatggcagataacctagtactgtgggtttctatggaccagagaactgcaaggaagattgtattgtatgctagtgagattgaacacgttcatgtgtacttttggttgccacttgcccagttgcgagtccggccaacggtggaacaactattttcaggtcagagcagaacgcgctccgatggatcatcaattcatcattccactttttttttgtgaggcagcaaattttgcttgtgtgtgtagtgcgaaagcctcacactagtatatcaaccaatgagtagcaaatgaaaatatcttggacagctagttttcgattggttgcagaatttggggtttcaacaacttgtttctattctttattttggtttaatactccctcattccctaaatgtttgacaccgttgacttttttaaatatgtttgaccgttcgttttattcaaaaacttttgtgatatgtgtaaaactatatgtatacataaaaatatatttaacaataaatcaaatgatagaaaaagaattaacaattacttaaattttttgagtaagacgaacggtcaaacatttttaaaaaagtcaacggcgttgggatggaggtagtaccatataactattgggtaagacctgttatagtttcggaaaaccattacactcaatttaaattcaaactttttatatcgtgtctggtagaatcatttttttttcaccaatgtttgaattcaaatattcctgtttgatttgaatgtttacccaataaactccggtaaagaacaaaaacagcacgtgagtcccacgtgagattgaaaaggaattcagataagctaagaaaaaacccagagagaaaaaaagaacaaacctttttttttctcctgacccctgcaatgaatatcatctagccggacgagatcgtgtgtgccaatcaccgagcgcggcaaacaaattctgtgacccacacgcaaaagcgtcgtcgaggccggatgagattcggatcagaaaaaagaaaaagaaaaaaaaagaaaaaaaaatggcacgagccgtcgatgtcagctatcgattccggcatcccacttgcggccgtgccggcgaacctcagccacactcccaggcttcgccttccggaagct

SEQ ID NO: 61056 - DNA, 843 bp, Oryza sativa
actagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttttcaatgcacaaaactgatcactactttttctaattatatgtttaaaaaagtattaaaattcatatataaaagtgttttcatgactattctactactaatagtcttttattgtgttaaatcctattattttttgcattcattaatcatctaaagattttgataatacatgacgacatatatttgacaacagagaggtaatacaaatcagttaaacaaaaaaaaaagtttaaaagtattaaagtaataatgtctaactctgggggaaaaacggattggattcagatagatagtggtcataccatatcctaaaaacatatttttaagagttaattttagaaaactgcaactttaatgacaaaa

SEQ ID NO: 61057 - DNA, 38781 bp, Oryza sativa
tcgcctccactcccccactccaagcccacctccacgccaagaacgttcacgcaccacctcgtcgacctcctccactcgccgctctacctcccgcgccgcctcaccatctcggacatcgcggtgcaccggtggtcgaagcgcaccgcggtggcctccgcgctcctctccccactcctccttgccgccatcaccgcgcgtcaccacaacaaccaccctccagtcctcctcaccatctcgctcgctggcgtcctcctcgccgccgccgccgcggccaccacggacgccgcctccccacccaagagccgctcatcccgactcccagcgctctggtcgtacgtgctcgcacgcgagctcgtctccctgctggtctcactactagaaaaataatttatcgccacgaaaaaaaatagtagcatcaatgctaaaattgtggcaatagatacacgttgctacaatcttaaaatcgttgctagccgtggtaataaatagcatggtaataggttattgcaacgatttttatttagttgtaataaaatttgatattgccataaaatggatgtggcaaaaaaaatatatattgcaacacgtcacatggttgcaataaataactattgctaccactccatgtgtggcattagttatacgtagcaaattaaatgttttcatattaatttatcatcctaattattttcttttgatatcttgtcatgtccaggatccgaacccaagatctctccctcacgcgcgctctctatgaccaactcacctacgcatcaattttgtttaaaaatgcatacaattccatttgagactacctaactaagatttgaatcatgaatttgagtatttaaaatatttcaaatgaaaattttaagtcgtagatctcatcgagagctataaatttcatataaaatttgtcctaatccgtgtccatatgaaaagaataagtcaaattacgagatgataaattttttattgcaacgaatttattgatcatggcaatagaaaatagtgaaaagtaccatgtactatgcaaattgccacaaaaattaaatgtgtggcgatagaacatgttttttgcaatagtaatgttttttgtggcgatagctcatttcctattgcaacaaaaatactgaataaaataatgattgtaaatcgttgcaacaaagtatagttatttgccacagaaaaaatatcgttgcgatagtataatatattgccacgaattgtttttcgttgtaataaattggtggcgatagctcaattctcttgtagtgtctccatcggcgtggcggccggcgggctgggcgcgacggtgctcgcgtgggggaactcgcgtcccacgctaccgccacgccgcctcggtgtcccgcgccgccacatcccacgccgcagccgctgccgcctccgcatcccacgctgtcgccgccgccgcctcggtgtcccgcaccgccgcctgccgtgctcgccgagagagggggagagagaggggaaggagagagagatagagtatatgacaggtgggtcccaccatcttttaaaaaagaaaatgttgactgggatgccacgcgtacgccacgtaggataaaactactctggattgggtcgaggggggtaattcgtctggtattaaaagtttagggtgaatcatgtctagttttcgggttcgggggggggggattcggtcgactgcgatagttcggggggtaattcgtactttttccaaacgcagttgtggacttgtggtttgtggctttgtgctcacccatggaagacgggatacgggcgaatatcacttttactctgtgtgaaaggttgatgccgatgtgtccggccatataaacttacgctctgcggtgaaactaaagaaggtggcgatggacagctatgtgcagtctgctgtaaaaactagaaaacttttcaaagaaacagctctctatatagtccataaaaataatatggcatttcatagctcactgaaaatggtgaaagaatcaagagtttttgcatgaaaaacgatcatggcacaatatttctgagattcgcatgtggaattgtgaggatgttcggccctaatatccccccggcccgattatggtgtttagtgttcacgtagagaaaagtccacttgtcatccctcatctttctatcaagtttaattgacatccccaaactataatactagaaatcctcatttccaacttataaaatcgggttaaactatggccctgatatttagaagtattaaacgtagattactgacaaaacccattccataacccctaggctattttgcgagacgaatctaacgaggtatattaatccatgatttgctacagtgatgctacagtaatcagtcgctaatcgtggattaatatacatcattagattcgtctcgcaaaatagcctaggggttatggaatcggttttgtcggtaatctacgtttaatactcctaaataacaagattctagagggctatttaatagcttagaggatccaaacaaggcctatgttctctggcagtactcataaaaaaccatgtgggtggcattactccgtcaaggtgaccagcgacgtccgtggccacgtgcacacttcaattgttgtgccatgtcacatcatgcgtgcgtgatgcagagcggtcccgaccgtcgccattcccgccttccttcccatgagcgcacgatcaagctcgacctcatgggggcgaactatcactgcaccacctcctccatagccagcgccttgctcgagctctttcatcttccaccacgatgaagatccggaatagccccgccaccaccgggggtagaagtttggccgctccctgatgaatgagaggtgggcgacttcaggaacgtcagggagggcatatccgacggtggtaggtggtcctcccgtccctaccgccagccgatggctagaagggtataaccgaaggtagcaccggtgtggcaggaccacccaaggcagatggcggggatgcgaaagggattgcgggggtagacatcagtataggaagggataccaagggcacattcgatggtgtgctggaggaggcgacgacttcgctagcgagggcagggaggacttggatggggtgggtagtggcggcaccaaggtgggatctaggtgcaacttgccggcatggagttgacaaggcgaagagaagggaggagaggagtagaggaagaaggtgaggtgggcatttacatatggccccacatgtttttttagttttctatttatttttttaatatgatgccacgtcaactagaaccatccatacacacgattttgctaagatgagatgaaaggtgaagttttgtcgtattacggtttaaaggatgcaaattaaactttacgtaaagtgggcttatttctcacgtttattccgtgcaacccattcggcccaacttccacttgctcgtgccggacggccactgtgcctcactgccctgtgcttgtgcccgtctggttggtgtgtagtgctatgctcccagcctcccacggtcccaccatatgctcgcagttttcttccaacaactgatggcatcgggtgcggcgggtggcatgcagtgcatgggaacgcatgcccacggtgttttcagttttctcttcgtgtgtttgtgtactccgctctgccggcgaaaacaaacatccggatgtgttcggcgtcccatcactgctcggtcggggtcaagcagggcaggccgccacgatcgcgggcgtacgcgacacggcccgacggtcaggccgactcaccggccacgcacaggcacgcccggtccagccccatgccgcgcccatgtgccgtcgtctgactcggccaggcgcgcagtccggaagctgcgccgagctccacaaatccaatgatcatgataccgtccgcgatggcggcggcgtggtctcgtactctcgtgactctctcacggcttgtggttttacgtgtgtttagtataacacgccgccgtccacacggcgtgactcccttcctgtcaacgcggtcagcggggactgggagacggttaactagcggtggtggcgcagccgctcacgggttcggagaagaaaagtttgagaggaagtaaaaacaaggagaacgtcgttaaattgccaaaggtactacctatatatttgtcgataaattttcttctaaaaatttgacagatataattatagtacaatcgtagtataattacactgtaacttgtatgtaattacactgtaacttgcatgtaactacagtgtaacttgtatataagtttcacgtaattttgaatcgttagatctattacaaaatttgttctggtgaggaagaaaaaaaatcacatcatacacatatgtgaaagaatttgttctcacaacctccattttaccgaaataaatgttatggagagatttttgaaagttacatacatgttacattatagttacagtgtaattacactacgattatactataattacatctgtcaaatttttggtggaaaatttgtcgacaaatatatagcatattcgattccaaatggcctcaaaacttctggctggattgggctcaggcccaggacggtctattcgattccaaacgggcctccacgcacgcttaccttaccttgatcagatatcgttagaccgatatatattactcacaccacagattcgtctctcattctcttgtagagacaggaatacttcttacatctcccagtcccaagtaatacgctgtactacacgtaataaaacaacagcataatgtctagctgtttaagaaaaaaacactcaaatcacaactggactaattgcccgacacacggaactaaaatctcagagctagcggcaagcaacaagtgacaacctgttcttgctcagcattgggcccttttgcccttacctgaagaatttcgagcaggacaatctgccccaacctgattcctttgcctgccccactgatgagacatgaacaagcggggggtgtctacggacaaacttgctgaaatcttggcttgcatctctcttctttacggacaaaaagttatcaaaggacagcatacttggatacataggccgttgggaacttaatagaatatcatgattcatattctcttctcttatcatttgcgattgagttgcggttgcaggagcagagaagattccaattgctccggttgctttgttcgtatgcaatcctaggggccaagacccaagagtggattcatgtaccagtgatgcaaaaagaagaaaaagaaaacaaaaggggctatgtttctttggaaccgccagtgttggatccatctaatcctgaattcctcactgatgttgagatctgaacgccgtattggcttcatccgcagatgacaaaattagcaaccagtttaaatgctcttggtgggaagaccgttcgggatgttatggatgtttgaacgcaacctgccatgttggaaggtttgcctgatcattgcctatgtcgatcaagaaaataaaattgtaagagcaagtataatagtaggttataagccggctaaatgctgaggtggaggagagaagagaggagagagaggagaagcgggctgtaaacttacagacggtttggacacaagaaccaaaaaactcagtgagagagacaagtggaccatgtattaattataaagagcaaactattatatagttaggttgagagaaggctacaaagaaccttatagccaacatatcggctgtattattaaccttgctataatgctaattctagcatttgggattttggtatgctcttgatgactcctttaccaaatggcatctcacacatcgatccacacgaccttcctgccttcctgactagaagcgttacatgaaatcattttgtccggttagaccaatgccaacttgtctaggtccaaatcatgcatccacttgacaaaacccctgatttgtaggcagtaggcacaatgagtatattcacctccccacatttctagcatctggccgtcatggctttggactaaacaaaccggcgctctttcctgggaaatcacccgcggccgcggcgcatgtggttgcatgcggccaaaattcggcataaagctcgtgctgttcttgtgcaagtagccaagtactcctcccaacagtatacactatacagggccatgtggaaggtagcctccacacaccatggtaaaatctccaaccaaccaaccacacagttcggttaagttcatgctcttggagctttgcattggacacgacaaaagaaattgaacggtatttgtagcagacgagagccagtgatttaattttgaagcaactaatttacaatatctactagtctaggtagacgatcatcacgattcagggcagttaagagcttctcttgtaaaggtgacatctgtagattatgtgtacaccgcgccgtacgcacatgtaacctgtgattaaagaagatgtggtacccagggctgaaattataagcaagaattttcaatatgtctggccgtgctgccgtcagttaattgaagcttcgtgtcaacttcagcaggaaattagatgcatggacggtctgtgcgatattcgcttgagttttcaatgttgcgtgatttagcatgggagaatagctactttagtccctaaagtttttctgtaggatcagtttagtccctaaccttttaaatggtccaaagaaattcttaaactttgtcataaggtctagaattgtccttgggtccaccaaaattattatatggatatgtcatgtcatcattcatgcaaaatctatgatgaattgtccaatttacccttacgtatatcgtagaaaaataaatataagggtgaattagacataaccataggaaaaaatacttatcctttttttcacccttttgagatatattttgctcttacattttaccttttgttttttattttcctatgatatatgtaaggtaaattggacaaatcatatagattttgcataggaatgtgacatggcatatccatgtggcgattttggtgagaccaaggactatataacccacatgacaaaattaaaggacttgtttggataatatgaaagattaaggactaaaatgacccaggaacgaaactatagggaccatattagctattctcccatttagcattgttgcaggtgttgcacatcaacagatagccggttttcaaatggaaaatcgatgtggcaggcttttcggctacatgtatggacaaatcttgttgcccgtcgttgttgattttacttagaaaatgatacgtttctgttctttctgagattttgttttcattgattccagctttatcttgttttgtgctagtgtaagaaaatttttaataggtttaaatgtaaacgccgggcttgaatggagcaagctcgggctggggcaatatattacatgcatcatcacgcgtagattatcccatgcgagcgatgacccggctccggtggaccagttttttcaggcggcgtcacttacggtccgcctggaatcaaatatgggcctcgtacagaaaaaaaaatatttctgtagtagtgccaataagaagcctaatacgtaataggcaatggctttgcttttactcatctttcttcagaacatatataaggtaacaaattcgtttaatcatatggaagacacgcccgcatagacgcctacgatactacgcacatgaaaagcaaattttattggcactgattttccaacttatgcatttattctgtttgtatactcccttcgtttttaaaataaataacactgttgacttttagatatatgtttgatcatcttgtttaaaaaaattatgcaaatgcataagataaaaagaatatccttaaagtactttcaggacaaaataactcaaaaaaactaataatgtaaaacttttaaataaaacgaatcgtcaaatgtgtgttcaaaagttaatgcattattaatttaagttgtggtttccattagtactccatcaaaatttattcgtttttaaattcatatttcatggatcatggtaaaccacaagaatacatgtagctaaccttgctttataattttgatggcaaagaaagcataactcaactggttaagttacttgtggtggaaccaatccatctagattttaagttctggacttgatatgagtgcttatatttatggctaattattcttgcagtggtaagcgtcgtattcatcgatagcgagacatccgtggtggcttcgtcaatctcaaaatatattgatctagtctttcagaggtgttcatagaggtagggtatgtgtggacgtttataagagaaagtgcgcgcgttgcgagcatgtgtgtttccaacaaaaatttatgcttgataacacatattatatcgattagtgtgaaagtgttttaatggcctaatatgcatcatgggttcacaaatataaacaggttcaagccaattaatgttcatgttggtccccatgatgaattgtatcttggtcccaagcaattactaatctgtacaagctgattattgccaagtttatgaccataataacatgtttgcaacatggtcgtttttttatgccacatttctcttttgctacgaagtgaaccaatcggtgccatgtttagtggactcaaggctccataaagtgatataatcctgccctagtcatggatccacggttccaccgatgcatcatcattttttagacacaatttgcactgaaagaccatgatccaacttcatctgtgaaaacctttaaacaaagaaccaataggatcaaccaaaaagataaatcacttttgacaaatccactctaattaattaattaatttcactgtccttgtaaagacgagagatagtataactcgatgagatgggttatggccgggtacatgggctttcattccaccaaccagttttagtgggcatgacagggcgatgatacagacacaatcttttcttagctgtccctgtatccaacatggcacaggattgaagattggatagaactactttagggctgatttatatgctgtttgtccagagtgtgctcgcttggcaagcacctaacctaagtttaggttccaaatacttaattaaagcttgacctaagaagaacccctcaatcgaattaatacaagaattaatggtatgaatttcatggaaaaatagttgttggggcacttcttttcatatttatcatgtcacatagcaacaatggtgccaaatgtcctccttcaaacaattgataccaaaggtcatcctcttaatttactctatgttcttacatcaatttttttttaattctagatgacacctcatttagtcccattgacactagttgcctaccttggggcttgccgaacaccccatagcatcgaagcacccccaacagaattgaggccagccagacgaccgagcaaagctccctcaccgttcaatcgctgttggtttgcatcatgccggtcggcctgtccagctgcacgctcacgtacgggcacttgttcccattggtccaacgttacgatggtcgatgatggctacattgcccccgcgatatgtcgagcagaggcgtgcagcgcgtcgcagattgagacgtgcggacgaatctgtggcgcgccgcgcgcttacgtgcacgagtgtacggcacggggcggcggccctgctccccgttactgtgcatctgtaaccggtacgatcgagctactcaccgtgctggcagcatgcgtacagcgtaccatatccctcccatccccgggcggctcgtggatcagcagcgtttccgtggcctcattgaccctgcatgcatcatgggctctctgatggcttaagccgtactgcttctactactactactaccacttggtgtcacggtattgggcatgcttaagtattggtaatgacgatgacgaccaccattggatccagttttttttttctttttttgaatgtttttggaaccggggcggaacgatcgatctggatctcatgcctgattgaccggtctttgtatctccatgtgcgagcaacggtcctgctggtggcgcgctcagccgtacgtggaatctaagatatggagcacagtacaaatttgcgtggtttcagggtgcggcgttgcgtgcgcggtgcgcccacacttgagtctcgaccgcgaagggcacatgccaccgatgcaggcactcgctttttggcccgtatggccgtatcagttttaccctttgacgcaacggcaatagaacttttactacgagaaatacgcaagtctgcaatgtagattactaccacggaaatgcactggcaaataggagtacgatgtgtaactgttttttgaggcaaagtggtggctgcaaatctgcaatgctcgagtaaatcggtaaagcaaagcgagtaaaaaaaaactagtactgtgcatattgtgggcctcctttcgcctttgggtgaggatccctatgtgcaaattgacagaggacctgacactgtcagtgagggcacctgtctttctctctttctctgttcggcggaagtttttttttcactttctttccacgcgcgctgccgaactcgtgactgccgttctctctcgtcgtatcttcactcaatggcaggtaggccccactgtaggtggacctacatgtcatgcacgtctagagtgagaggcgagtgaatcacccccctgtcatgccctgtccttcaaggttcccgtgtgcaacggcctgtacagccgggcatcgttagatttctccacgggtgacttgacttgtgcggcgggacctgcaaaccgggggcccacatgtcagctgcagcgctggcccctgggtgggcctcggggttgcagcgctggccccgtgcttttggccgttaccgttacctcgaacgcgccccgaggaggagcgcctttcggccgcgtccccacctctacctttccaggggcacgcggttgaagcctttgctcttcgtcgatgacttgtgggcccggaagctataaggccccacgttgtcagttcgatgccgctctacgggctagtgggcaatgcgtatatgaaaagacgagctttttccttcgggctccggtccgaccgcgattcgactcgaccagcccacccacccaccggccggcgcatactgtagtcgcacggtcgtttcgccgtccaaactcccggatgtacccttggcctattcttttcttgtactagtgcgagggtttcctaaaccaccgggccggagttactgagccccggcggtaagcacggtaaccgcggtaaccgtaaaaaaccgtatgaagccgtgtaaaatttattaaaaatttaaattatttttaaatttatttgaatttaaggaggttaccgcggtatttatattaccgtacccccgcggtaagcccggtaaccgcgcagagtcgaaccatgactagtgtaccggtgaggacaaatgcgctgatgagcctctcctaagtcctaatcgacaactctcctaattactctgcatttttcgtgctggtactaccacagagtcatacagacacgtagtgactattggcaaagcattggcaaagcataatgagcctgatgatcatgttaccgacggtaagtcgaaccatgactattgtaccggtgaggacaaatgaaatcgacaactctcctaattactctgcatttttcgtgctggtactatcacagagtcatacagacacatagtgaccattggcaaagtataatgagcctgatgatcatttagggggaaaaatggacatttttaatctgaaaatgtttcttactgaaccagctgctactactggacatggcattggatccgtgattagtggaggtactgctgcgactgaaaggtgctacagttcaatagttgatgctgaacagtcaccgctgggtacttccttttaggtggaaattagcaagagcaagctccgcgtgtgtggtacatctgttgatagctgtacatattttaagtaattcgagatttaaagttgtaaatgctaagtttctttaatgtgagaacatgaaaacaaatagaaataagacaataatacacatgcaaaataaatgactagtaaacatagaaaaaaataattataagaatgatcgtttggataaccgacaaggaaaaaaatgtacgagatgttaataattgagtcgagatttgaaaagatagacgtccctctaaactttttttaagcaaaattataagcgtgttgaggatcgaatatggaaccttaaattgaaaccatgtatctcttgtcactgcactatgcactatcaagtgcatctctaaaaaaaaccacagagccaagaattgtttatttaatagatgcaccctaagcccaagcatacagaacatttgcgctttgcttcaaacccaaacaccgaatagaaaaaaaagagctcaagatggatgctagttttccttcgaatttccctaattcatgccaaaagaaaatttcccacgcttttcttgtgctccaaccctacaaaaccaccggatgaacagtagcacttcacataggattttgttcatacgtatttccttcattaaatttcctcctacaactaactcacccagagctacaactaattaagcattttcaaaggagaaaaatgcatcaagctagaagcatcgcacaagcctgagtttgaatcccattaaacacatattttcttattaatgattgaaaaaaaaagaacctgttcactttgatgaaaaaaaaaaccttaccaaaatttggcaagatgccaaaatttagtaacttgccaaaattttggcaggatttcttatatagttactaaaatttgacagcaaactaaggctgagtttgagagaggggagatagagaagattggggagatacgcaaaatgaggtaaatagagaagattggggagatacgcaaaatgaggtaagtcattagcgcataattaattgagtattaactattttaaatttcaaaaatggactaaaatgattttttaaagcaactttactatagaaatttttttgcaaaaaacgtaccgtttagtagtttaggaagcgtacgtgcggaaaacgagtcacaatctccccaatctctccccgatgtccttcgaaagaacgcaacctaaatgtagccactcttttttggcaactttaccaaaatttggtaaggttgaaaacggtatcaaagtgaacagggctgaagattatgagagtgccaagctataagttcgcaaacctttgtatcttgctttggaatcgactttcagagctataattggactggatgaggtaatcatgaaagaaaattgtgacacttaattatcaagatcggtagtactaatttagtattttccaatgagcattaccatcgatgatctaaaactccaaggtgccaagctatcctgattctcgtacaattagtccattgctttaattaagattcctgcttcataccaatcatgcaatctcacttaaaatactaacctccggataaataacaagaaccattattcaaactaagaaattttctcaatccaaatcatgctttgccaaccaatctctgttgaagcctcagacataaactatcacccggaagaattattgttaatcatgaggggcagcctccagcttagctgtcctggaacagtggttatgcatccaatccgaaacattatggagaccagcggtgtcagtctacacactgacaccacggatcaggattaaacaaaacctgttcaaacgcatcaaaaatacacatcgaaaagcatcgaaaacgagacgaaaaaaaaaagccctactggctccaacattatgaacagaatacggcgatacactaaaccatacagtacgtgatacgccacgggagcaggggggaaatgggggcccaacgcgtgaatcacaccacgctggatgcggggcccgctcctctggggtagccggggtaggcgcatgttgtaccgagcgatgctggagccctggcccgcgccgtatctccagtggagccgtgtggagcggggctggccgagttggccggccatggcaagaaggaagagcagtggatcgatcgccgagacacgagcagcggacggccgcgatcgcgtcgcgtgcagcgtgctctgctttgccgcgatcggcatcggcttgcgtggccccccgtcccgtgctgccgcgtgaggcggcgaccgtgcgggccggcggggcactacgctgttgctgccgcgctgcggttgccggccggccggggtccgtgtagtggtggcagcatcggatgaccataggcacagtaggcgataggaccgcctccttttgccgcacaaaggcgggaaatcctctatcttcttctgataagttcggtaaaaaaaaaaacttctggccagtttactaccacttcgctagctctggaatctcgctggagaagagggaggaggagtttcaccgaagaggaaatagtagtgggcacgtgggaaaatctcgatagacaacggtggaaatgccactaggattagatttggaacttgggaattaaaacagagggaatgttgtgcattaatatgatatgaaatcatttacttcccgtgtatttttgtcaataatggtatctgtagagttcatttttttatctggtatttccttgcacaaaatggagtttataaattataaggggagccaggccaaggtatgccttctagacatagtatttccttgtttcattgtttgtattttaccaaagtacaagtatagtagtacgaatattatgtacaactctgaaggctgaacttgttgcaagcagggcttttctgcctacagagctactacgtgtatttttcttgttaaatctacacacatgacacacctacaaagcaacattctgttgtaactgaaaacccctatctgtccaaatgcaaaagcctgagcctgctgctgtgaatgacagcaggatggacagaaaaaaaaaaggaacccaagcaacaacacaaggaggaaaccagaacatgcagacaacacaagcaactggctcctctcctctcctcctaccgttcagttagcagagttaacaatgtgattagctgcgtactggaggactactactagcggacacaaagccccactaaagtattcattcgttcacaattcacaagccgtcaagcactgtgccattatccccaataagtagtactccaccacgccttctctcttcttcctctcctctcctctcctccgcttcacctccgtttctttcatcgtctatctctttctccccaacacagcgggcgaaccaaatccgtcgtctcgccggggtccgggaccacctcgtcgcatgcgcgctgggtcgtagacttggccgccggcgatcgccggagttggggagcgcggcggcggcggttccgctctcgccggagcgaggggtgggtggaggatggcggcgggagggaaggggtgggtggagagggcgcggcgcggggtgaagacggcgtggttcatggtggccatggtggcgtcgctgctgatggcgtcggcgccggcgctggtggccgccggcgacgtggccgtcgcgctgtggctcgaggtgcggctcgggtgcctccgctgccacggcctgcgcggccacctcgagcgttacggcttccggagctcgctcgtggacataccgcttgtctccatcgctcgatccgtcgtcattacctgtaagcagcgactagctccccctcattgctgttctaatgcgctcgcaggatattggggaatctgttcgtatgagttggatttcttttcatcttctgagaatttttgtattggttatgtgtgttatttttttaaatattctaatttcattatattttgggatatgggatttccctcaagattctttatttttttcccttttcgtatggggatttgtccatctgaaagctacagttcttgctacgtccgtgcttgtcttcattcgtagacgaaaggatgaaaactttcgtgaaaaaaaccgtgtctatttctaaagctattaatctgatttcgtatctgttgcctgctattcttttcactttccgtatttgaattcagttaaatcccgtcatttgattcgctgaattagtaatagatttgctgaatctgttgcctactatttcccggcagtttgaagtgcgcgccaacaaatttccgcactcggatttggggagaaaaactacgagatgcgactaacagatccgatgtttgctcgtgcaggtgtatacctcatgtctgatgcttctgggctctcccatggcccgtaccttggaacagcaacttgctgttccctggcttctctgctcatcttgttgattaaggccagcgtttacagtccggcgcaggagattgggcctgagctctcgccgtcattggcggatcacaagctcagtctcaagaagctatcgggaatgccggtgcttttcctgtcctccttggtctttgctcttggccatgttgttgtcgcttacaggacaagctgcagggctcggcggaagctgcttatccatggcattgaccctgaatctgtatgacttacatccgtttgccttctaaatctcactaagtgatcaattgtagaaacagggccatgtatgctagtattttcttgcatccgttgtgcttttcttttgcaatgtttgatgttttcgtgggttgtgctgctttcagattctggcatacaagaatgcatatcctggatgctacaagactcctcgatctcccacaccatacagtggaaaattttattctaggagtgacagtgagacgaagagaaaatctgttgctcacgacgatagggatattccaatcagtttccttgcagacggtgatagcatgttcattgcttgccaggggatcactgtgcattacaaactttccgatccatcgagttgcatatcttcagctacagacacttttccagaaatccatcatgatgttatttcagcaagcatttctcctagaagacagagacatgatagcccaccatcagcctccactaatacccgtcgtcttttgaataggagcttcagccatcaataccatcagacatcgctatatgcaccattgttggtagagccagtgacctctccaactttgtcggatgacacccctgttcttagtgttgatgatggcagtgctgatgtatgtttgaaacctatgggatttgatcttgaggctggagaacaggggaaatttgctgttgttttggtgcatgggtttggaggtggggtgttctcatggagacacgttacaaatttgctttctcgtcaagtgggttgcactgtgctggccttcgatcgccctggatgggggttaacatctcgacctcgcagaaaggattgggaagacaaaaatctaccaaatccatatgagcttggatctcaggtgattcttcttaccatatactagattgcgcactgcccaatagcagcaagtgcttgcagcacttgccctaatgttctttgcactagctactagatatgttgcaatatcccatactcattccatggaatttgttataagcatgactgactgaatgtaaatatgttactgcatgtgttttctcttagaactatacttatctttgggattatgtcttctatgtaccataattctgtgtgacaacagcttttccattacaaatagttgagtacaatcttctgaagttcttttttttccttaggtacatcctatcttacaaatattcatctaagggaatgctcttctactgtaacaactattaatcttttaattaatattactatatccagttatgtttgcaacatattttccggcagcattaacgctatatttcttcgctgtacttggaaaactcagaactttaagaacaacgctttgtatgccttctgcaggttgatcttcttatttcattttgctcggacatgggcttacgctctgtggttttagttggtcatgatgatgggggcctgcttgccctaaaagctgcagaaaagttgcgagcatctggagattcaagaaaggtaactgccttgtgaccttctgttcatttttcttttgtgaactttagtagcttatcagactgtttgcttgatgaaagtctatccttctggtaataatcattttaaatgcctccttgttttttcttaggttgaagtgaagggagttgtgcttataggtgtaagcttatcaagagaagtcattcctgcatttgctcgtatactcctgcatacccctctaaggaaaaagcacatggtacggccactgttacgtactgaaatcactcaggtgatcaatagacgtgcatggtttgatgctaccaagttaacaacagatgttctgaacctctacaaggtacacacttttaataattttcattcccttcagtgtgttgtcaaaccattagtacgcaatctatctctggaagagtttggtcactaaaagcacatagggagcgttatatcatttgcaaataatctatttatcattccaccacatattgtctgaatgcaaggaaagtggaacttttcttgcatgttgttagttatttattgtcttcctgttccttgatgctaaattaaatgttttaacatgcatcctttcacttattctgtgaacatgaactacgaactgacttgaaatgggtttttacatttaggctccactatttgttgaaggctgggatgaagctctccatgaagtaggacgtctttctttctcgactgtcctatcatcaaaaagagcagcagatttactaagatcagtggaagacctccctgttctggttgtagcaggctctgaggatgctcttgtttcttcgaagtcaacgcaagtaatggcttcaaggcttgtaaattctgtaagtaatcttgagtccctttgcctcagtatagtgaatctgcttctgaagaggactcttgcatgatactctatattacttccctgttagggttactccatacattgtgccaatgagttcttgttattttgcagaggctggtaacgatatcaaattgtgggcatttgccacatgaggagtgtcccaaggcattgctttcggctctttctccattcatatcaggactggtgtcatcagatgattcattgcaaagattgtagcatactagttcttttcgttttgccttttgccctgtctttctgtcctctacactgagtagatctctctagttggtgtgagtttgtgtgagccaatgtagtgcagtagtggagcctgacccaaaatctcaagggttcctagagctcctctaattttttgccccatataatgatacctccgaatgatttcaattaagcaagttgaatctgtacagcacaggcttgctgtgttcagttcatgtctactccagctccagctgtcatatatcagctaactactgactactagtaatatgcccgtgctaaacgctacggtgcaactctatttgtctttaataatttttaaaattttcatgtttagcaaaaaaatattattatatgaactgtgcatttgagctttaattcaatttatatcatacatcaaatatgttgcaagtaaaatattagaataggatataccaatatatttgtgccccatgtcataatgcataataatatgatattaaagatatatgataatgcatatatctgtgccttaagatgtatgataacgtgacagatcaaaggcacttaggttgagtattgcatataagtatttatcatgggtattttagttgttaatgggccattacaggatttggaccatacacataagtttgacatctagcagtcctttactcctttatcatgactgaataggcaacataatagcaaattagcaatactggtttcttatgttaattatatttgctttttttatacgctttcatgttcataaatcaatattcatgtgattggtcagctctttaaattaatggagccctgaagcaaataaaatgtgtttgatctaaagcaaagaattacatgtgtttgatctaaagcaaaagaattacagaaatcaatagtgctacacaacgtcagaaaattggccgacttaatttatttatgtgagatctaaaccacaactggtgtgtgatgtgtctccttatataagaagacatggaaaacaaatataaaggaacattgctatgcatccaaccgtgccaaacaaatacatagtagttcaacaggaggtagagcacatttgtataggtcccagaaatcaactcaatcacaaacaatactgaataggcatcataacaacaaagtttcatcgaatttggttgtgcatttcacaagcaatactgaataggcccgaacgacattgtttactgaattttcttgtgtaattcacaagaaatgttattttattctaaagccaaaacacagtagtgataatactaaatcatggttccttctcggttgcttcatcggagacgtcgtcattgcagatcttcattgttatctcgatgggagaagaccagcgaggatcatacccttctcccaccttccttttttcaccgtatcctttttctaccttcttgcacgtgtagtcttccatggaactctcaacacgtcggcaaccatcacgtatgtattgaaacatcatcatgatggcattcgcgtggcccatgtaataattccccttgtttggtgtttgccctgacgaaggctgcaccttcgcatcatccttggagttcattgactccttaggtgtggcttgatgtggtgaaaaatccacatcatccatggatgccatgccttactacaatacagaagaagtaggagatcaataggtgcaaactaaagtatataataatttccaacacataagagatagtttggagaacgataccaagaaaaagattggtcaatccctcaaaagaaaatatggttggcacagtaatcagggcaatttttttttcttgatttgtaaaccggatgcaggcaattttaaacatcagattctacaacagtgcgaagattgacccacgaagtatacatttgcactatttgcaaggggtaatcattatggaagaaattacctataccaaatagaaatttagtagaatcagccaaaaatttcgttgattgtgcagcaaacaatagtagttgacatggtgtcctgtcagcctgaatttttcttcggcaatctgaattttcgtcctatagattaaatcatttgaaatgaaaggttaagtcaggttgctagatataagcaatcacatagaaaaattgacacaatagaattatctgaggtaggccatttcttccccacaattttacaatgaaagattgacgataaatgttaacaagatgtgaagtatctcatccaatgacaacaatgaaaccccccaaaaaaaaaaaatcctaccacacgaatgagattaacacatgaaatttagttgaaatgcaaaacaggctttgaattagagttttgcatcacagatatccatgcacagtgaacaatgtttgataatgaacaatgggggtttagtcaacaaaggggattcctaaagccattatgcatctctatgaacagcggtggaggacggaaaaaaaatttaggtgtggccaataaactaccacacgcgagagttaacacagaacaagaattaagaaaaaaaaaattcaatgcacaatattgtacaatgtaacattatatcagcaagtcatagtaacaagcacttaatcacaagttcacaattcatcatccatttgcaaataagtgtaaatataaaggtaggtactcaaaaatacctcaagattcactgattcaagctttcagccgtacatcacatatataaactaatgaggatagatacatatgtagaatctgaaaaacaaatagcaaagattgattagtttgataagataaaaagcaatgagtgaaacaaaatgtacaagcatcctaaaaataaaatatttaattgcaatttcagtaataaatttgtacactttgaaattgcaatgttctgaaattgtcaaataaaaaaaagtacaacctctttgtgatgccagtgccttcccttttctctttctgtccattttctgctgatgggagattgggcgtgatggcctgatggctgctactacttctgcttgccttgcttgctgcttggtgctgctgcgccatccgccctgcccctgccctgcttggcgcctgtgctgcacgcctgcgcggctgcgccccgccacgcgaggaaggtctcggcagctaccaggcgaggaaggcgtcggcggcgacgagaatcggtggcggtgagacgacggatgcgatgacggcggagcggcggcagtcgagggcggcggcgacggcggtggcgcggggatcggtggcggagatgacggatgcgaagacggcggagcggcgacagtcgagggcggtggctccgcgtgagtcggggttggggaggggcggcggcgcgtgagagcgatagagagggggcgaagaggagcgcgcaatcgagggaggtgggaggtgggagcgatctcaatcgttgagatttcaccgagacaatctggaccgttgagtgatgaatgaaagaatgagtgaaagtatttgttgaactatagggtagatgactacacatttcgacggagcaaatttcggatgaaatctgaacagctgtggcgagttggtgttttaattctttaatttactgaagtcctactatctggtagtagttcatttaccgaaaataacatgcccgtcctttgtgttactgtgtatctctgagactctgacagcattgggctacagagaatgtgttttttaggaaaaaaatacggttggtaccgtaggagtatgtatttgtgccagttggcagcagtatctgttttctatctttggaagaacttgttgtttttgggtctataacttgtgttaaattgtcattgctctttttgatgttacattaccatgtgaagttgtcagcattaaacatttcatacatgagcatgatatacaatgatgttccacagatgcacagacaggccacctcaatttttttttaatatagaactgttttaattcagccaaattttgttcaaataaaaaggtttgatttttaacccccttttttttgaacttttcattcatttgcccctgtcaaatgtttatgattctcgcaatttgtaagatttgaatttaggatttttaaaaattcagccaaaatttgttaaaattttaatttatttaattaaatatttttaatcaaaattttccactactagtcacgtgcccatgcgttgcaacgggaaaaataactttttaagaaattttatgatttatcgttgataaacactcgattctataacgccttagcaaaagcaagtaatatatgattattatgttttctttctttttgcgttgttatcggttgaactccggtagagcctgaaaagatcatgttcctcataaaatatggcatgtactaagcaagccaagacatagtgcactgaaataactacagattagcacaaatcaactctttgcaatttagctctctcaatcttttccaatgtcttatagggaaatttccaatgtcttgtatggaaacaaaataaacacgatatttatgtatatacatatataaattacagtatcatattccaaatggtcagttgactgtcaagtagcacaaggaacaagaatggtaactttagagttccatcatccctaaataatacgtacattgcctgcagagagttcagaagtgagtccaggagggaaaattatttcccgcatcaactaattagctctcccagtaaagaaattcaacatatggatttaccctggagtaatttctaaacttagatacaaaaatgaatagaagggccagccattgctgatttgcaggggataaagatggagagtgaagaacatggcattttcatcagagttagaggatagtgattactctgtaccttcagggcttggctagctaagatgataaagctaatgttgatcgtgaaaagatttaacatattgatgagcccatgtaagtgatttttttttacctgtagtcaccaaaataaaggttactcaaactgcaaaaacaaaattagcatattttatgaataaaagaaatccacaagaagtaaatttcatatccaattgaaatagtatgaattatcaaaaatatgatgtagctatcttgattcttgactctccatattgatctccgaagagaatgaattttgccttatcaaatttaaattccatattgatatcagattgcccagtacagtaaagtggtcaacaagcagcagtcccaaatgcaatgttaatagaaggtcaggtcatattatccttgtaaaggcctttgaaatttcatggcaaaaaaaagccattgaaattgtcactatgcgaaggaatagcaacagatggtataagttcagtacagtgaaaaggaaaatgcagagcagaacattctctgactaataatgccaaaaggagccccatcccccgtccagttctgcagaatgtggactatcaataaccatttcttaactgctaaatgatcactatgttccaaaaaatatagtcagtactattcgatattcgatgtgtgcataatatagagtgaattatggcagatgacaattagaaaatagagtttactatgcaaaggttgatacctatctggttttcatttaattcaaaaccaagggaaatagatgatcatacctggtgttataatttcattgagaagctagaaaagcatttgaaccctgtacatgtatcaagagtttagattaactaatgtatcaagagtttagattaactaatgtatcaagagtttagattaactaaagacagtttccaggattatacatgaccactaaggttcattcttttagacgtgtggaagacaacttcacatccagccaaatgatcaagaatcatcagactgaaaggctgaaacagacatcgcaggagacatcacaaatggtgtttatgaagctgtatagttgattaattattagttcagaagtcagaacaattattagttcataatgtgaccatactaaaataattattagcctgtcagttctatcatcagttagaaaattatatgtgaatatacatgttggttctacagtaagagaaaaaccatccagaataatcctgattaaccagatactattgtcctttggagatgtttagacacgtgcaggcagttatgcgttgttcatagacatgaatactttagttattactcctattatctaactaaatgaattcttcagtgatactaccacataacataccactaacacagaatgcattaccaaaatgttgtttttggttattttcttttggttgaatctcgtctgatcaaatcaacggcggctgataggggagagatgaagcatagtactgatggtggataaaaaaaaggaatgatcttgtacctttcggtgaatcagatcgaagcggggcgacattgttctggcagcgctgaggagatcagcaaggcgagggacgaggcgtttcgtgctgatgctattccggcggcagagattggtggcggcggagaaggaggcggacgaggaagaggaagatattgggacggcgctgaggagatcagcttggtgggcgacgcagacccaggcgactccgggcgatggtgatctagcggcgcggattggggagagtgagccaagaggcaaaagcagcgagcatcggtctcctggcgaaatggaggagatcggcaaaatagccaacggcaagcgtcggtcacccgacggcgtagtcgtggttgctctggcggtgcagagcagatcaacgaagcagccgagtaattagggttgggtagagagagaagggggaggttggggtgatgcaggaggggacctgtacggctgtacctatagagggagacggtggcgtcgaggacgaaggcggaggcagaggcgacggatcgacctccgtggcggtcatgaccggcggaggtgtcggcggcctagacacacataaaattagacacttagcgcaaatgctaaatgaatagctcagcacaaaatagcaaggttatgactacgagaaatagtaatacttgtgaaaagcattataattctttcccagtggtttaaacaggcagaagaaaaatactttatgccatcacatgataattcccagtggtttaaacatgcatgcacattagtctcctgccaaatcctgctgaacatagtacacaaattcatctaatgggatgccatttgacagaaaatatctccccagcaatcagctcagcagaaaaatctgagtttgatttgctagtaaactgcacaacattgaatgaaaatacactatcgacttacttataacaactgtgcacttaaattacaatgtgccaatcagaagagttgtttgctgtctcacacaaaatcacaccatttcaattcagttttcaaaattactctgaaatatgcaaatggaagaaaccctttatcaatctctgagcaggagtcaggagcaaacaaacggacaggggcagaacatcaagactgaaatcgaaacatggtaaaagcatgaaaggcatacataaaccatttctttctccattttttctaatgtttagagaaagacagactcaccgtatcaatgccaaaaaaaattcagcagatgccaagtgcatgtccctgaactcccgcttgattcctcctggatctaggtttcctgggattgaaaagtggcatttacatctcgtgatcaacaatatacagtacctagttgggggctttgaactgctgacgggggagcagtagtcccggtgacctaggctagggatgaggcagcaatggccagttggggatctggcagcggcgacggtgacctagcagcggggattcggtggcgatgttgtgagttgtgcaggctgcgatggctggttggggattgggcagcggcgacggagatggtaacctagacctagcaaccggggattcgcagcagcgtggtgtggcgtgcgggcggcgatggccggtttgcaggtcggggatggtatggcgtgcggctattgcggcggcggcggttgacagaagtggtggggtaggaggggatacataccttcagatgaaggcgatcatgaccggcagaggtggcggcagtcgagggcggcgcgggtcgtcgcgacggcggcgaggaagcggctcctcggcggtgttgacgcggcgtgacctcctgctcccgcgtcggcggtcgagggcggcgcgggacgtgggactcggggcacggcgacggcagcgaggagacggcgcgggtcgcagcgtcggcggtcgagggcggcgcgggacgcgcgcgcgggacgcgcgcgcgtggcacggggctgctgaggaggcgatgcggcggcgaggtgagaaggtgaggaggcgaggagatgacgcagggaggagggcgaaggtggatgatcgatccgatgcgaggtggaggcgcgttggagagggcggcggcgatcgcggaggaggccggcgggcgtggctggcgaggaggcgatgcggcggcggggcgagcgtcgcccagggaggagggcgaaggacgcggcgtgggaggaggaggagtgggcgtggggaggagatcgattcaagagaggagcgagcgcgtgatggggaggagattgacaccattggatatggcaatcggatggttgagattacgcgtgtctgtcagatgcgtctgctatgtcaggaatcaagaccaccactacgaattttttaagtagtagagatatcgttccccaaaattgtttcctacttaatataatcggttatgcagcttggtatggtggtaaaatcatcatttccaaaaattcatttctctagaggcaaagatgctaaaactacctccgccccaaaattcgagttatatttcaggataggggagtaaaacattccgtcagtacgtaactgttctgttccaaccgaaggttgattccatgagttaaaatcacccaaatcaataagtgaaggtgagaataataatgaagcactggtacattctttggacttttccttcaaaaattagaaaagcgtaaaactgtacatgccagcagatcaacttgccaactaaaacaaaaacaggctaacatcacaacacgctataacaaaatcaaattcttacgcttctctacttacgaacaccggacgtaacccatcaatttcaccatctcttcatggtggaataactataccaatgatttccagttattccttagctaaccgttggactccggggtaaattctatctcccctttcttggaaatcaacagtaaacaaccaaaaaagaaaaagaaaaaaaaacacacaactcctttactagctcttgcctttcatcttctctgcatcccattcattactgacgagcacaagatgatcgccgtctctgatgagctccacctcgtcaacctcggcgccctccacggtgagaaccttggttggcgcgaagtcgaacttcttggcgccgagctcgaggagcatgtccagcgtctgaggcaggagcacgagcttcccggcggtgttccctttctcggggcagctgatcgtcaccctgatgacggcgttgcggctgccgctgctcgggttcggggagcccgtcgccgcgaggccacccctcgagagcgggtggtcggtctcccgctgcgcctgcgacgacgagatgaccccgaagagggagttctggaaggtgacccgcttcctccggagcttctcggggagaacccggctgggcaggtcggcgtcttcgtggatcatgttcttcatcatgggctcgctgttgaacctcccgatcagtgatgccgccgccgccgccggcgccaccctggtggtggtggagcttgggacgtgatggtggccactcgccgtcgccgccttgcgcgaccggaacaggagctggatgtcgtcgtggccctgctgctcggcgagggctctcggggtccagccgttgccgtcctgcttgtcgatgtcggctccgtgttccagcaagagctcggccatctggacgttgccgtcgcagacggcgcggtgcagggcggtggtcccgtcccggcgagccctgttcacgtcgcctccgtagtgaatgatgtcgttgagcagctcggtgtcgctctcctccacggcgatgcaagcgtataagcccgtgtcacccgacgacagatccgcgccgccttcgactaatagttgcacgacggcggcgtgcttctcacacagcgcttcccacagtggaacttttccttctgagtctggaaaatggaaaagaaaatcgtggcatgtcagatggtgtattgaacatctgtatataagactcatcactcatggagttaattacatcgacgcacaaaacttttgcgtcttcgcaaaaactcatggagcaaattctattaagtaaatcagtaagttctagatgttagattggtagaaaattcaacaggaattttgcaagcaagtttagcctcgtaagatttacaggtgacgtgaggccatgacatattgcagggtttggatataacatccagctgttcataccatttaactcttacagttaaattgtacactatatgctgtcaaaattttccagttttcggcatacctctggcatttggatcagctccatattctaatagaagcctgacgcattgctcgtttcctttggaagcagctatatgctgttaatcatgaacatttgaaagtggtaactttcttggtcagcataagtccatagaaaaataaacaacacagatacgtatagttgactaaactgaccagtgcggtatgcccgtcattatctgactcatttggatccataccacgcttaagaagttgatgcaacaaaaaatcatctcctctagttactgcaaaacagagtgtaattggcaaatccagatttccccgagctagcatactctctatctcctttacgacaccagccattacactgttctccttctgctctttaaggaactgcatcagaaaaaaaaagagtggatctcagtactgctcaaaatactgcacgacataaagcatgataaatgtcaatgaagcaaaaacaaaataaacagcccttatccagatcacaacagacaacagtgaacatcaagtctgatagtcgcagaacagtcgacatattttttagataatggcagaacagtcgacatgaataaacaatttctgtgttcaagataatctagtggctatatgagggaatactagtttaacttcacatattgttaaacaagatgatgcaggttccagggtggttcgatttaggagttactacagagctagtttcagtggtcaggttaccactctgaatatgaaaaatctttctacaaatgcaaacatatgcgataaatgttacagagaagagaccaacaaataaatggtagacctgaataaggttgttcattatgatagttccatccccaacattggattgaacaatgctgagaaaagctgtacgattcaaacgcaacaactggcacaaggatcttgttcgaactgtgaatagctgaggtctgtagcaaagaaccccaatttctccaacaacctctcctgacgtagccacttgtatcacctgcagaattccaagttatcatatttaggaccaattgatgcacgagttcacttggaattaagtctcaaagcaacagaagtcttgcctggtctgcaccattttgctgctctactaactcctgcaaaagtgactcgaatttcagaatgaccatttatataactaaaactgatatcagtactgatagctcaattactcctactttttcaactgcactctctgaagcttagtattatatcaacttggaaataacaaagtagttattaaagagtattcttaccacactaccagaaactaagatgtagaagtcagtgggtgcttcattctgcaaaatcacatcctccctaggtggaaaatattcagctttcatctccgaaacctcaaaaacgaaatcaagtaaaagaaccagataagcatattctgtaacagtacgcaactacaaaaacacagctacagaaagaactctatccttaccagttgaaaaatcagatcatttgagactccttgaaacaggtaaacattttgaaccagatggaagaacagatattgagaaatgctagatttaatagctttaggcagtgaatcaaggatctcttgttgttgaagaccttctgaatctgtcctgtattttaagctaatatgtgaaatcatctgatcttgcagccgaggtggtagctgatttcttactccaaagcttgttgctgcttggattgtatccctcttttagtacaaaacataacaaacactacttgttagaatcaaactttaaaagagcagttagatgcaagtatcaaccaaaggttgaacaaaaagaactcacatagtttcgagtacgactagtgccatggacaaccaaattggtcatgttaccgatcaaataagcggtcaaaccaaggttaaagagcatgtagaaaatgttgaagatcatctcccttgtattttctgcatgtagatccccatagcccacggtggtaagagtggtgattgaccaatagactgatgttacgtagcgaatccataagctccgttcatggaaatctgccatgtaattgccaatccacgtagaagttgggacggggtacctatcagcaagaagatagtagaagcatgccgcacagtgcacagcaaaaagtgtgacctgcaatatcaaaggatgagaaaatgggatgttccacaaaaatgttaaaacttcacaggaaaataacataaatacagtcacttacacaaatgagctttgcacatcgaacccagaagtaattgaagtgtctatccttctccaacctagaaaaagtgaaaagtgttaagtttactacacaaattgaaaaggcaaaaatggcagtggctctagcctaattaatactatgttttaaccgagttcagtcaggttcagattgaaatgttggaccccaaaacagaatgtatatcatagaattttctatatgtgcacgataaaaacatacctagaaaacagagagctgactctgcggagacgccacagacgaagcatgttgaaaaatccatatgacctaagctttgaaggtagtatcctgcgagcaaattctgatgggatggtggaggccacgtcaagaacaagccatgtggtactataacgccatgcgatcttctttggatcatcttcaagcatatagctcattttatccaaataagccacaaagaaggtcagaatgatgtcaaccgcgaagaatgcattcaccacattgtcggctgtagctagagcccccgtaggcttcggaatgaagccaaattcaaatggtgagacccacgcagagtagactacaagaactatgaggaaagtctcccagattctgcatagtattaacaattaaatgttagaattactcattcttctgatttcaatattacaaagtttctatttgcttttcatactagcaaaaacaccatgcttacaaaggaaaaaacaatatattcctgtaggaagaagtccatataccccctaaaccatgaatggaagatatttatattgtgaaatccatacactagcattatatgcataacatcataatataatataacttgcggccaaggaatgacgaaatacaaatatgtcatcttagtcattataagcatccaaatacacgaaaccactgttcaaaaatcgaaaccactgcaggggttgcaaactttagggagttagatgttcggttttaaagtttagggtattagatggactttcgttcaaagttccgtgatttcttattcctgtacaagtaatctctgtttattcaacggtactgtatatgtactggccgtaactcggtggcaagtggcaactagaagtaccacagaaactaccgtactacttactgtatactgtgtatacaagattatctccgaaagagtgatccgaagaaaaatggagattaatgtaatgcgattttatgatactatcaaataataaatggacaacagaactctcactagacaaaaaaatatattaattgaatgatagcacagaataacttcaaattgcagaagactgtcattgaggccgacaaaaaaggtaatctgaacaattcgtaaaaccaccaagtccataactaaaatacaaggttattaatcctcgtccgtccaacggcaaataattgcagtaaacaaatcagaaaaaaagttttccatgcgagttccgtgagagagctctttcgacaacgaagcattgcgtaaagaagcgcaaaacgggagtactagaaatccaggaacgtcagcatcaaaatcacgcttttcttgtcgttcctcaaggaaaagaaaatcgaataactaaataaagcactcacaagccatagaattagccatattaaaacggagataatgagtactataaaaagcaagaaatagacaaatcaattattcagtcgaggtcaaaccaggaacagtaaaaacaaaaacctctacttctcacttccgcgaaaacacattaaagacaatttgctgacaattgcggcagcaaagcagccattaaaacagagggagaaaaaacaaaatttcatgagcaacccatctatttcgtgacaacatataataactcattggaattaacaagaggcagaacgaaccaattcagtgccaactatgaatacaaaaataaagcacttctgcgctgaccatcaccaaaattaaagctgtaatgcagccagtatagcaggactgtacacaagagactgcgcaagaaaaaaaaaatctgaaacaaagcagcggcgagagttgtgatggcgatagggaagagagagacagagaaggttgcgaactaacctgtatcggcggtcgtagggggagatgatgaagcggcggagcttgatgcggcggttgctccgcgcgccgagcgacgggaggatggcgctggagatgctgtagtggctgccgtcccgcgacagctccctctcgagcgccgggtccccgccgccatggcccgccccccacggcccgcacgcgggcatcatcctgctgcgcccgtcccgcctcacctcgctggcctcgaacgcgtcgccggcgccgaccctccggttgcggccccacggcccgcacgccgccatccgagcggcgccccacctcgccattgcgctgcccctcggcgggcgcgcgtgcctcccctctctcgggtttaatggagcgcccacccccacaaggcccacaaatctggcggcctgcaagggaatcgcggggtgggaatctctcgccttgaatactagagagagaagttctcggtgattcggttttctggtaagtggaggagagccgacgcccgacggcggctgcggcggcggcgaagacgtgtcgcggaagaagagaagagaagagaggagaggtgagagcttcgatcgagcttggtcggggccacgcgcggctcggggctgcttttatggatgcgaggggagggggagagacctggggggtgggggcctctggggcggacggactgctgggcggcgacgaatcgggaggagagtctgaaggacggttttgcccctgcgggactggacgcgacgcggccgagccgcgaaccgggggtgacacgttttctggggaggacggcagaagtagtggggatgtcagatggctcggatccgccgggtcttgccgtaaccgtgccggtgcatgactctaagcagtacgaagggcaaatctggtaatcacctaaatgggaggcacctacccctacctgtcttacagaggatttgcctcatgaatatttattcgaggtttaagattaaaattagctgtctgggtttgtcttaaatcaaatattatttgatcatcaatttctatatgagtaaactcatactttaacatcatacgatttatatttttagatttaacatgagaaatatgattgtgatatataatttacattttgttggactatatggatttctagaagttaatggtcaaatacaaacgtaaaacaacatgtaatttgaaacgaagggactataatttgatcgaaacttctaaaattatagtcatcaataaatttaattttcaattgcttactttaaaagaaacaaaaattatatgcgtaaatttatcctggagagtattattgtactccctccatttcatcttataggtcgttttgtctcttttttagtcaaacttatttagatttgacaaagattatagaaaaaatatagtagcattacaaacaaaaaacaaatatattataaaaaaatattcaatgttaaatttaatgaaactaatttgatgtcactaagttattctatgaacttggccaaactaaacaaagtttgactagtgaaaaaaaaatcaaaaccacttataatatgaaatagagggagtaaaattgtaaacccatcaggtcttataaagtattattttaatatagacctgatggtcaaaatcctactgcctccatctcgtaatatatgcaattctaaagtttttcacgtgtattaaatagagggatggaattaaatgagggatgtttgtaattggttgggatgagtaagtagatgaaataaataaataaatgagatatggttgtgattggttaggatgagaaaatatgtgaaaaaaaattaaatggggaatggttgtgattgtttgagatgagagagcaaatagaaaagtagctatatttttaacagttctataacaatagaagtaattatattttagtacagatagagtaaaagagagtagatagtctttttaagcgagtttaaatgcaataggggaccatccaaatatcccatacaagttgtttgggtttctatttcctcccaacaactcaatttcataacaaaaaccccatcaatttcttttctaaactgcccccacatcctattttcattgatttatccttattgtttaagtttattgtttcaatttttgtgcctcatatgtctttggcatggtgtgtttttggaaacctcaatcctcgcttccagcttctgcctttcccaaatcccacatgagcaagatgatgatagcagaacaccatggtaaatttataggacaattacaaatttaccactgttttgaatcgttattgtaaaactgccactagaaaattgcaaaaataccactggaactgtcattcgagtggcatccttacaaaattgaaaaaaccggtgacaaatttgcaaatgcccctaaatctattgagttgtgagttagctgtattttctatgatcccaagctccggcccgaggtagcatgagttcctattatcctgtgatgctagaggtccatggtgcatgataaattgaaatgattaggcaaagatgaaaacaaaatgttggtgggaagttagaagagcagttgacttacagggattttgtgtacaaaattaagttgtaggaggaaatacagaaacaccagtgaattgtagtggcatttggattttacccaaagcaatatgaatattcatctagagaagttatcttaggtacgtaaaaaacacttttacgattaggtttagatccatcccgaatattaagataaagtgtgaataatatactttttaacatttatctttcggtgtgcatccttttagcgactaagcatatctcggttggtttactcctatggtaaaacctactcaccaagattcgagtatctgacttagaacaattcctaacatttataaataattattcttttagtggtaggcagcatgcttggtaacaacgagattaatcaatatatctcaatatactatttcagtgtattagagatgttcaaatagaataggatgtatatatgtgttcatagtggtgaatatgtgcggtataagtataaattaatagggattgtctatacatcatttgacagaaaacccccctaaaaatcttgtaaattatggaccacccgattactttaagatttgtgcaaagaaaccaaccctaaaaacctcctctcctctcctttctcctgatatcgcgccgccgctcccagtttcacaccgcgcctccgcctccgcctccgccgccaccgccccaacgtgccgccccctggcctcaccggctggccggaaggcctcaacggcgccggggaggcccccccggcagacgtcctccccctccctctcccctctcctccctcctcggcgagatgcccccgccgccaatgccgcccaccgccatcctccatccccgcggctccggcgccgccgccggcgcctcgccacccgcccgatccgccgcccactgccgggccgccgcctcccatggcaatccctctaagcccggccacctcccccttcttcccccctcccaccccaaccccaccccgccccgggaccctaattcgccggcgccggagaagaagaggaggtcgccggagttagagaagaagcacctggagcacgaatcgtgaagcacatccggtgattcaaaatttgcaagatttgggtatgtattttctgtcgacagatgcttagcaattccgaaattaatatatgcgagtgaatataagcttttgtatttctgtgtttcatagaaagaacacacgcattgcggcatgtctttctagtgggagagtccatattaaagttagaatttccgcctaacacataatatgttggtgccacctaaagtggtgtgaatatgtccataaagtgtattagtatattttgactgtgggtaaagtaccccgtctcaaaatataacaatttttacaaattatccaccaacattctcttcccaaccaattacaattctccaccattcacttttctcatatacctctacttctcatccaatcgcaacactgcaccatttatttctacctactttcttaataattatgtctaattctaaatttttttatattctagaacagaggagtactacatttcttgatggtaattaatgttcctctccacgttcaattcacttcgcaagattgatcgatagcgcgcgcctactaaaatgcactagcacgtataaaattaatcatattccagactaatgtaacacgtgtgtgtgtgtgtatatatatatatatatatatatatatatatatatatatatatatatatatatatatatatatatatatatatatatatatatatatatatagtaaatttgtttggtgctccatggtgcccgggcaccataattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggtgaatttgtgtatttcataccatggtgccccatatgagtgtcctatatatatatatatatatatatatatatatatatatatatatatatatatatatatatatatatatatatatatatatatataatttgaaaatttttaaaaatttaagagaatttgtgtgttttataccttggagcccgggcaccatagagtcccatataggtatcatatatatatatatatatatatacacatatacatacatatatatatatatatacatatgtatatacatatatacatatatacatatacatatacatatatacatatacatatacatatatacatatatatatatacata

SEQ ID NO: 61058 - DNA, 8253 bp, Oryza sativa
cgtctcgcgatttcccttctaactgtgcaattagttttttgtttttatctatatttaatactccatacatgtgtccaaacatttgatgttatgtttttggaaaaaaaaattgtgaactaaacaggccccaaatcagaggtgccatgctgagaatcacaggagctgttcctgtcagaaattctgctgcacactttgtcaccataaacagaaagttaggcagggtaattaattaataattactgcttagtgcaaggctaataatacagccgatctgctggctataaggttctttatagtcttctctcagcctacccatataatagttagctcttcacaattaatacatggcccacttgtctctctcacagagtttcttggttcttgtgtccaagccggctgttagtttacaacccgcttctcctctctctcctctcttctttcctccaactcagcatttagccggcttatagcctactttttgctcttaggtagaaactggtcagaattcccaatccagatatgtttctgctgctcagtatgttaaattcagagaaatggttacagtgactggagacacctgaatcatgaggtacagtaccagtaaacaattgtgctgaccgaaggttctgaatgatggcaaaaggtaatgtaagaattaaactaaccaaaaggtagtactattttctttggatgtagtatcaaggcagatcaagaggttctttacagaaaactttattatcagaaattcagaacctaatagcatggtgcctacacaagaactgacatcattgacctggtcactcacacaaggcctaatcacacattcaactgcatctgtggagttggttcccttgccaaccttagctactttcagataaaaattctaccttccaacatactaactttaggtttattactgataaatactactacaataagttcccaagaagaaggttcctgaactgctcatgttagtggccggttcccttcatttcaagctatagtgccttttctaatcaaatcaagagaggcttccagaatcaagatcagggatgctaataaaatcagtttgacaggacatggataattactcagtgtttgcacacaaaagcaggtgtgccagaagcaacagggcactcactagcttttgaccctgttgggggagttcaagttttgagaagtagtgggcgagaaactagttgatgagaatatagaaaagttggattttatagcttcttgtttgtagtttattttctaaatttcacaactacaatatataaaaagttgggttttgcagcttcttgtttctagtttattttttataaatttcataattacaaatttttagaataatttatgttagaatctggatcgtgtagaggagctgaagattttagaagaagttgtatctattaaaagctccttaggaccttttgtagggtggttgggagtagaacgcaactgcaaacggccacacaccaacatctccatggatggtcccatggatcaactcacgaatccaaactcatctttgcttgcagaaagaagttactggtccaagccactgatgtcttggcttatttggaatgcagaaagtgttgcagtttcagaagaaaaactgaacaatttgagccccataaaactcttgaaaatcttgtcgttgataaggattagagtacaaccactgatctcaatgatcagacaagtgtccactctgacaagacgtcaagagaagcagctcttgtaatttcgatattaacttctggtttctggaaatgaaattcagagttgtccatcgcccaagaaagtattgacaatttccaacctatctttatatcttcgtatccagattaaatctgaaagaaatacggttttgccggtcattttggtatccaatttacaaggcccacaaaatattcccctccatggaactcaggacaataagttagtagcattctcagaaaaccaattgatctcgtctcttggatgatgaacagaaatgcatggcacaaagcatctcggcattattcaagcatatctgaatcatcatcgcggcgagtcctaaagaagtgcaggttcacatctccacgaggatatgctattgctgctgctttgctttgctgcttgacgttatttttgtcagtgggagcatgtgtggcaatgcaagaacgaactgagtcatcggagacagcgatatgagcagtagcacattgcaggattcttgctcgctttagcttgcctttttcttctttttttttggatcggcgacgagtgctcggctgccatttcatctcctccacttctcgctggattttgctgtgttcttcgtgtttagattctcgcccgccgtctgctttagctagacacgggtgcctgctgctagattgttttggagcagaagcaggtgtcaccttgcgaagaagaatcgtcagaaatgtgtgtggggtgactgaatcgatatgcagaggggcatttggttgttgagacgaaaagatggaatactgtcgtactttcagtttcagtgaatttaccttttcttttttgtacgttgaattattctctgtcgacgtgttacgtgctgatttcatcacgattatcatatatatgtttggtgcaactgaacaaccctctcctgaccgatggtagagaatttgtttgaactcctaatcacccaccaggttcaatgcatattgcacaggatctggcttacgtccaatttgatggtgttacaacgatatatcagttcttttggacagaggaagtacacctccctatttgaatacatgatgatattgttaattgttcagtcaaacttttaaaactgtaaccaccaatatctctcaaaatatttagtttaaaaacataaattcctataggtagatctttctttataggttgtttaaggtggtgtttgaatctcctgaagatgaagataaagattaagtatttcacacaaaacgaggtgataataacgtttgattaattgagttttaattattacaaacttgaaaaatggattaatatgatattttagagtaactttcatatagaaagttttcgcacgaaacgcaccgtttagtagtttgaaaagcatgccatgtgtatccaaaatttcatcccctctttttagtagaaacgaatgggacctaacaatgttataattttattagatattatcattaaattctaatagaaaaataatggtcaaagttaaaaaaaataaagtcaacagtgtcactgtgataatattacttatagactatgcagcaactaaagatgcatatggttttatttgtggacactggcatttgaatttttgataggtaaaatcatgcacacacgactccaccactatgccaacaggtgattggagtgcttcttccaattaatatatcgtcactctgtacaatctatttgcaacgtgaagtacatactaatataatttttgaactcaagtgtagccacgaccactctagatttttgcacgatattttactaagaatcatcaaaattacatacatctagagcattttgaaatatatttgcaaaaaaggtctagaatgcaaatgtgtgcaataatatttctgtatctaaatacagtaatatacatctgtaccataaaagcaattgtaatcaaaaaaaattatgcgtttactttcacataaaaatttaggtaaacatattttaacatgctctatatgtatgtatttttcagtacttctatctataaatgaagaaaagaacctggagtgggtgagtgtcgcagtagaaccttccaagttacaaccttcctcagaaaaactctcatgcaggctgaattcgtttatcatgtggataggtcacccagaaagatccatgtcaattacaaaagttgaatggtggcaatggtgcatgtcctgaaggtgtatgcaccttttgtttagatgaggagatgcatcagcaaatggagcagttcctccaccactttcatcctcagtttctacattggtcggcatgactttttagaaaacggttctacttctacatagtttggcattacttttcagttaatggaagaaactcccggtctccacagtacacaaaaatacttttgattcagtttttaaaagagcaatgctacaaccatattaaattgttctataaagctattactagaaactatggtatcaactgtgtttgatttaactagatgaaatcataggaaatctagatgtattcacaatatgacacataagtgttagtaagagttcatcaacctttgatttaactagataaaatcagtttattacgaaatttttagtacttatctagtacgctttttagcactgcaacctctattttttatatgtatgatgcactcgtctttttttcctcaatctttaatcaacaatatttatttaattacctaattaaaaaaatagtgcaaccagatttaccatcaaaaatactttaaccatgtctagtacatttttctatttgcaccaataattaaagaaaaaaaatcatcaaacaattttaaaaagtcaactacgtcatattataaaatgcagaggtagtagtacataagctggcatgattaaccagtgagcaatttggactaatgactcctgaaatgaaacatcaacattggatgaatgttccattagatggaaaagtgagaagttagacaaggcagagtattgccttccccggttgcacttgaatcataaagggctttggcctcataaggtcaaaagtcagaaaagaaaaaaaaaagagtgagacctggacaagcagagctcacaccctcttcatctacgaaaaggagagagagtagagtggttgttcaagagcttttgttctagttctaccactttttttcttttttaaaaaataatttaaaccaatccagcctctacatctcaacgtatcctatcttattttatcttttgttttcattttttctctttttttcccttttggaggaatcatttgcctgccgaagtatgtcaactatgcattcttctgttgacctttaatttacaccatcatgttaatagtaagttgtaaagaagtcacttttggataactgaaaggaagcaacagagctttgctatctcttattttattttattttttaaaaatagaagtatgtaactacttggtgatatttttctgaagattttctaaggaaacatgtttttgcaaagcaccagagaatcttttgcataggtccatgcagaactgttggaagtgctaagttcagatatgctgaacagcatatatatcataatatcaacactgaaactgtattatacctaccatcacacagaattgtggttcctggtgaatcaaaactccttttcggctcgtattattgtactgcctgggtttcaggccattgaaactgtttctactgcacacgacattctccaccgaatgtctcatccagaaaaagaaaagaaaaacattctccactgaagcctaaatatataggttcttcagtttattaggaggtcagctctatagcccatcatatatatcatgcagttgtggaacaagatccggacacaaattatttgttggctgcataattgagcaagaaaagggtgagattttcaatggcgactcctgtagattgcgtcgacaaacagcaacaactccctgttcatcagaagtatacccacactctcatagtctcatgcagagatttggcttctttcttttctccaccaactgaatcagatcacgacggccatcatatccttccctccacgtctctacgccgaaaacgattgcgtgcaatgcaaacccgtttatacaaaacaaacaacagttcactggtcatttcaagaaccaagctagctagctagtaatgtgagatgcagagaatgagtgagagagagagagagcaacatctgtttgagcaaaagttatctgaactgacacacagtgacattacattgcaattgttgctgcaccccaacgacatcgatcctcttcctggattctgaaaccgatggctctttatctcatctcagaaactgttggtagagatgcaggtaaaaaagatggccatttcaagcccggaatctgctccatttctgtcagaaagaagcagtagcagataaacagcaaccgtttcttcgcatttggtttttgaaccggttgctgtcagaaagggcccggttgctcccccctcctcctcaagctccggacgccggtaggaccagacggctgccaccgacgtccactcgaccattcgctcgcgccacgcagccatggccacgcaccgtcgctgcattctcggccacagccaaaaaaggcgcgaaagaacactctccagctagcccaagccacatagattggtgaagaagaggaggaagagggtgacacattcttggacagcaaaactccatggacaccggaaaccacagacaaattccagctaagccaccaagatgactagatggccagatgggcatagtacgttctcactgtctgtactctggtagacaggaatgtatggtaaaatagtagcctcacatttgttactagactactagctaatgtgtgcatggtgacaaacaagcaggaatgtttctgaactctcaagcattccatcagaaacctgacaagctatctgaaaatcacctgatcgatcgatcgatcagtatgtcagtaagatcgagaactgcacccaaatgtggtctgggaatctctccatatatatggcgggccagtccatggtggatcattgaagccactagttaattattggcagaaaggtgagatggcaagtgaccaaaaaggagagcttctttttctctgaaactgaagcatcgatgaacgcgcggcgttttcagcgcactgtggtccgtggtgggggaggaggaagaagaagaagaaggagaagaaagctaattaatggggagataatggcggttgacttgcgcagcagcatttgatttgctaattgcaagcgtcaactgcatcaccaccgatgctccactagctgtgatgatttcatgttttttcaactgtatatctgatgatgatgatgatgatgatgattgatgaatatctggtcgatgatgatcagtcggaataaagcgaaagccggcgagctttccccctgtgttgcgccgctatgggccgaaaatatctcgaaaaatataggaataagttcatttgaggtcccttaacttgtcaacgaatccaattttcatccttcaaccgaaaaaccagatataacagatgagtaaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaaattttatttgaaattttaataggacaatggatttttttatcaggagcattcataaaaaaaatgttgtgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctctataacagatcccccaactatcaaaaccggtgcagaaaaggtccctcgtctgtttagatggcggttttggttgacgtgacgcttatgtggctagtttgactcggtcttcatctgacgtgtcattgacgtggcgcttacgtggcaattcgatccggaaaaataataaaacctgtgggacccaaatgtcagttttacacacaaaataataaaaaatggtggggcccacccggggcccacatg

SEQ ID NO: 61059 - DNA, 1182 bp, Oryza sativa
catcctccgcacccacccgtcccttgtcgccgtgaacacctcgccgccggcgtcgtccacgtacacgtcctccggcgcgctcagcatcccttccccaagcttctccagattctgccacatcgcaaaccatgaatccaccaacggccgacatgagcgcggcatggcgcggcgagctagaacgcaacgtaccgtacctggaggaggttgttgggagggaagcgagcggcgccgggtgggcgtgcgggcggcggggcgagcggctggatggggcagtggagcgcgacgtgcacggcgagcgacacgaagacggcggcgaggaggcccagctgctgcgccatgccgccgatcgacccaccaatgtgtagccgacgacgagctcgatcgatcgatcacgctatcggcgtcgactcgactcgccctgtagataagctggaggtgtcaggcatggcatacacgtgacgagtgggcacacacctgttatcgttagcccaagccacgtctgttttggacttgcccattattgcaccacataaaaggttctggtccaaacaaataaccgaaatttacttttctgaatacgtaaaaaattggaatccatagataccgtggtttaaacctgtaatgctcccctcgttccatttggaccatttagaagcctcaggtcactcatggattctgtaaaaggcaaaacgcttgtggactagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttt

SEQ ID NO: 61060 - DNA, 1673 bp, Oryza sativa
tctcaagcggcaatatagttttatcagtgtaactaccccaagctttcaacaagcctatacccgatccgtcgtaaaaagccagcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccaggtgttccggtgcgggtagccaatagccaaagcccaaagagcccagcaaccgaagcggccgacgtggcgcatcctcagccgccgcctcacgccgatccaacggtggccagatcgatccgtgcaaagtatacgtggcttcgcacggacccatccatctgtgccctagtttaatcccccggggcgcgggcctaatcaacttgattaagcgccactaaccaccccctggaacgatctccccgatatttaggcggagattaacgaggcctctgtgcctcgtggggagtaattaatggcggagaaagttttggttaatcaaagagaggggggtaattagatcgatgagtggtcattaacaaacaggtgtcagcccgacacggaggagcctggtcgtgacacttgtcctccccgggatccatgttggcccatatgggtgggctctcattggccgaactgcaaaagctgatcatttcccttgtgcggaaatgtgttgttcatttttgttttgtttttgttttttttacgccttgtgagatattgtcaatatttcaagatgtactccctccgtattttaatgtatgacgctgttaactttttgataaacgtttgacctttcgtcttattcaaaaaatttatgtaattataatttattttattgtgacttgatttatcatcaaatgttctttaagcatgacataagtatttttatatttgtataaaatttttgaataagacgagtggttaaacgttggttaaaaagtcaacggcgtcatacattaaaatatgagggggtataaaatatgaaataaagaattattgtagttctagcttgggtcatgcgtgacaccatcatagtacggtagcagccgcagtagcaacagggtggattataaaggaagaagttgaatgcatttatgactctatttatcagggtttaaattatgacacatataatggaaaaattgtaaaaccatctcaaatgtcactataagtttgagtttccccctataagacgatttgtggtaaatacacccccctctcttagttcacctttgatttgagattcccctgattggcattgctcgtccattctcgtgacaaacccccccccacatgtgttcacatgaatactaatacgggaggagttgtggtcaccactcatgttgatcaagcctaatgacaccaatggtgacattttttacacatgacacgcccacacc

SEQ ID NO: 61061 - DNA, 734 bp, Oryza sativa
tcccaaacaccaccttaattagctgcgcacaacaacacagtgaattaattagtagttactaattgattgattccacgtagggagttggacagcctcatgcaaaattcccacaggatcaatcaatggtgctgaggatcgggccccccggggctcgacctcttcgactcggagtacggcatcgccgccgccaccgccgtctgcgagctgatcgtagtggcagtgttgctcccggcgacgacgagcattctccgcccggtgatcacggccagctggagctgcacatgatcatgatcaggctcgccgcgcgagacggcggcggacatgacgacgagcagcagcatcagcacgacggcggcgcgcaccagcggcgacctcaatgtgctggatgaggagtaggccatggaaaaagctagaggtcttcttcttcgtctaatctcctagcttagcttagcttgagagtgagctagctgtgttctcaggcgcaggttgcaatggcatgcatggtgctgaatttatagctaagctaagctgatcgagattcgaggggcagtttccggccgttaccgtgagcactatcgagctagcgacaggtgtagagagtgatgggtggtggtgatataccggaagtggatttttgtccctagaggagacattccctcgttttgtgcataatgtttaaatagttattaaaaaaatttaaaaagggtaccgagctcgaattcgcctatagtagt

SEQ ID NO: 61062 - DNA, 3814 bp, Oryza sativa
aggtggccggaggaggaggtcaccagcgagcacgttcctgctcctgctccgactgctaccgcgctcccctctttagccctagctccaaaactttcacttcgctagaacacacaaccctttctctccctcgcaatgccacaaaatcagattagtcgaggccgagaagacgccacttgggcccggcgcaaggagtaggaggggggagtgtgtgcggcgccgctggtcgcagtcggcggcggcgatggagatcggcgcggcggcgcaggtagaggcaggagatcttcgatccgtcgagcgcaaggaccgattaagcttacgtgttttttagcctaacaccatataacgccggccggccgcactgccgaggccgcgacccgcgctctgccgcacggccacgctcgcgtcatgcagctcgtctccatctccaagaaccaccgcggcggcaacgacgtggacggcaagcacgatagcagcgacgtcgacgagggcgccaacgccgacggtgagcacatctcgccgcggggctcctactaggtggtccggatcaagaaggacaagatcctggcgccgcacgtgcacttctgcagcgtgtacagcaagggcttcaagcgcgacgacaacctgcggatgcacatgggcggccacggcaaggaggcatctgcaggagcttattgtgcgcggccacggcgatgagtacaagtcgggggcagcgctggccaagcccggcggcaagggcgtgtcgccatcgctgtcgccgtcgccagcggacgtgccgaggtggtgcttctactctggtcgccgaaccttgcgtgagagagaggggagatggggagagaggaggaaacccagggggaatgacatgtgggccccacgtgagccccactattttttattattttgtctaaaactgacatgtgggtcccacgggttttattatttttctggatcgaactgccacgtaagcgccacatccacgacacgtcagatgaagaccgagtcaaactagccacataagtgccacgtcagccaaaaccgccatctaaaccactgagggaccttttctgcactggttttaatagttgagagacctattgtatctggttttccgattgaaggatgaaaatcggattcgttgacaagttaagggacctcagatgaacttattccccaataacatgggcttctcttacggcccaatttaggtgcatcttcaagagcatatagcccagtctagcaaccatattaacggacatatgggccttttttctccacactacctatcaataaagcccataggaaagtctgatatcgaggtgcagcagacagttagccacagagcccccataggttgcggccaaaatttaaatgggagtgaattgcatattaggccacttatttgcaacttggactaggcctactatagtgttttcactttacaccaagtaagcttaccaagtgttgcactttggtccaccttatcccatctcctcttttaactccggcaccattatcccttcacctgcccccgaccagctcccttctgtgttgctaggactgcacgacgctgcctcctgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatccaatctatggccagctcgtcgtccaagatggcagccactaatcctttcggaggaaacacaatctcagagaaattagccaaaaacaactatgcgctatggaaagcgcaagtcctggcgtcggtgagaggagctcgtcttgaagggcatctcactggcaccacagcagcgccggccatcaccatctccgtgccaggcgagaaggaaggcgacaaggccaccagggtggctaatcccgcctacgatgaatgggtggctacggatcagcagatcctagggcttctactgagcaccctgtccagagatgttctggcgcaggtggccacctgcggcactgcagctaccgcctggagcatgctggagagatgtatacctccatgacaagggcacgcttcatcaacactcggatcgctctctccaacaccaaaaagggcgatctctccatcacagaatatgtcgccaagatgagagcacttggtgatgacatgacggcggctggcaaggtcgtcgacaacgaagatctcatctcctacatcattgccggcctcgacgacacgtatgaaccggtgatctcctcaatcgtcggcaaatctgagccgatgtccttcggggaggctttctctcaactgctcagctttgagcagtgcaacaatctccgtcacggcggtgagtcgtcagcaaacctggcgaatcgagggtgcggcaccaccggcggcaacggaggccaacgcggacgcggtgggaacaaccgtggacgcggcggcaatggaggcaacaacagcgcaaaccgcggcaagggtggtcgcgggaatggcggcttcaatggaggacgtcaaggaggtggcgtcgacactaggcccaagtgccagctatgttacaagcgaggacatacagtaatcaactgttggtatcgttatgatgaggattttgttccagatgagaagtatgcaggttctgcagccacctcctatggtatcgataccaactggtatgtggatactggggcaactgatcatgtgacaggagagttggagaagctcatcgttcgtgatcactacaaaggacatgatcaagtgcataccgctagcggtgcaggtatggaaattagccatattggtcactctattgttaaaacccccagtcgtgatattcatttacgcaatattttacatgttcctaaggctaacaaaaatttagtttctgctcaacgtcttgtttctgataattctgcctttatggaactatattctaaatatttcaatcttaaggatctggccacgaagaaacttctgcttagggggccctgccgtggttgtctctatgctcttccatctacaccgccacatgcacactcaaccaaagaagtttatggagtctccaagccatcttttgaaaggtggcacagtcgtctcagtcatccctcctctccaattgtagagaaggtcattagcaaaaataatctcccatgtttagttgagtctaataaatagtctgtgtgtgatgcttgtcaaaaggcaaagagtcatcaattgccttattctatatcatctagtatatctagtcatcctttggaacttatttattctgatgtttggggtcctgcccccacttctgttggaggcaaacagtattatgtgagttttattgatgatttcagcaagtttacttggatttatttaattaagtttaaatctgaagttatccaaaagttccatgagtttcaggctcttgttgaacgattgtttaacagaaaaatcctagcaatgcaatctgactggggaggagaatatgagaaacttaattccttctttaccaaaataggtattactcatcatgtgtcttgtcctcacacacaccagcaaaatggctcagctgaaagaaaacataggcatattgtagaaatgggtcttgctcttcttgcttactcatctatgccattaaagttttgggatgaggcttttacttctgctgtttatctcatta

SEQ ID NO: 61063 - DNA, 549 bp, Oryza sativa
gaacagatctagtgaaaatcaccaagcatcaatcaaggacgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggccttgccgacgagccctcttaccaccaccttcaccccccgcgcaacggcgccggcgccgaccttcgccggaacagccgcacggacggcgactcctgcatcacccgtcgacggcaccggcggcaccttagcgccatgaaaacaccgcagtgggagctccatctttctcctgcaagaagacgacgacgacgatctagctagctatggacaccgagcttttatcagctacgcgaccatttctttctttatacggggggcg

SEQ ID NO: 61064 - DNA, 6015 bp, Oryza sativa
gtgctgttggtgcactttgtaaacacagagagaagcaataaagttgttatctactttgagagttcttcaatttgtgtttcttcgggttcaggcggtagggaggaggttcgaccggcagcgtgcgagcggtccgaccagcgacggcgacaggactacgtcgagatttccatcgatttgagggtaacttttatttccgctaaaagtttttgggtttttggttttccctaccattcatccccctctggtaggcttggtttcttgcgttcgatcctacactatatatatcacggcgtgtcggccggtgcacgtcaatctcaataggcagtatatactgccctgttagaatcagctcggctatctttaataccgatttcaaggccaagattctagcttgccattgggccacgtggcagcctcaaaattcagctagacacctcagaaatccttccacgtgtccatctatatagttctacctttctccagcttattggtacacatgtgctagataactcgagggaaaaagtatccagtagaacaattacagattctagatgctttcaactatctagctgtttgcaacatttaggctccaagaggcattaaactgtctcattgaagataaatcataattggtttgggaaaaaaatataaatccataaaaaaaaggtgcagagggccggctcttacagatacaagtgaggcgccggagagaaaggcggcatcgaggaagacagcataaatatatggtaatgactgaaatatttttactaggagtcagaacgcatatatattggcaacttccgataaaacatactacctcctacttttaatagatgatgccgtttactttttatcaaacgtttaaccattcgtcttatttaaaaatttatgtaattataatttattttattgtgagttgttttatcactcaaagtattttaagcaacatttatatcttatacatttgcataattttttttataaactaatggtcaaacatgtattcaaaagtcagtgacaccatctattaaaaaacggaggaagtatatacggatttagtcctctttggaattttgtactataatttcttcttttaaaatctgcatgaaaaaaaatatagaatacatttttatcgacaagataattatgaagcaaaagacttagggcttgtttattttgctaccattttcaaccttaccaagttttggtattgccaaattttagtcaaattttggtaagttaccaaaattttggcaatgttactaaattttggcaagatttcatatgtacttactaaaatttggcaacagactgactaaatgtagccaaaattttggtaactttgtaaaaaaaaatggtatggttgaaaatggtatcaaaatgaataagcctttaggtgtgttctttttcctcttactattatggattataaagggcatgcttcacaagcttatggtttattatttgatttgttttatatcaatacatcaactttataatatttttaagctctgaaataattgttatacaccagtttcatctatagtccatcatcaatcgaaacttaaacgctacaggagcatcgtcaatcgaaacttaaatactgcaggagattaggctaatagtatgatatgcaaaatagaatatttgatgaaaatcgagataactctgaaaaaatcctgtaaattttcatattctaaacacaccctggaaaaattacatgcgttatctagcgcgtcatatggcgcgctaattttctagtttcctcgatttcaggagcatatttttcaaaatattaaatgatagacttcgtaaaaaaaatatgtatagaagttattttaaaaatgctatataaatattttttatttgtaaataactattacttaaattatttttttatcatgtttctcgttttacgtgcagctaatgtgttgtttttatccctggtttagaacacgcccttagcttgttttcgcctagctaactagcacaacacgcgtaagagaaacatgcttgtaaatagttttactcttactacatataatacttcctccattttataatataagactttctaacattatccacattcatttaaatgctaatgaatctagatatatatgtgtgactagattcattgacatatatatggatgtgtgcaatgctagaaagtcttatattatgaaatggagggagtatgtcggtattatcttgtactggttcgttaaaaaaaataattagccggtttaacgaagtgagcataattagttaggttcttttggtagaatcaatctacccaatttcaagtcgtatttatggctatttattttttcagtgatagacgtcgtatccgtcgttagcaagacattcgtgatgactttgtcaatctaaaaatgtgccggtccagtttttcggatatgtacatagaaatatggtatacgtgtgtgcgtttataagcatgagtgaacgtgtgtttgtaaaacaaacttaaacatgatgcaccatagatcacacgagcgaagcttatctagaaactgcaggctccagtttggccatcccaggctcccagcacacccgctcaatatgacagaagtttagagggagagaatatgcggtaattgttttcagtggagttggttacatactaatttcttataaaaatgttgatgattgtgtcacgttatgaacgaatcttgatttttcttataactcgcgactaattaaataaaatgttgaaatcattataaggaagaagtttataagactaccttttctattgcaatgctctttatcataaagacgaacgacctgtcactggtcatattactatataatacgctgaaacaactggtgctagggaaaggaaaaaaaagtttgaattacacctccgaactattgagcgagtaaaaattaccacctagactttagaccccctttgaatcaaatgaaattcataataattttagaggatttcggggctgtttggttcacatactaacattgcctaggtttaccatgttttcttagctaaacttaccaaaggtgaggccatcaaaatccaagccacactctagccaacaaaatgaaaccatgccacactttttagagtcacttacatgtgggacctagattacaaaagaggaatcttgccacatttgtgggagtcaaccaaacactaacctaacatgatcaaacttgcctaaccttaagtgtgacaaagtgtagcaacttatggctatcattcctataggaatttttcctataaagccttttgaatcaaaggaatgagctctatggaatcttatgaaattcctatggaatgcctcttcccatacaagttttggaggaattttaacaagaggtagaacctcatggaagaaatcctttgagtctttatctctcctcaaattcctgtattttttctgtggtccaattaaacggtcattcctatgtttttcctatgttttgcaatcctcttttttacacttacattcctgtcaaaatcctatatttttcatattcctccgtttttttattcctgtgattcaaaggggcccttagagtggttttgatcctacgtggcagactagtcaatattttttttaaaaaaatggtagtaccctgcgttcacgaaagttggtaggacccgtccatctcttattgcaggtggtttccactgatttattatgaaaattattgactttgctgccataatataggaccaaaaccactttggattgtgttaaggggattttcattcaataaaaaaattcaatattaatattaatagagcgttcgtgaaaatattaatagttgagagtgaaaaatgtatgattttcatgtctagggtttaatttgcaagtatccaataattagagggtgtaatttggacttttttccatagagaaatggggactgagtcaaacaacacatcattactgtagtagactgtgagtctgtgaagatagtataaatgtatgcttagcgcctagaggcacgccgaagccagacaggcagcgcagacactaaccgtggagtagtctgatcgatctatagaaatactgtagccaaaaactaggccaagagagagattggggtgttctgagcgtagccgaagacatggcaactgatggccacataacacacttcgctcatccacagcacctgcttctcaagacccggtatgacagcacctcgcgccatgtctgcgacatctgccgagccaagctctccggcctcgtcggctaccgctgcaacgcctgcgacttcgacatccatcaggcctgcgccgattacttcaagaagaccatcttcttcttcgcccatccgtggcataccctcactctgagctccatacccgatggaagcaccacgtggtcgtgcgacctttgcagggagaattgcccccggggaaacttcgtgtaccgctgcatccagtgcgccttcgacgtgcaccctctctgcattttgctcccgcaaacgatccgtagcccgcttcaccagcagcatgatatccacatggtcccttcatggggccgctgctccgcctgccgtgaagatttggacctttggtactaccagtgtggcttttgtctgtttaagctacatatccgttgcgtctctggcgcgccaagtggtgtcggtcagggtagcgggcctagcggagtaaggccttgtttagttcaggaaatttttttagatttagtggatatacggacacacatttgaatatttaaagtattaaacatagtctaataacaaaataaattacagatttcgtaaaaaaactgcgagacgaatttattaagcctaattaatccatcattagcaaatgtttactttaacatcacattgtcaaattatgacacaattagacttaaaagatccgcctcataatttatatacaatttgcgtaattgattttttttctacatttaatactccatgcatgtgtctaaacattcgatgtgacagcatggaattttttgttttgggaactaaaaagagccttgcaccagcaacgctgccatccgaactaccagtgatgctcagagcattgccatcgttcggcggagctgcagctctggtatcaccaagtttctcgtcaagaaaagcttcatggtcgcgattaacctagcaacaggcgggctggcatcgccggtgctcgacgtccttgaagctgtcctcgattaattgccacgtcgatgatcaccaggcctgtttggctcatctatgtatgtgtgtaagatcacctgtcgtttcaattccgttgaactttcttcttctccaataatgtgtagtaacccattgttcgatccacaagcggtataggctaagtcaagtcaaccgtatatgcccatcgaatcgcactacgccggaccaggtcatctctgacggacccaaaccctcacctttgacgggtttggtcttggtcagtgattagtggtcactgatgacaaaatcacctgtgatggatgaaacacccgtcacagataacccatctctgaccggtatataagtcatctctgacgggttaaaacttgtcacccgttacagatgagtcatcagtgacgtgtcgtaactacctgaccgtcactgatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacacaatataacttgtatgctacaagtgagattcgaacttaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatttcatcgtgttttataacttttacataaaaaatatcttcat

SEQ ID NO: 61065 - DNA, 31246 bp, Oryza sativa
ccccccccccccccccccctctctcccccccatcgcttgctgtcctctcgtttcctgtgtcattctcgcgcgccaccgaggcgccggccaccacctcaccccgcggacgcagcgtccgggctggcacgtcggatgcgcggggtcccctccccccaccgggggcgctcacctgtcagaggcacgcggccgtggggcgccacgcccccgcggccgggtgtgctcgcccgggacgcgtgccgcgggacgtcacgcacgccgacgcacgctcccggcgcctgccgccgcgtgccgccacattgccgccccgccggccgcgcgctataaagatccccgcacagcacgcggctaaatctcacaccagtaccaccacacagctagctagctggtatagagtacagcgcactagctagagcggtagagcctccagagtgctagccccatcagccacagtagtgttgagcgagctaaagctagcatacccctcctgcttaatttccatggcgccggtgtcggaggccagccccctcgtccaccaagacggcggcattattgcctcctttgcggtttacgccggcgcaccgtgctgcagtgcgcggggtaggatggccgagacagacggcgacgacgatgacgacgactatgactgcgcgcctgccgcctgagtcgtcgtcgtcgggtgaaagaagagctagctaatgtagtagctagtgtgcatggtacctgaagattaattagcagctacgaagtcatgctgacatgctgtagtactgtcttaatagagttgccactgcatatatatgctacttatttggtcgcacgcaagtaggtactcacttaattaagtatcagtttatggtaattagcttctactaatatatatatgtacctccccgagtaaccgtagtctaagctatgaggcagtacaaagtgtgtggtttttgtaccgggaagctagaggtcatcgtgccgataggcaaactgcgctgcaagctatatatatgcacataatacagaagcagttagtcaagtcgctagcaggtagcagcctagcagggcgcatgtactgtggttgttgatctccgttgcaataaattaaactgatatctacgcacttgactacttatttgtttgcatgatatatgcaccctggagacccaggagctggccggatcacgtactgtacgcaactacgcatgctgctagctatagctatgctttcaatctggtgcaattcccttctgtctagttaatttgaatctgatactgatagaaatgctaccactctaggctatcagtttctcgtgttgtatttttacttgaaagacatatttggatgatacacacgcaccccatatgcatatctaaactttggttttctaattaatgttgatactgtctaaactttgcctcgtggttttataatggttcttttaggccagcttgatatcagtataagattctgttggtagtgtgcacactttagaaatagctatatatatatatatatatatatatatatcatgcactatggttttcatgccactgtttgcacattaattatattggcacaccatactgtttttgcatgcatgttaacacacttttatgcaatcgttcatatttgcatcagttgaatgcaattatatgagtggcagatttaattgtaaattaagagatggtgcaatcgtatcagtcaattgtacatcagaagaactgcatccccttttctgattctagcagatggaatcaaaaatcaacaaaactgtaacagagattgtgtgagggcttgcatcaaaatgtgtatctaggaaatgcttagtatttttggataattgaagtacaactccagctttccattaacgagatcgaatggacttggatgcatggaaatgcttaatatagacaaaccaacggtaaggtcgatcgctatgctttttgcagtgacatttttataatttgggttgatgttttgaagtggattgtattgaaatttccctcgatcttttgtgagtacgttcttcatttggagttgtcattgagctctaagctcacatagcgggagaggattctaatccctcgagggggcaggggatgttcccctcgtctaactttttctctcaattttaatgtgtgagagaattctaatcccttgaggaggggatgtccccctcgtctaagtttttctctcaatttcaatgtaagtagtttttgaagaactctaaaaaaatattgataatgtagagttttgtaacatctatcattccgtcaaagttgagttttgacttctttttttcttttgagaagtttatatatgtgttgtgaatgttgtcattttcttgagattttttaacaatcatttagatagtgcttgaacaaaagaggggatatcttctcaagagtctaaaacacgtttccctcacatagcgtcctcacattgatgcaccatctattggtgcatgagaggaagagaagggtaaggatgtcgttgtaatatcaactctgtgatggtaatagttcactacggttattagggcatgtataacagtgtttagtaacaagctctttgttaccatgcatgtaaataattttggtgatgtggaagaaagagaatggaggaaaagcaaccatcgttactttgcatgacatcgactcaaaattaactcttaacatttattaaagaaattttattacatggaagtaaagaaaaagaaaaaaaagtaataaacaattatttcggtacgattagataccctgttgtctcactattgtaaggagatagtttccaggtgactgcggcttatgggtaggtgggagaggatgatttcagcgaaagacttcaccaacaaaaggtgggggaagaggccgatgagattggggcaagttgttgaaaaatatctctgatttcgaagaagcccggaccgctctcatcttatctcaatttttcatgtgaatagagctttctttttttgtgtgcgcttggggttttgccatcaaaggcgagctgaatcggttctccctgaccagcgagatttttctcaccttgcaaggttagttcgctcctaaaagcaagtttttttttaccggttccagacaactagccttcctaggtaaggctatgctagcctttgttgataaaccaaacgggccctaaatgatcagagatgaaaagtgatttctataactccattgctatcccaaatgtatcatgcaagaactttgaaggtccaatatccagtccaaggaaatttacttgggctattggaaaatggaattaaatgggccttttgtggagatgcatatgtagttgatgcacatataaagaaatgtaataatgtgatgacaataaatgtatatttcacagaccagcaagatttaggtgttaatatttcagcaggtagacaacatatacttaaaaggaaacttcgagctacaaatatatatacatttggtgaaagtccaattggtagcttctttctttccaaggaaccgtatacgtgagagacttccgtatcatacgattttataccaagtttgtattgccggcccttgttattagaccaatatacattctggtcttttatgcctaaactataatctctgcttctcaggcgcctggctatcacgaagaaacaacaagaaatattctaatacataagatatatataggaataaacatattttatcttcattttccaaaataaaaaaggatatattattttggcacaagttgaaagggttcatatgacatattgaaaacatatgatttcttactgtcaagttggtaaatgacatattgaaaattctggttctcaaaagaaaacatattgaaaaggtttaattgtacaagatgaatatcaaggtcatatgattcttaccgtcaagttggtaaatgacatgatggcatgcatttcaatattttattatttttaggttaattactttgtttgtgatgatgtatattaatttcccttaatataagagtctattacttacataactggaattttgtcaaccttgattcacaagttcttttaccttccatggtcagtgtacaccgtttgtctgttgtttggctacccaagaacaaataatcaatcaactaactactcttactttaagataagtgcaaatggggggatttaacacctataaaacaaaataatccatgcataactagtagaaaacaaactaaatctaggtaagccttaatgccttatatacaataaaaatgaagaaaataaaaaaatattttttctgtaaatctttgcaagaaaaacctgagtattggagaattaatatgttttattttttttactatatatgcacttttaaatgactgatgaaagctaacaaaaaaaatatttggatgaaaaatgataaaaaaaactgctttagcaaaatttaacacgttgcataaaagtagggtggttggcgggaaggtctggagaaggatcttgtgggcaatgtcgagtggaatcagaaacaggtgaatcggacagggagcaacgcagtcgtactaggctagctattttgacttgaaaaaaaaacgagcccgtgtggtcaaatacgtgaagcgaattagaacgttttctgaaaacgacgtacgcctcaaaggtccaaaacaagatctcatgagacgaggaaacggaaaccccatgacttgaaccttaattaatttgttctagtactgcactgctacttcttgagttcttatactgcgtagtagctcatctgttgaatgatgatgcgtgtacaacctctgttcctccgttaaaaaaatattaatttttaaggtataaatttatacaagtatttattcagatttatctttaaaagctggttggagtaaaagagtagtcaactaccgaaggttagatttaactagtcctacaaaactatggttggtctcctcccttaggtgaaaacccagtctagctatgggcaggtgtcggcaggagcttctgtcgttgttcacctctttggaggcttcgtcttgaaggtcttgctactctctcggttacttatgtggttcgtagttttgtcacaggttttctgtgtcttctgtgtaaggttttgtcggttttctcttagcaaaccgtgcagttgtatggttttcgatcccggtttcccttataaatagagtcaactctcttcttctaatatatccagtagaacttctaccgtatactgtttcaacaaaaaaacaaaactatggttactagtgattgtagtttcatatgatctggattcaacaaaaaaaaataatgatctggattcaacaaatgattcatgaattgttgattcgtatggaccaacagaccgtcggaccatgcatgtcgctctcattatgcataatgaaattaaatttcattatattagttttgggctagttgatcgatcagaaagctagatcacctaattaatgaatgatgtgcaatcaaatgctgagcaagtttcagtcctttcataatattattacacttatatgccatttctcatgtactttcttcaatgtgaatgtgaaaaatgttagaataacttacattgtgaaacggatggagtatatgtgtaaatatacaatttagtgatcaaattaatatactactagttataaaaaaaatcctccggaaagcaataattttttccattattttacgatctgaggagtataaaatgaaatgattgtcctatagtctattatagtttaaacacaatatatctccacaaatgatacttcaaaggttcattgtattacccaaaattctttaaacacaaatacacaatatctccacaaatgatacttcaaatgagggtattttgggtagtgaagtttgttgtacctgtccaaaataccctcatgcctctttaggctgtgttcgcataaggtggataggaacatattccctccgcacggaaaacggagcgattcattagcgtatgattaattaaatataagctaattttttttaaaaaaatagattaatttgattttttaaaacaactttcatatataaatttttttaaaaaacacaccgtttagcaatttgaaaagcgtgcgcgcgaaaaacgatggagaggggctgggaaaagagagttgcaaacacagccacagaaggacagaagggtggtcttcatttgatttaaaacctcagttttcgattgagagaaaatatgttaccacttcatgtttttcaagtttcaaccaaaataaataaaaatagaggagatttaacatggaagtttgtaaacaaactcctctaacgcacagaaacaaaaagggaatgagttactcctacaaaacacccggcgagccacggcgccgctgactgcgtagggcgggcggcggctgtctcgttccacgcacccccaccaaccccagtacccaagccaacggccaggatcgtcgtccgcctcgcgaaccgacggccgatcccgccggggcttggtcagtgcgcgatcttttattactcccaaagttccccccgacctactcctcctcctcctcctttccctccctccgcctccccccacctcgcgtctcgcggagcccggagagcagcggcgccgcccatggagtcgctcgcgctcctccacgccaagcccggcggcctccctccccgcgcggggctccgcctcccgctcccgcgcgcgcgatccgcgcgcgtctccctcccctcctccccggcggcccccgtatcgctccagtccccgctcctcctcgcttcgagaagcggccctacctcgcgggacgccgtcgtggggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccaggtgagtcatgggtttggatttttgtggtcaatctaggcatgtgcaaatgtcaatttattgtctattttcagtcaaaaattgatggccatctcattagctaatgtttaacctgatgtttggctgtggagagcaaaacatgaaggagcagagtttgttgttgggtttctgtcactccgtcagaaattaggatgtgctcttgggataatgggtagttacagaaacgttggtttgattagtatttagtagtattgctcagtgtattgtcaaacctattggctaagtctaggtgcttgttgctttctggcatgaatgccttcaacttcatgattgctactttgctagcttttgttaatctgaattatatttagttggttaagttgcatttttgttgtgatatgcgttcttttacaaccacttgcctggatatggttcacactttttaactgcttttgcaataagtaatgttgattgatgtgggcctgtttgttttgagggccagagttgcagatgaaaccctagccaattttggtactaccaaaccaaacaagctgcagcctttaacataacatgtggccatattatggctacttttcttcccacaaaggaatgcctgaatgcttatattggatagttttatacatacatttcatttgtgtgaaacagtagggaggatccttgctggaagttcaagagggggaagaaatacttagggcaagatttaaaataagagaaaacaaagacagaaacaagcttttcaggagatagggatactctacacaaccatgagtagctagctgataataattcaagacaatctaggtgatagaatggcattatttcacaagtacaaatgtttgaacttctctcttatatctatctgagagaagacggtggaatagattgtgtcaactctctgactgaataattctgcataggggatatagagttttttttttctgggccatttgccagagtggctttgtgggctgttggtcatgcctgaatgagtaatgttggtgcatccgaataacacgtgtgtcctcagctatttgatttcagaattacatctgaatggtaggtgatcaatgtcctcagttatgcagagttcacagtggttgttttttgttgttcacgaagcttgaccagaggtgtataactgtcaattggttgcaagctggatggggttttctagtgttgtctgacgtttggttgtatatacctgtttaatattttctgaacttcccatcaaatggtgacccttcaggctacaactgatttcatccatccttctgcagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggtcagccgaatagttaaatgtgcttcttttttttttttactactactactacaaataatgcactaacgttttttttcaacaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacaggtaactttctcagctttgtttgtttcatcttcagattaatttgtcaaacagtttttctaattaagtatttctttcttcatcatggcagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtttgcttctataccagattgcatatttattcatgtgattcgacgatgaacatttaaaaatatttttgcgcattattctgctttgtatactctcgtgattcatttaagcagtttgttgcttcatatatgcatatcccatgtgcatcatttagaaattatctagcaattcttgatgaactagtatctgttaagtaatttaaagcttctgtcttgatcctgtagttgtaagataacattgcctgtgtttacctgcttccattcattgcatcatatttgctttagttacaccaataagtgcaatccattggcatgagcaattgagcagtttgaactgaatgtcagttctctatccataaagtttgatgttgtgggctttgtacaaagcactagggcgagtttgcaccaccaattatgctgcagaagccaactctgcttcctctgtttgcaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagtgggtagaaataatggtgatgaaacaattcacggtttctcaagtttgtaacagtgcgcagaatcaagctgcctgtttattttgtttgtaacgtatgcaaattttgacaagtgcactgaacgccattgtggaaattcaaccgttctggcagggagaatgaatgaataggtttcccacgccttgcaaaattttccttgtgaatggattttgcttgcctattgaagtgggccatgtcaattggtaagctcttgttatcccattgctctaattaactgaaatgatgtcataacaggctatggcaggatcaaacaagcaatggctgagagctcaaagggaataagatcactattccagcaaatatcacttatattgattccagggcttatactaatattttttatggtaattctccaatcttattgctaaccacgcaccaagtgatctagggcggattctgtgtctgccatttcaagtaccggatcacatcaaacttatcatccatccattctcacttcctttcctatttgactatgacatgagaagaattctgaagtccgaagcccagtgatgactaatgactggccagccgagaggccaaaataccagatgcatgtgagtccgtcttttttgtgccggttcagcagatgcatgatactgatgtacatgagcaatccatccatcggttgctcggctgcaagtctgcaacacttgccggacgtattggttgattttgtcgccaaattcctagagatactccgtactagttagatttagattctcatcgttgcctgctgtttagtacgatccatgccttatgtgagcccgcttgctcgttcactccgttggaattttgcaattctgatgctgagccttgtttttaacgagtgtttggtccatccgtttgtgcataaatccgtgcggatgaagcctagccgcctaatgtatcttagaaactttgtgagccattcttctttagggcaaaagctagtaaaaggtaaatgcagtaactcgacgtggacagatcacctaaattcaggtccaaaactctcctattctacctacgctttctcgtttgccagtacagaagcatgtgatcaattttctcccattagtcgttctcagtactctgcaacaacagaagcatcatagacttgaccaaagcaattaagcggacacgtcaacaaaacaggcatcaaactgtccagaaaccaccttcctctgacataagaatgatgtgttgtgagagaacaagtattctacccgatctgcaactgcgtttaagataaggtaatccgtaatcttttacggctgcaaaactgtcacataaaagccacacctggatggagttctgcaactaatcgagaacagagtaccagcctgccctttttacttggtttacgagaagatgaacacaaagctacactcacacggcttatgaacaatgaacagtgatactaaaagagaactatagagaagagtgcttgcacgcacgccagtacacccctccttatctgaagcacactcactcgcactcgacgatttgtcgccatcggagaagccattgtgcaagatcatgtcgcattatgcgacggccccacgggcacgggggaggaggcccaccacttacacgggtgcggggcccattgccacgttgggcctaacaatccaattccccaccgctcgccgtaagccgcacggtgacgcagagacgccggcgagttcggttcactgggaggtggtggtggtgcaggacgaggcggcggccggcggccagaggcgggagaaggtggaggagacggcgattccggccacgttgagccccttggtgccccagtccggcacgggcacccaccaccactcgccgcgggcgcggtcgtacgacagccacacgatgtcccaggcgccacggcagttggagatgaggacgagccggaccacgccctcccgctccgacagcagcccggtcatcacggcgtacggcttccggaacccctccaccagctcgcccggcacggtggaggccagctgccagtcgccgccgacgaccgacccgaacccgtacaggtccacgccggccaccaccttcacccgcggcctgcccggctcgtcgatcaccgtcgaccggaccaccgcggcgctcccgtcgccgtacacgtggagcctgtcgccgccgccgttcgggttgtgcgggaaccgcggccggaagaagaccggccgctccacgcccggcccggagtacaccatcacgcagtccggcccggcgtgcgccgcgcacaggaacgtcccctccgtcccggccgccgtcgacgccccctccgcctggaccgcctccgatgactgccacgtgtccgtctcggactggtactcgaagaggagtggcgtgttgttcaccagctcagcgaacagaaaccttgtaagttaacagtaatcaaccaattaacaattgagtttgactgttcttcagcaatgcacagtagtagtagtggagtggagtaatacgtaacagtaattaattacgtaattactatttggaagatttccagaatcctcgggcgagaaaaagacgggtacctaaactggctcgacccggggggatcggcgacgagcttgaggccgaagcggcgccaggaggaggtgccgcgggggccgagcggggacggcgggaggcggcgggcggcgtgcgccgagaggtcgacgacgacgagctcgcggcggccgttggcggcgaagaggaaggagctgccggacgcggccaggaagtagaggtcctcgccgggtggcaccgcgggcgcgaggatggcggagacggggatgcggaaccagcggccggacggcccatggaacccccggagcgcggcgtcgcgggggcggagcttcttgaagacgaggagccacgcggccgcggggcctggcccggaggcggcggaggagaggtggtacaggcggcggaagtccggggaggagatgacgtgggagagcgggcgcgcgacggagcggacgcggaggagctccgggagggcgaggcggatgaggatgtcgtggaggagctccgacgggaggaggagcaggggacctagagcggtggtggcggcgctcgccggggaggggtggtggtcgccggtgaggtggtggtggtcggacatgggtgggggcggggatgaggtttagtttcttggggatggggttgtttgggggacaagtttcgtgggggttttgtgggtggcttttatacagagcagaggagacggtttttggttgttgacctgctaaacgaaatttgcgtttcatgcggttttaagatttatttcccctctaaatttgtactacatcgtttgtggttgagatgaaaagaatgtgttcgtagggcctgctttcatatagtttgtgttttctgtttagtgggcggtggatgatcaattccgaatatgcatatctacctagaaaaaaaagggtctaaatttgttcagtagaggcctagagggggaaaaatatttataaataaattcaaaataacaaactaaaattgcttgtcttgggcttgtgcacgtcgatttcaaaatatttaaaatgatacatcgactttgtcaaattatttcatcaatttttaggatcatttgcaccatgtattcggaatgagtgcacaagaatttgtcatgaactggaagtgtcctcagtatttataattgtgtgatccaaggacctagagtacgtgctactagaatatgtttttttaaatatacttcactaggataagtttatgcaaacgtataaaaggatattatttgtaactagtgtttctctgtggggatactgacattttgtcgctggtaaacatttttgtattgccaacattttattagtaccgtccatgatagcacaaattcctgaaattagtaatttgataaaaagaataagttgcatgcatctgctcctacaatttggatgctcacggcttctcttccaagaatatttagtcttcttgttcaagtaaagattataaatctagtagagctggcctatctcaacaaaacagggcgggaaaccaacagaattttcatggctccatcccaacaaagagatcatatataagggcgaaaataaatttcctgcatagacgtcagcaagcttatcgttgagtttattattcgttcttgagcaattgggagtttgggactaacataattagctgcattaggaagggtccttttttttccctcttaaagtcagaatcatgcacctgttatgcatatgcatatgatagaaaataaaacagaaggggaaaggcacaaaggcactccaggatgttctatccagagaatagcagaattgccacttggattatcaccaccaatttctcttctgctctttcacaggaaaatgtgtgacctgtgtgagccgtaagcccgtgacacgctaggtcactagcgtacgtagttagtctgtggcccttcaaaattttattttgtacagaggacgccaagatgaagcctgcatatcaccttgatagagaaactagaagtaagattcccttttttctttatttctcaatgatgtgtgttgattaaggcttggagtgtagagtgaagagtctcttctgtgcaaggaaggaagctagcagcagagctattggtttcttatcggaataataattagtttcccgttttttcttctagactcttatccagaggtcgatcaattgaccaacaatcgcttgcttggatactcaattatttggagttatacagctcaataattgaaaagagcattaatttgtgttgcttaggcctcggcttcacggtgatgcagagtcaatcggaagtcctggtgcatcatttctcatccctaataatagtgtgcaagtccctctagcagatgacggcaacacttaactgcctccccaaaccaacataaaccaagaaaccagagaagaacaaagcgaatatagttagattaaaataacttaatgagttgtaggttcgtgtcagactgaatatttgaggtttgcatgcagaggctacatctaaaactcctttcttcttctgctccaccaacaaatgatgagacatcaacagattatgccgacctgggtggatggttttgaggcacaagaataattattcatatacggttaaatcaaaacaagcgaacgaaagattatggccaaagattaggtgaagatgttgaaagatgcttgttttatggggtccaaagaattgctttcgtgagtggcaagaactcacgcatcccttgtgtgcaaccgagatattgttctcatgtggaataggccggtgcaacttcctttaagtacgcctacaaacctgagtttgatttgatttgcttggatttcgttatctcaggatctaattattatatttttagatccaaaatttgattttactttcgaggtactgtactaaggttagtgctaaaaggagatgtactcctattgaatatagttaatagacggctgccctctcctctacgaaaactctaccattggcagagcttaaccatcaaacaacaactaatcatagattcacaggtcgctcttgggctacctagacagcagctaataattaattactactaataaagaactcaccatcacggttgttgtaaacaatcacccgattttcagatgagaaacatttacactgcaagacatgggagacaactaataaccggattaggggcaaaaccaccccgatagtcagaaaccatggcctccgactccaagaaaagggccagattaacccataccagatctttggagacaaatcatttgtttaccgaaagtaagaacaaaaagcggaagaccaatcgaacaagacagagttattgtcctgtggctgttatattagtagtatactctgacgattgagacgggaagttgataaatttcagaaaattttgatgacaaagcaaagcacgcgctgcgcggcgcaacacaaagtttgggattattcaatggagagcatttgcggcctgtggccggcgttgtgcggtgaaaatgccaatttaattggaacatcgtgatgtcaaatgagctgaggaagaccccacctctaaaaacttgtaatattaaatcagagccttctcctaccctctagcaagtagaagacctaacctgcagattaaaccctcttgtagtcttgcagattaaccaagtggaatgcaaagctgatctaagaactgcctgaaaatcattagcgaagtaagggtcacatgcatgcatcatgccgtccgtcaccgaatgaaagccagaaacagcaagttaaaagttagtggcatactgtatagggtgtgggcaagtgctctatctctgctattttaaaattctatagtggtggcggtgactccaacactggcagacacgcggagtatgagccatccgatcgctaaatccaacggctcatatcgtctttcccgtcgtttgcatgcccccgcatccgcatccccatcgttcgcacaccctgtttttttttagcgtttctctccccctcaacaacctccaacgccgcacgcccgcaccctaatcgccgcccgcgccgtctcccacctcgccggtgtcctccgcgccgcccccaatctccgacttgtcgaccgcctccgcgtgtgccgacggcttcgccgccaccgatccggagtcgcctgagtcgtcgtcgcccccccccccccaccccaagccgatctcccacacccgcgccacctcccccatcgctgtttcatccatcttctcgtggtcgcctccgcgctatatcgcccgccgccccgcctcctctgcttcgacgcttatcccctcagccgccacctccgccgcggtcatcgacatcatcttcccgagcgcctgaggaaagggattcacgccgctacaatgccgagaccgagcggagaggtggtttgaggccagtagagctgtacggcaagttttctcttttgttgtctttcaatctcttctcccttccgatttgattttgattgtgatgagcaaactattttgacttatactacccaattgattttgattgcgatgaacgagtaaagctattttgcccatgcacatgaggtgttcgattgaatgccgcagaaacaatctgccactctgttcatggaaaaactttagaatccagtgtcaaaatccccaatgatatagtgaatcacaccctgctcatccagcatcggcttctttaacccagtaaaatgcattttaacaaccactgacggattattttgtgctgtccatagttccgatagagcaatcagttttgatcttgtaaattgtaagcacctaatttggagttcgacagctggcaacggcatgttttgtcagggtacccgtcgccaggacgccgccgacgccttacacggtgactgcttctcactgccactgatcctttctcggtcccacggcacggctgaggctgtggaatctagcaatcgatccgtattcttttaaactatatgctactgtatgtgtgcaggtggttattgatctccacgccttggcctacagcaatggacaacgctgttgggatccctaaactcatgatttgtatctaataacaggtaatgactaatgacacttcaaattgctcttcagcttttgcatccgatgtaatcacttttctgttgagtcacatccaatacttattagatgctaataaactaaatctgtatgacaacaattacagattgactcatctaattttctgacagtagatgtgctgacgttcctatattgcagttgaatttaacttcagaatattgctgccagcttccggcctcctcaacatcagatcagtgtttcaggtgtgtgtgtctcatttaaattagtcttcttttcctggtttgaaatttccgctttgcaaatggcacgagaattttaagtatacgtcagtgtcgatgaatttctcaaaacaaaaaaaagaactccagttcagtctgcattgcgtggtgatgcataacacacaatagcaagaggtttgctctgagagtcacaacgtcagtacacacatggatggtgaaaaaacactgataatttccctctgttatcctgaaagtaattttgaaccaatataaggatctggccacatgcatcgaagaggagtaaatgtgttattatgtgggatcctggcagtttttttttttgggctatcagattagagaaagcaaatattaaatgggggcaaatactagatgtttgatatcctatggtacaacattctcacaaattacaattaagaagtatcaatctcgatgagaaacagtgtaaatatatgtaataaatattgatatcaacgccattgtgaattattttgtgtgtcatggatatatgcattatataccatattattatgcattatgcattacttggaggctcttctttgcaccctcgtccgcctgtgagtcaatccttcacgccggtggcctcatcttccccacatctgtatgggtgaatatttaggggattgaattttgggtgattgttggataggataggataagtttcatttggtttgtgagtcgatccttcacgccggtggcctcatcttccccacatctatatgggtgaatattttaggggattgaaattttggtggctgttggataggataggataaggtacatttggtttatgtttagtgataggacgtaccggttggtcagatactgttatatacattttgcttatcatgaaggcaatccctttttattgcatttcagaatgaagcttcatcttacactgggtttctctgatttataatttatcatttaatttttcagcatttgattgaatttcttacattgggtttccaacaagtcgtcgtcgattactcgtcgtctggtccccttcgcgcctcctcgcccccacgccgctagccaggtaaacatctctccctccccttcccattccttcgttaattgcaaggttccccctccccccagatcgccatattcttctctcggggtgcagtgtgagatcaattaagaagaatcagcactgtctaggctagctcactgctgtttcattctctgttttctcattctatgtctaatttatcttcttgtaggctacagccatcctggtgtttttagtgctgcacctctctatatatatcctttctaggtaaattttaacccctaatgttcactttccccgagaaaatccaattttgttgctttaatttcaggtagtatataacctggttttacagtttataaactgatgcttcttgtgggatgtcatgtctctgattaatttattttttaacatatgcaccaaatatatgtctgttactgccacacatgttttatattggattcagtaaatatctcctattacttttcactgccatcactctaggaatattacactctccaacgatatatatctgagttgtgaagttactggttttacatgtctgtgtctgagttgtgaagttactgatgaaaacatccagactcaatgaagtgtgattactgcatttaggcggtctgatgtgttttgtttttcagaaatggataagattgttgggggctccacaacatcaactacaaaatcaggttagctatgtgcatgttattaactcgaatgtaaactctttgcatgctaatttcacccatgtgttcctttcttaggccctcttgctgacataaccaatataagtggttccggtttggcaaattgacggggcaaggttggaaacaagtcgttacgtgccgttgaaagatacgacgagaattgtgatgtctttacaaataacactcccaactgcttcaaatggtatcttttacatattgcttgtttcctattttaattcaatctcaatctgtatccaccaacaccaatgtgatgagtataaacttgtgatgctggccatgaagttgtgcatcctgtggtgacgcctaatagtcatccatgtgcggaaaaccgcgatgcgtccttcaatacacccagcaatgtgcatatgtgtacaggtttgcatgaagatgttagtcaccttagtgtggctgaactaaaaagaaagcgtgctagagaccggtacgcagcattgaccccagagcaaaaagatgataggaacaagaaggcacgtgaaagaaggaaaagaaagaaggaggaaactcaagtttcaggtacaactgtaatatttatctgtacaaattaaaatatgtctggccaattatgcgaaacaatattataaattctcgtcgtgtgaacagccccacttggcgatatttcaaatataagcgctgttgatataatgaagtgccaattggaagtgactgattcttccccgctgcatcaaggaagtaatgtctttattgtttgtacagtttggttgaacaatatattattcgactgaatggaaattgatagttctatgtttaaatagaaagtgaagcttcccatcttaatatcacaccaagacgtctcccatttacaatcatcaacaatgtagctcactatggtcccaacgaagtaccaatgagtcgcttcactcaaagtacctaaacatgaatacttctgactttgtagttgataattcaggtatgctaatatctttttattaatgggattacaatgctgttgccatttataaatttctatattacaatatatattactgactatgttacaacaggatgtgaaaatcaatatgaatccagtttttttgaaggcagcgatcaaaatgagtgcgaccacgatgacgacatctctctaggtaacacattttacttcatcacatgttttttttatataaacttgtcaaacataaaacctctttgcttacatatgagaagtgcgctaagttagttattattatctattcatgtttgtacaatttaatatttgaagtgagcaaacaatcccataaatctactcatgatgatgttggcacatcactagataatgaattggtgcgtgcgccaaccaatgagacaaaagaacgattgcagtcaaagctagctcgagctagggagaagtatgcaactcttacaccggagcaaaagcaagctaaggtggaccaacggagaacacaacgtcaatcactaacaaaagaacagagactagagttgaatgcccgtcgtagggttgcaaggcaatctatgccagatgtggaaatccatgatatgaatgcttgccgtagatcaagacgacaaaatgttactcctggggaaagatctgctcatctggcacgacgtaacgcactctatgcagctaggcgtgacaaaccatgcgctgaatccattgcactagagtgccctgagggatctatcccattgttgctaaatccaacgccttgcttggaaacaaccggtgatgtgccatctacatcgagcctgcaaactgagcatgctgtagatcatcaggcgcgatcatgcacattcaatgatggtatcatctatatatgttttcattcgtactcgcaatttgggggaatttaactatattccacttttagatttggcaactatccaaatgcccttcttaagtttgctcttaattttttgcccctcttagatggtggcttcttaactatttgtcactgttggccatgtggcaatccatggcaaaagtgccaattagttaagaaacgtaacaagggaatttggataactgccaaacctaaaagtggcaattagttaaattcccctataatttgtacccttccgcatactaacttctcatatctcattgtactaaagatgatatggattccttcatggatgatgactccgacgatgaatactacatgtttgctgggctaggtatcgtcgtcgtgatatcttaatgtctctttcacatgtataatttttgcggactataaatcctttgcgctaaaccataccaggcgacgatgaggatgacgagatggtacaatctgatgacgatgacacgcaatcaccgacctcttctgttcctgatccgtatgactatatgtacagcaacattccacaaagcacaaatgttctgaagcctgaacctgactgtaaacactgtggtgccaagaggttccagtacgaaccgccgagcttctgttgtcggggtggcaagatcaagcttgtacaaaatgaaacacctcctgaactgatgaggctttggacaagctcggatccagacgccaagcatttccgtgataacaatagatacttcaacggccacttctcattcactacccttggtgtaagccttgacaaggcctttgcaaacatgagttcgggcgtgtacacttttcgggctcatggtcagatatatcataatatacattctttcagtcctagagattctggtccagagcatctcgagttgtatttctacgatgacgatccaacattgagtcatagattccaacgttcccctagccttgaccaggatgtgattaggactgttgcagacgtccttcggaacaacccgtactcggagacatttagaagtctagggcaggctgaagacctcgcgaattatcgcgtgacactaaatctggatcataggttgcaccaaaggcgttacaatgtgccggtgacaactgaggtcgctgctatctgggttgagggaaatgagagaaggaagttcgagcctagcgtgacaatatacaggaacaaccgtacgcggaaatctatccagcctttctacgaatgttatgatcccctctcgtaccctcttttcttccctagagagaatggttggcatcaaagccttccaaaggacaaaataaccatggaggatgcaaacgcacggaatggcgatgatcctggtaagtttatcttcgtactatgttgccttagagaattgatcattgtgcgttacatgactgtactaacctagatgtttctcacgtgtagattgtaacagcaggatacgagtctctgtaagggactactactgctataaattccagatgcgtcgtgggattttcaatcctatacttcacggcggactcctgttccagcagtttgccgttgacatgtacatcaaggttgagagctcccgtctagactatgtgaggaacaaccagaaggagataagggcggacctgtatcaagggttgatggatagcatccaggctggggagagtcgagcaagcgcggttggcaaaagaactgtgttgccagctttgtttgtctgtggtggccgaaatatgaagcgtcgatacatggatgccatggctttagtatagaagtacgggaagccagatgtattccttacaatgactagcaaccccaagtaggatgagattactcgtgaacttgagcctggccagacaccacaagatcgtcttgatctcgtggtccgtgtctttcgagccaagttagaggacctaaagaagcagctgttcgagaagcacatccttggcaaagtcattgcacacgtatatgttgttgagttccagaagaggggtctgccacacgcacactttttgctgatcatgagtggtcgatacaagctaacgtctgcagagcaatatgaccgcatcgtctcagctgagctaccggacaagaaaaaatatccagagctatacaatatggttgtcaagcatatgatgcatggcccttgtggtcgactcaacggtaggtgccaatgcatgcgagatggaaagtgcaggaacaactacctacgagagttcaacaccacaacctcgcaaggcaaggattcatacccgttgtataggagacgtaatgacagtaagagtaaggtggttagaggacatcctctcgataacaggtgggttgtcccgtacaatccttatcttctacggatgtacaactgtcacatgaatgtcgagatttgctcgagcatcaaggcagtaaagtacctctttaaatacctttacaagggacatgacaaggcctcgatatccataaacgaggcagataaaaacggtgaaatcgatgagattcagcgctacagggatgcgaggtgggtgacccctccagaagccttgtggcgtatatatggttttgacatatgccacatctcgccgtctgtgaggcagttgcaattgcatctgccaaacatgcacatgttggctttcgatgcagacaaggatctccgtgatgttctggataaggaagacgcaggcagatcgatgcttacggcgtatttcgaggctaacaggcagcatgtctaggctcgagatatcctttatagagatttcccaatgtggtttacttggcagacgccaggtaagtactggaagaaaagagatagaggtggccaggtcgggagaattgtgtgtgcccacccggcagagggggagcgctactatcttcgggtgcttctaaaccatgtgacaggatccacctcatttgaagacctacgtactgttgatggtgtgctcatgccgtcgttccgtgctgcagctgaaagaaggggtcttatagaggcagacaacaccctcgacgagtgccttacggaggccggtgtctaccaaatgccggcgtcgctacgcaggttattcgctaccatattggtgtactgcgaacctaccgatgtccgtgcactttgggacaagcatctagattccatgtcagatgtaacaacgcatgcccttatgctgtccaacagatggtgctgatagatatccggggcatgctacaatcaatgggtaaggaaatctcatcgttcccgctccctgaaatagatgaatcacatgatagtactcgaggagatcccagagagattattgaggagtcttccattgttgtggagagagatgatatgaacctcccagaccagctcaatgatgagcaaaggtctgcattcaataaaatcatgaacgcggttggtagtgctcaggggagcgtgttcttcgtagatggcccaggaggcacggggaagactttcctatatagggcgctactagctacagtgcgtggcaatggtgatatagaggtggcaaccgcgacgtcgggtgttgcagcttctataatgccagcaggccggaccgcacattcgcggttcaagatcccactcaacattgaggaagggtcgtattgcagcttcaccaaacaaagtgggacggcaaagcttctccagatggcatcgcttataatatgggatgaggcctccatgacaaagaggcaagcggttgaggccctcgatatgagcatgagagatataatgggttgtccacgttctccgtttggagggaagacgattgtgtttggaggggatttcaggcaggtgctcccggtcattaggaagggcactaggtctcagataacagaagccactctacgcaggtcctatctttgggattgtatggttcaattaaagcttgttcgcaatatgagggcgcagagcgacgcgtggtttgcggactacctccttcgagttgggaatggaaccgaggaggtgaacaaggaaggaaacataggccttccttcggatatttgcttagagtgcaaagggaatgaaacggacctcgaaaggctcatcgataccgtgttccctaacctaaacgataacctgacggacccaaactacatcatatgtagggccatattgtccactcggaatgagttcgtcgatcgaataaacatgaagatgattgagcggtttagaggagatgtgatgacatatcatagttttgactgagcagaggatgaccctcataactattacccgccaaaattcttgaactctctaactccaaatgggctacctccgcatctgcttaagctgaagataaactgccccatcatgcttttgaggaacattgacccagccaacagccaacggactttgcaatgggacaaggctggtggttcgtcagttcggaaaaaatgctattgacgcggagattgttgtagggcagcatgctggaaagagagttttccttcctcggatacctctatgtccttctgatgatgagatgttcccatttcgcttcaagaggaagcaatttccggttagattgagctttgcattgaccatcaataaggcgcagggtcaaacaattccaaatgcaggcgtctacttaccagagcctgtcttctcccatggtcaactatacgttgcactgtcaagagcaacctctagaacaaacataaaaatactatcgatgccggtagaagacaagaaacaaaagaaaaagtctaagcgtactggcgtgaaggacaatgagaagaaaggaaaggaattgtctaaacaagctgcaacatacacaaaaaatattgtgtatagagaggtcctcacagattagaaaaggtatattatgtgactaattaaccgtccacaatatgcttgcttaaattccattcttactgtaatttttatattccatgtctaacatttcttgagtttttttccttggacagcagtaaacatttactttcttggtctgccccttctcctgtatatgcctacatccactccttccccgagcagtccctccggccgcctcctcgttatggctgactcagagaccaaaaccgttgtagtcggctgctcgccgaggagttgcaggtgatcaggtaaagatatttttctatcagtccttggtgaaccaccctggcagctcttcccttgctcattatttcttattctttgctaataggagagaagcagccaggtccaggatgaagcaattcactgttatgaacaaattcaagatgaagtccttacttgtaagctgacagttatttcttcttcttttttaaaacaatcgtagttggtttgtacatgtcttgcagcttagtactgatgttagcagatttatgaggttctgctttagttcagatttccaattgcagtttagcatttcttgtaatcatgttgtggcagtccagtttccagtggggtactgaataacacttgagtggagatcatctgaactgaaagccaacatttgagctcatgctattagcctattactatatcaaataaaactttgatctttatcaaagaaaaaaattatacaatttttgtttctatcattattttggtatgagttttccctgctcatgctaagctcacttctgccaaactatttgatgtttctagcaagagagtcaaatcagtgatgtctttatttttagaatcaagaaacatgaatattcatataatatgcaggtcttcagtgagtgttaagttttgtgtgaggacgtaagcaggagccaggaactgtgagtactgatttgtaacggagcacatttgatcagtaatttgctccatgtgaaaggagcttcggattcagattaggtcagggattaatatgttttgctcaactggctattttatttaattgcaaatttcagtttgtcaaaccacttgtaaagttttttgcatgttgtacatgcatttggtaataaccatgaagtcatcttaggtaaagagtttgagcattactgttgcctgctccttaaattttagtcagcgagttgttctgaacactaattaaattatgttgaatgtagtttccttacgatgctatatttgtcttttcaacgccagattttatcctccgtgatcaacaaaattccccgtagcaacgcacgggcaccctactagttagtagcaaatcgtttgaaagtgaaggagtcgtctgggcaatatcgagttgtcgactgctcaagtggaatcttgttgccgtactgtttatgctttaaccccccctgctgccaacagatatggtgccaaaagaggcctaatttcatccaccaaagttagtgttagtgatcgcctttgtattttatttttctttggtcggcctgtcctttttggtagccacataggatgagttgacaccttttgttttcttgccaggggttaggttttggttaggggcccatgcgttttatccgtgcgaggagaggaaagcatgcctttgccaagtcagcttatatactagtactagtcgatatgggttcagataatctatttttcaattggaaaactaatctataccgagttcttcgcttcaatattccacgctttgtctctccgctccagaacctcaaatatgttaaatacgttttgtcgtctcgtctcgtcttttaccgcaacgccgtcgcggagcggctcggcagcagccagcaggtgatcctgctttgctagccggaagacgcagaattagggggagaattagcgtacgtgctcggcttctctgccctgctctccgctcatatgattgggggtgtggaactcatcccacagccggagaagccggtgcacatgtacacacggtgccgtcgcacgcgccgcgctcacccagacaggcttggaagttggatgaggaggttgggggcaagtcagcagtgctaggcagtcggtggtgttggcgccagcggcggccgtgcagtcgcagaggaggcacggcgtttgcgggtggggtggccttgcctaggccgcgacgctgtaccgattttcttggcacgacccaagttggcctacgagaattgtgggtcggcctcatgtgattcttgccggtgtcgtcgctgggtcgacgtcggcgcgacggtgcgaggctgcgggcggcacgggctaacgcctcggcccagatctttcttagaggattcgacccagttctgcgagtgaaacagccagttttatccagcaatcggccgaggaagaaggaagttcatatggcaacgtggatatttttcttttgaaaaattccattttacccccgaactattttcgtggagcactaacccctaaacaatttctctgttcatttatcgacagaactattgaaaacgattcacgttactccttaacggtatttctcttttttctctatatataagttgtgttttgcaataaaatttggaacttttgatagattcattacaacctactctctccatgttaaaataaattaagctcatatttagattcgtagtactaggatatatattgtattaggctaacttattttttgatagaggaagtgcctcctaatatttttagaattttattaacattgtttacataggttagaagcactagggctgatttaaacatcagggttttaaatttcaagcaaataatcatgagaaaattaaaatattataaaactttaataatggtgtcatctatggctacaaaattttagcttaaaatatgtctcatataaagaaaaaaaaagaagagaaatacaattaagtagtaaagtggaacatttttaatattttaggggtaaaatgagttaggggtttacgtaatcgggtgaaagagtttggggaagtaaaatggttttttcactccttttttttccttggatctgcaaggcagatattaatagagttaataacagggtaggatgggttaggttggagaaagacagctccacccctcacccttgacctctcattcctcccccgacgaccctagggtcggtgggtcctaaccctcgaccgggccctgtcagggaagataaggtgacgtccgggaggctaccacgttagtggagcactagtagccagtagccaccacatcgatatggagggagaaaataccaaggctagctgctatcggggcattactttaccaagaagaaggtagagaccggttgtcgtattgggggagcgtcgaccgccacgacattgggatggaagaagagaagataaaggcggatataatgttgaaggagcacacaccagctgctgatattgctacatcagaatggggagaggatatcatgggatagaggcctcaagaacataccgactgcaacttgtcagggtacgaggaagccaagtagttagtaatgtacgatgacgagtatgggatttaggcataatgatactgataataatagcatgttggaattcgcttaatgggttgatggccttttttaattgtaaacattatctcctgtcttgaataattttagggcccatgagtcacgtgtgggtggaacacaccattcaaccccatgtacctgcaagtgggaaactcaccccaccccatatggggacacgatgggtatctaatttcaaaggaaaattgtcacctctaaatattatcatcaatgtatcactattatacagaagacgtgtacgcgtgtgcacaccattatgcccacacatgtgtgaatacatcctctaaaacaaaaacaaacagaaagccaactataaataaaaaattttgtattaaaaatgcatccatgtgagtgtattatggccaccaggatttcaacgctgatggatggggtgcatgcatccacaatttcatctccacaatctgtttaattcccgggacttttttgaattatttgtaaacaatgttgtgtatgtggtgtacttctttttatgtaatcgaaaatgtgcaagtattggtatatcattgtttttccccctgaagttggatatatggaatgcatttttcttgttaaaaggcatatgaattgaaaaccatttaatctattgtcccaaccgtagcctgaccacgtcgcgactccatactgtgctattacagaacaaaatggggtgcgcatggggcgactcctgggcgatgccacgtaggataggaacaatgttagggttggaaattttacgaaaaagtcctccgatttatccgtaatttgatctcggtccctcatgaacagtatctctgagctgatattttacgtggaagcccttagtaaaaccggatattccatacgaaggagagaaaaatcgtgaatttcaaaagaaattaacagaccactgattccatgatcggtctcgtgacactccgcgtgaacctctgttcagatgcacctcgtactgaactgtgcgcgggacagcagctgcagcaaccaaccgaaagagactcccagcagtccccccccccccc

SEQ ID NO: 61066 - DNA, 6820 bp, Oryza sativa
agcgcgctgcactgcgttacatgcggcgtgacgcgctcgtccaaaccgcaataaatgtggttaggtgagccctgctgcgctcacctaacccatacacgcggcgcaaaatctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgccaatcacgcacatcggcaatggtaactcgactgtcaataatgagcggcctcttcaaggttgccacattactcgagtagcacgcgaatcgggacgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagagagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccttcgccacacgcgctcgctctcaaacatctcttcctccggcgtcatggcacggggctccgctttgctcgatggtagcgtgctgccgccttcccgcatcgtgagcgagaggcaggccgggctgccgcgccgcttcatgccggaatctgccaccggccgggagatagtcacgctgggcgagggacgcccggcgccacactacccggggcggtccgtcttcttcctcccttttgcaatggcagggctggttccgccattttcttctttcttcatggatgttcaggagttttacgatctccaggtggcgcacctcacccccaacgcagtaatgacattggccatcttcgcgcacctgtgcgagatgttcatcggggtgcgcccatcccttcggctgttccgatggttcttcaccgtacagtcggtgtcgccgccgtcggtggttggtggctgttacttccagccgcgggggccggtgctgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatcccaggggctcacaggggccatggtgtacggcgactaccttcgtcgccggattgcgccgctccagcggcgcgcccggggcgcctgggagtacaccgggtccgaagactatatgaggacccatcagggagtcagatgggactgggctcctgaggatttcaagatagtggtccaacgggtgctgaatctcagctccgtggaggcatccctcattccccaaggagtcctccccctctgcagcgatccagatcgcgcctccatcctgaccatcatgcaggcggtcggggcgtcggaggagcgggctcctcgaagccacgatggcgcgggcgggagccgcaggggggaacaatctaccccgggagggggtcgtgcttctgggccccgcgacgggggcccggggagcagccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggctgtattcattctctcaacgcgagttttcactcacccatcttgtttgtcttctggtctttcttctgtttcagcgagatcccgtcgcgtccctcccgccattccaagtccggccagtctgaggccgaggatccggcggccgcagaggctcggaggcgggaatctgaccggcgagaagccgcggatcgcctacgggaagccgaggaggccgctcgggaggccgcccgggctcgccaggccgaggaagccgctcgggaggaggccggactccgccaggccgaggcgacgacatcctccgaggcgacccgtgaaactgaccggcaagaggccgcggatcgccttcgggaagccgaggaagctgcccaggtggccgtccgagctcgccaagctgaagaagccgctcgggaggaggccaaacttcgccaggctgaggcgacgacgacttccgaggcagctcgcgacgaggccgcgggcgcatcgcttgggcccactccctcgtgcgacgctcaggacaagccaggtccgggggacatccccgagtccggcacgtccatcggcgggccgagccgcgcggcatcctctccgaggcggctcttccccacgccttccgttgccccactgagcgcagagccccttctgcaggccttggccgtcgcgaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagcttgaagcccgtcggaaggtgctgggggagatcgccaaggaggtggaggaggagcggggggctgccctcatcgccaccaccgtgatgaacgaggcgcaggacaccctctgccttcaatacggaagctgggaggcggagctagggaagaagctcgacgccgcccggggggtccttgacgctgccgctgcccgagaacggcgggcggcagagaccgaagtggcatcccggcggcgcgaagaagcccttgaggcccgtgccatggcgctggaagagcgtgcctgcgccgtggagagggacctggcggaccgcaaggccgccgttgccatccgggaggcaacgctggcggcgcacgaggccgcctgcgccgaagaggagtccgcgctccgcctccgcgaggacgcgctcaccgagcgggagcgagctctcggggaggccgaggccgcggcgcaacggctggcggacagcctgtccctccgcgaagcagcgcgggaggagcaggcgcgccgcaatctggaaggtgcccgcgccgagagggccgcactgaaccagcgggccgctgaactcgaggcgcagacaagggaactggacgcgagggcgcgcagtggcggggcggctgcgggcgaaagcgacttagccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccgggcggcaggcgggtctctggggcaagcggactgcgaagtacgccgctaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggatcccgacttctccccatggacggcgctggacgagttccctcccgggaccgaggacggcgcgcgcgcgcaggtccgggacgccgccgaccacatcgtccacagcttcgagggttcggcccctcggctcgcgttcgccctcaactccgacgaggaggacgatgacagcggagtgggcggcagtggcgacgaggctggcgacccgggtgcattggattgagcccccaggcccccgccaatctttaaatagttttttctttcttcttccgaggccttcgggcccccttcttgtatagactaatttaatctgcaatcaaataaagaggaaatttttgtgtcaattctatttgttgtgtgtatgagacgaggatggtctgtgccgcagtccttttgtgtcttggcttgaacaaggactcgtgcccaggtcccagtcctcaaatggctcgggtcggggctagtgcctggggagatccacatgtcgagactggccaggccgggagcgtggtgaccgagggttatgggtgacccgattgtgggtttttgccgattccccccccggagttcaccacgccccggggcacggctcggttctgggccccttttggcgattttagccgacccgagcccccgagggcaggattgagcacgagtgacctatttcaagtcaagattcttcaaaaagaaataacagcacagacacagcctttaggaaattgaaaatgcttttattaaaatacagatataagagaaataagaatatgcatgtgtggtagcccccggccaaccctgcacgcccgaggggggtgcggggttggcccgagcccgaaacctgacacccgatcccccttaggggtagaagcgacgaaggtgttcgatgttccacgggttaggcagctctgtgccgtcgccggtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggtttgcccagagcaccgctggcaactcctcggtccacgaatcgccgtgcttcttgaggatgttgaaggtcttggttttaaggcctctgaggatttctgcattggcgcgctccacttggccattgcttctggggtgggcgggggaggcgaagcagagcttgatgcccatgtcttcgcagtagtcgccgaaaagctcactagtgaattgggtaccgttatccgtaataatacggttaggcactccaaaccgggctgtgatgtccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcaccgccggaccaggtcgaccgcatcattgagagctgtcggccaatagaaaccctgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcatttggagatgcgctggacgcgttcactcccttcgcggtcctcgggtagagtcttatctgtgaggtatacttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctctatacgccgtacttggcgcacgtaagcgtccatctgcgggtcagagcaccggtactccttacagacctggttaacgaccagctgggagtcgcctaataccaggaggcggcggatccccagtccagctgccaccctgagtcccgcaaggagtccctcgtactctgccatattattggtcgcccgaaagtcaaggcgaaccaggtatctgagaacgtctccgctcggcgaggtcaacgtgacccccgcaccggcgccctgaagagacagggagccgtcaaactgcatcacccagtaggcggtgtgaggcagctgcgaggggcccgagttggcctcgggaatggagacgggctcgggagctggggtccactctgccacaaagtcggcgagggcctggctcttgatagcgtggcgtggttcaaagtgcaaatcgaactcagaaagttcgattgcccatttcaccacccgtccagtaccctctcgattatgcaagatttggccaagggggtaagacgtaaccaccgtgacccgatgcgcctgg

SEQ ID NO: 61067 - DNA, 11486 bp, Oryza sativa
aaaaaatattttttgaattttactagccatcctatacatggttacacatcactacctacaaattcacaatttttcacacaatataacttgtatgctacaagtgagattcgaacttaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatttcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatttgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgatgagttgcgttggcccgtcacagatgacccgtcactaaagcccggatctgtagtagtgtcggcaagttttttgttagtatatcttgtttctgtgtcctgtgttttctgtacgtacgccttatggatgtaatgttcaaataattaagcgaagatgaagtgggagagcgaagatggctttctaaacggagacccacgagctatgttatgttatgttatgattgctctccttttctcggttcctcggtgttctctttttttcttgttcttgtatttctcttgtttcggctggtttgtcagcctatcgggttttttaaaagaaaaatggaagcgggggactagagtattgccaaatatattaaaaggatagtgttgaacctgtttgtaaggaaaatcgaaaaaaaaaaccatactaaagtgaaaccgacgaaaacattacgcagaagacacagaaagtctgagacaaaacaactgcgaaccgcagaagacgggcaagcaaggctttcgccccggactccctcaaaaggtgcagaacttctaagaagccaaagcaaaactctcgcaccatggagagataagcacaccgctccaatctcagcaccacaacgagttcaataagccacaggacacgtgaagcaccggcgaggcctaagagacctaactacagacaggcaagaccaacaccgtggacgaacaaactcctcaagcaccgaaagagaccacggccagatctgaaagcagatggccaagggaaggttttgtatagtttcttttcaataagattcaggtggggagttttcctccccggtgaccgttaaacaatactccctccgtttcatattgtaagactttctatcattgcccacattcatatatatgcatatatgtgtctagattcattaacatctatatgaatatggataacgctagaaagtcttacattgtgaaacggagaaagtaataactaagtaattgtaatcgaatatttgttgggataaaatatgtactcaaatattgttaccaacaaacataactgtatttttcagttgttccaacaactttgaaccttccaaatgtttccacaaatcttaccttttatggcagttcaacttcttcgcagaaaaatcttaattcaaccaaatgggatgtactaccgcgttcataagggcatgtacaaaggtagagactaaggtggtgtttggatccagggacttaactttagtccctgtctttagacactaatttagagtattaaatatagattacttacaaaactaattacataaatgaaagctaattcacgagacaatttttttaagcctaattaatccataattagagaatgtttactgtggcatcacataggctaatcatggattagttaggctcaatagattcgtctcgcgaattagtccaagattatgaatgggttttattaatagtctacgtttaatatttataattaatattcaaacatccgatgtgatagggacttaaaagttttagtcccatctaaacagggcctaatatgagctctctatattaattaatatcactagagactatccttctacaatagtagagacaataagatttctaaaccattaatgcactaaatatttttttattatgcttctttccttttctataccctcatgcaacaaactttctgttaataaatgctaagagtcgactctgagccgttgttatgcgtagcaacgatgtttctcattccttccttctctttcttccacgtcaccaaatttacttgcatgacaacgaagagagcccgttattaaacaccattgtacatgccctagtattgttcttctagaaactgactccctgtagaaagacttgagattaatttgatagtggtcctctctctaccattcattagaaagatgatgctacatagaggtcttgcaggaacatcaatcatcagaatgtacatgatttgcacggtaacattactccctccatacacattataagatgttttgagtttgttctgtgttataaaaatatactaacagcatccctaactcaaaacaaatgtgctacataaatatattcaattgtggatttaatgaaactaattcggtgttatatttgcatattgtaatattattttttttataaattaggtcaagtttaaaaagtatgacttagaacaaacctaaagcatattatcttataatttggagcggagggcggagggagtagtctacttagaagtacaactatatttgtcatacaactccgacaactatttgcatgtttcttatgtaactgtaatgaccccctactcccctagtagccaactagctagtgtgtcacatatgggctattattatcaatattttcaagaaagtattgttattgttactataattgttaggttttgaccatatactattctgtaaatacgttggttgtttttgaaattatagggactaattagattggattaaaagaaaagtccaagttagggacaacatgctagtggttaatttctaatttagaattaaataataacttgtttatataattaagagtccaagacagtgcaacttcatatgtattagttttaaattttagaattgttcaattttggaaatagtaaaactaaaacatcaatgttatgtccaattacttattttatttaacataatctcttaattcaatggtcatgataatgtgattcaccttataaggagattccttctagttgatctcggggctctcccaaagagtatgaataaaagaataaaaactaaaggatgtgaccacgcatattttaccacggtatttccaattacatattttatttaccacaaactctcagtactatcagttttaggtaaaccttgagaaggagggcatgaagttaatgttttatattaagaagaaaaaggaatggacctagtttataagaaaaaatgggctagaaaaccaaacaaacgcatggttaattaagaaaaatcggcaaaatctcacatagaaagcgaaaagagcatgcggtgacacaactacatagactggccacaagtcatctttcccaagcttatcacgaataacaaacagctctgacttcctatgacgtacggacaactgtctcaaaaccacctaacactttgattgtgtagtaggaccttctggatgaaacctcccagaagaaaaaacaacgtcaaagacactgccaacacccattcggtaatcggactaggtttttacgtgaatgaagagaaccactatcatgattcctccaaggaggaaatggtgtccacaaacatcgacatcactggcaatggtcatagaggcttttgcccaaagctgtcacatctgctgaactcgtctagcgatgccataatgaaggtattgtgggttatcgttgttcagctcgccataccggatgcactagctccgagtccaccataactttatcattccaactccactccacatctaaaccctcaccacacagccaggacgagaaccctctcaatactatctatgaatcaactaatcgacaactacttaacatgacagatccctcaatggtccctatttcgaactaatactattttgaaaaatactaaactaaataatccaatataactttcccgaatacctgagggtataccatactcgtatgcttcgcaaccccaaggataggaggtatgcctaatctgtaaccctaacatgaagttactaggtaccaaattttacactagaaagtacctcgaggtaccaataatttgtggcatctcaaggtaattaacaatgttggatgacaaaattgcttttcaaaatataagggatttggttagattggacacatgttggtactataaatcttaatatcgtagtaataggattatgtcacatctaaccaaatcatattttaagacgaagcgagtacctttccatataccatattattgttgtcttgcagtagccgattgggcggttgccattaaaatcatgccagaccgtagtactgctccagttttcattccctccgtcccagaatataagcatttttagcatagtgttaagtcaaagattttttaactttgactatcaatataaaaaataaaaaggtcaaccatgtaaaattgacgttactagatttaccattaaacaaactatcataatatgcaactctttttatttaaaacattttatttctatagatattgttggtaaaaaaaatatcttgaagatcgtgtcgaagtccagaaatatttatattttaggatggagggagtactacacttgctccgagttgacttgacctgacttgtaagctagcctttttaagtccggccacttggaagaggacagacaatgcataagcatcaatgcatgtaggagtaatctacaacacatgcatgtcacagacgtcgttgctgctgcagctaccgttccatgtcgtgtttagaccctagcaagtccaccgcgaatggaaccgttccatggacttgctaggtcacgttcaaatcaatgtatatgtcccaacatttcaacatccacttgtacaaacccgattgaaactgtcaggtcggagcgaaacagccataatgcaagtcttcgtcgttccatcgctgtattactttaccagaaccgtgtgatcgaactcccaccagctatcccagagtcgacttgacctagccagtccaccgcgccctgccccctccaacgatgcggccgtgtacgcgtacaagtgcaacacggagagctagcagaggcacgtacgtaaaaacagtgcaacgtgtgattgcttgctgaccaagtgaccatgtaaaaccgatggcaccatgcacatcctcacgtcaccagctagctagcttcggaggacacctgcgtacaaccagtaggaaagccaccgtgcctgccacatctgcgaattattgcgcccgtcaccggcgtcggctaccgctgcaaccaccagtccaccaccactgcagcgacttcgccatccacgaggcttgcgccgaccgcttcgcccgggacacgatccacgggttcttcgcgcacccgcagcacccgctaagagcatatacaatagcagactataaaccaacatattttaattaattaagaagataaaagagaagagagaaaagtagcggtgcaacacggactgcaagattacttctaattaattcattatctcttggagtagccgattggcattaaaatcagagttaacttgacctgacttttatttcttccgtcccataaaaaacaaacctaatatgagatatgagatatgacctgacttgtactctctccgttacatcccgtactcttatttatagaactagaatatgtcatatcccatattaggattggttttatgggatggaggaagtaagtcttagactgcgattgaatcgtggtagtatctttcctcttcggcacgaaagatgatgtgatgacccattaactacgttttagctatagaaaaaaactttaaaaataatttaatataatttttaaaagtaatttttatgtagaattcatttttaaaaacacactgttttacagtttgagaaatatatacttacgaaaatcatgaaaatagattatggaggatcgaacatagccggccggttagaagggcctgtttggtacagctccaactcctaatttagctccaggagttgagtctagagcggagttgtggagctgtctaaacccagttccacaactctagtttattttgtgagagagctccacccagctccattcccattattggtagagctgaaactgtttagctgagctccagctcctggagaggtggagctggagctggagctatgccaaacaggcccgaagcagcgggtaccagctagcctgagttatttgtgctacactcaaaacgagatagtacgtcattagtgacttagcgagtgattagttgaatataatcgattacaaacttataaatagatttatttgatttttttaaaaaaaaattataccgactacgtccaaaaatgtaaaaatttgcaaggttagatacgagtatcaagaaaacaatgtggaattaaatgagacaatattgtgattgatagagaataataagtagaggaagacattcagccccatcgtttcgcttatatatacttatacttataagcaaaatttaaatactaaaacttaattaattttgtggtttcttttatcttagtttatattataacatttaattttgattgctaagggaaagtatatgaaaattgtaagcacaaattattatttgttttgctaataagccatatgtacaagtataatcataaacgaaacgatatggatgtttgaatatggtgggaaagttgttatattttacaacaattttaaatgctataagttattatattttgggatagggaaaatatgtagaactttttcgcacgacgcatgtagttaagtaaattttcagaatttttgactagccagagttcagctataaggacgataccttaagttctcaaattcgactagagtaccagcatgttgtaaattttctgaattttcgatgagaaaattccacatgtcacagtttgctgctgttgcattccatgtcgtgttcggtacgtatttagtactatttactacaggttcaaatcaatgtatatatactacatttcctaacatttcaacatctcttgtacatacccgatcgaaactgaatcagaccggagcgaaacaaccgagtctcccgttcgtttcttctgtaaaagtggatgaaaatttggatactcatgacacgcttttcaaacggttaaacggtacatttcgtgcgaaaactttctatataaaagttgttctaaaatattagattaatccatttttcaagtttgtaataattaaaacctaattaatcacatgttattaccacctcgtttttctgtgaaacacttaatctcttaatctccatcttcatcttcctctctgtacttattacccgaattaaccgcgtgaacccatagttgactgaccttgtaaaagctcttgcaaatccactgtctggccccctccaaggatgcatcatgcgtgtatgtaagggtctgtttagtacagatccagctctcgctccatctcttctagagttggagctcagctaaacagtttcagctccacctaaaatgggagcagagttggacggagctctctcacaaaataaacacagctccacaactccactccagacccaactcctgtagctaaatttaggagttggagctctactaaacaggccctaagaaaagtattttcatctggggatatcctttatttatttcttacatgatatttaaatagttattaaaaatatatgaaaaataattaacaagatagattaattatatgaaacataaggtcaaatgcaacataaaaaaaagaacaagttaattaacttatgtctatgtatgtaagcgtgctcttctctctgtgtatatatattggcacccggaactcaaagcgcaacacaaattaagagcagtgcacacgtacgtaaaaacagtacaccgcacgagctatacgagcgagagcgatcaagctatagtgattgctggccatggaaaaccgctggcacgttgcacatccacagcaccagcttcagaggtgcacatacaaccagcgggatcagatcagccaccgtgcctgcaacatctgcgagctacccatcaccggcgtcggctaccgctgcaaccaccaccactgtagcgacttcaccatccacgaggcttgcgccgaccgcttcgcccgggacacgatccacggcttcttcgcgcacccgcggcacccgctaaccgcggttgtggcctcggcgaaccccgggtggtgcgacctgtgccaggggcggatccagcccggccgcctcgtgtaccgctgcgcggagtgcgcgttcgacgtgcacccgctgtgcacgctgctgccgatgaccatccacccggccgccgggtgccacgggcacgtcctcaacttggtcccggcgcgcggggagtgcgcggcgtgccaccgggactgctccatctggcattaccggtgcggcctatgtctgttcatgctccacatcggctgcgtttcgccggccggcgccggcggtgctccagctggtgcgaggggttggcctgccaccggtggcggcggcggctgggccgccggtagcagtcccatcgtgaggtttctgatcatgttcgcccggcaactggcggtgaatttaattgtcaatgatattacggacatcctaaatgcgctatagtaagatgtgtgtgtgtgtttatataggtgattattgtgagcaactgatagcaccgggatggttgcataagttgcaagtaagtgggagtggattgaggggacatctttttcttctaaattcgatgcaaatagttgtgaaaaattctgaaaaaaattaaaaatgtagagtataatgatacctactagtccaccaaaattcatgttcaaattcgatctacacatcgagaaacaaaaaagacaaatttatatataaacagttcgctactattcatacgctgaatttgtcttttttatatctcgacgtgtgagttgagtttggacttaagattttgtggagttatatatatgtgttgtatgaatgttgtcaaatttttctagaatttttcataactgtttagatggtttttgagcaaacgagaaaacatcccctcgagggattagaatagtttcccgcaagtaaatagatatttgagcttcatctttcgtaattggtgttctgggtgcgaggagtgggtgatgatgctcgctatcctagcttggagagatgcaaaagatgttagaaattttgtgctagtttttttttactccctccgtctctaaatatttaacgccgttgacttttttaaaacatgtttgaccgttcgtcttattcaaaaacttgtgtaaaatatgtaaaactatatgtatacataaaagtatatttaacaatgaattgaatgataggaaaaaaattaataattagttaaattttttgaataagacaaacggttaaacatattttaaaaaatcaattgcgtcaaatatttagggtgagaggaagtatctttaaaaataatgtcaatatatataaagcaagaaacatctatttgctctcgagatggaaagcattcaaacagtgacgtgtgtatgaatttttttagcctgaacaagccttattagatataaaaactatatatatgcacaaaaccgaacaataacttcatagactatttatcatagataacttcataacagtcactgatgatccgttagaggtgagcggatcctgcgtagtagtttattgtccacgaaagataaggtctgctatagagttgtgttgctttggctctatggtcacagaaatgatggtttagcccttgttttgcttgttaatttattgagtaattatataattaaccttcagtagaacaaactaagtaatgtaattagataaataataattagtaatatgcatatataattgtgggtggtgtgaaaatgtttatgtaatgtgtatggcatcgtttgagttttttatttgaattgaatatagattggagatatggagtttgttttccatgaagagctcatccaataaatccacacagctatattttagatccaccctataattaacggtttagattttttttctcatattaatatgtaatttgagagcaaacataaaagcttatttctttgcaattacactttaataagataatagtctttcggtccttccatttcaaaataactttaactttaagtttagacttggacgttcaaaacaatgtagaagaaaaaaacaccaaagtgtcgctcactaataggaaactagtatatatgcgtggataggtagataggtaggtaaggataggtaaaagatattgatggagtaaaaaaaattcatcaaattgtggattagagcatgataggtaagttgataaaggtaaacttattttgagacgaggtagaggctaaaagtaaagttattttgagactaagggggagtaagataatagctagacttaaaaataagtagaaactaagtcaaaacaagccgcatatgataattttgagttacatttttacgtgttgtacatgcatgttgcacatctcacattttttttaaaatatttttatgtacatttaagtatacacaacatttacaatttaacgtttgtacaacatgtactgtatattaacgcacaagcaatatgcttccatatatgaaaatatggagaaattagttcatgctttgactctatgaggcattatgacggagctcgtggctcctcaccgggagaccgcgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgttttttgtggatctgtgta

SEQ ID NO: 61068 - DNA, 15516 bp, Oryza sativa
  unsure (1)..(15516): unsure at all n locations
cagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgcattgttgtggccttctttttgtcatgcactcgtctatgctcaactgcttggtttatggtgatgcctgctgaaaaacctgaattttagctgatgccggctgtacgcggccgctgtgcagacatatctgggtgaagtctgaagaccatacatgtgaattttgtagtaggataaagtgagtgaaaattacgggtgaagtctgaagaccatacatgtgaattttgtagtaggataaaacgagtgaagtctgaagatcatacatgtggattttgcagtaggataaactgagtgaagtctgcagagcatacatgtggattttgtagttggataaagtgagttcagacttcaccccgatgagtttgcagtaggcaggatcaactgagcaagtcgctctggatagatttgttggagaagaattgccgcttgggatctggaacattagctagacgatggaagcagaagcgtgcagtacactactgtagagtgtacaggagggtgattcctggatgctagtacctgattgatgaaagttgtatacgatgattagcttcacaagaatgtggtgtgcacctggttgtgggccttgtggcgacttgactactactagtagtctagccgtctaggggtgtgtttagtttctgaaaaaagttggaagtttgggaaaagttgaaagtttagaaaaaaagttaaaagtttatgtgtgtaggaaagttttggatgtgatgtgatgtgatagaaagttgaaagtttagggtagtttggggtgaactaaactaagcctagtactccctccgtcctataaaaaacgaatctatgaccggatatgacatattatattactatgaatatattctaatatatgtatatccagattcatagtactaagatgtgttatatttggtatttatgggatggagggagaacttcagttgttgtgtacttttatggtcgatgatcatcggtggcgactggcaaccacggcatgaaccaggagaattttgcgcagatgcacgcggggaatagcaaaccgcgcacgcatgggccgtttagctgcccgcaccgcacacggctcggcgaggagcacgcgcggtgggccaagctctgggaatcccacgtcaacgcgtgtatgggccaacctcgatgagactagctgatggaatttggaattgggccgagttgctgggctcttcaccacaggatcgcactcgaacccacgcgacccccaggcccagcagatcgatcgctgcgcgtcggctctttgactccacttctgctgcttcctcctgaggctactaaattgtcacgaccttaatttctcatcaataaattaactaggatattacatttcacaactcggaacacaaagagtacaagcaaatagccgacttctcctcaataacttaaaaagtttttttttacatatgcaactcaatacatttaacggaccctacggcatatttgcaaacaaaaaaaaatttatgaataaaacttttatatacgtgttcttaacgatctaaaagcaaaggctgaaaaataaactttgatgaaaaaactctaaaatcaactcttaatttaaggtattcaaattttgaccgataaacataatcgtaaataaaaaatgaggcctttaacatctcctaaaatactgacttgtagttttgtctgctagagaataaaagatgaggtgaaaagactgatacccgtaattaggttccttgtggtggaacctatccaccctgtttcaaatcctaaatttgacataagtgttcgtatttacggctaattattcttttagtggtaggtgatgtacccgttgacaacgagacgtccgtggtgacttcgtcattttcaagatatgccgccccagtcttctataggtgctcatacgggtaggggtgtgcatgtgtgttcatagtgtagtaaaccagctcaactattagcggagcaccaaacctgctccatgtccatcccaaggcattgaagcatgagaagatgtagaacactgcacttttctctttgccctcaagaacattgcagaagtagacaatgaacagagatgtggggctttttctttattatagatatgatatggagtataaaccaacttgagatgtctcacctgctcttgtatatatgagtcttaagatgaaataaatcttatctctactccggtttagattgacccatgagaaacttatctcctacagatttatttcacaacacatagggttgagtacgcgtgcgttatgagcgcatgtgtttatattgtgtttcttaaataatattaaatggggttagaagggcccgagggggttacgattatttacaaattaaataaaggttagttggtgggggaaaatagtgctctagaaaatcttatattttacaagttttattaaatgttacaaatctttatatcttagaatgaaaagagtatcttatacttatcttacatcatttgcataggccagaagagcgacacgtaacacaaacgacacaaattaggcgtggagatgcatgaaaggaccattgggtgtgcagcttttagaaagccccaccataagctaatcacaaaaccttggcatgcatcacatagtgggcgagcatgccatatattctactttccttccattctccatatatggaccacctcccacactcctttgaattattcttgcgcatatatcgatcatctaccttttctactattacatccattttatattataagtcgtttaacctttttcatgataaatttgactaaaatttagaaaaaataatattagtactttcaacataaaacaagcatattatcaaatatattcaatattagattttataaaactactttggtattttagatgttgctaaatttttaaataaaaccactcataatataaaacggagggagtactatacacaaaaaaaaaaaaacattagcctctccaccaaaaaggtctctccataaaaagccctaatcaccttctcccactccaccaacgcacgccttattttgcccatccccctaatctctctctttgataaggtttcttctcccatatctctctagctagctactaggcatggcgattatggaggtagatgagatgggctgttaattcgctttgtttgtgcgccataagcaggtgaagctgccagcatgatctgaaagcatctcaaaccagcgatcagatcatccggcagcttcatcttctcatggcagcacaccagcttgattgattgatgatgaaaccctaggagcaggtagcttggcttctcgatcttagcctgatcttatacaaggacgatcgattaggccaaatcaggagttcaacagtccatgtaagttcagcttcagctttttttaatttgctccttgagatagcaaatcaagatctagggctttctggaggagatgaagtcgtgtacatgttcttagattgcgatcttggtagtttgtttttgtttctgcagatcgagtgcaaatatatgtcttttagatctgcatatattgatattggatttgtaactttgaatgtgcaatttgatctgtatatgcactggatatgacattattcatgcatcttacatgttttatatcacttattagtatgcagaaattgaagtctgaataattaagcagtaggatccatctgacgaatgaacatatatttatatataagctattatattatcaggtaacgcatcagactatcatctcatattgccccgtgtccctcttaaacacaactacacaacctaatgttttatatgtatatgcatgtgtgccatacacgcttgcgacatacatttagatgttctatgatatccattcactcatcggaatatatctgacatgcatggagtggtgaattgaagttcccccatgcatcctctttttcaaaaaaaaaaaaaatctatatcatatatatatcctctatcccttgtctttcctactttcccttacatcatacatgcatgaagatgtacatatatgaaaaaaaatgattaatactagtattttgcagttactatttgtccaatccaaattaatcttctgatgctattttcatatggcaaatcttatagtatctcttgtatattttttttctctttatcttaacgatgaagttgttaaagcttgattgcatacgttctaataattcgtgatcaggaagaagtattaagttacagttcaagatcagggaaaagcataatttcatctgagtcttgctctgatcccgttgaaaacgttttaaaatcttgcaatatgcatggaccactactatgaatcaacatatcgccatccttgatattcattaactgtggtggcttaattagttgcttcggcatatatactaatttgacagtacaacagttatttcagatgctgcgtgatctgaagaattttcgtccttagaggcatcttacgcgtgccatccatgcctgaaggatgatctcacatctgagcaaattaaatgcgatgaattagattcccatatttactcgacctcttattgctagggatatatataacctctctttggtgcgtactaatcgtctgattatctcctgtcactgttgcttactcaaagctaattatatgaggctcatttcctctcttttctactgtactcaccagatgcaacttttctgcactgcagatatatgtggacgctcattgtcatccaaaagcaagattagctcctctaattttgagcactgacgcatgccactgataaaccttttaaactatataaacaaactttcagttgcaagaaacgatacagtgcatgtaactatactataaccaggaaatgaaggggactgatgtctatagcatggcgccgacgaccactgaatagatgcatgcgcgcatcctctggcttgcaagaaattgcctgtcaattctggcaggcaacaagaggatgaaaagaatcacaacccctgaatggtcacaaatatttcacaatagaagttagtattttctccgtttcacgatataagactttctagcattacccacatttatataaatgttatgtgtctgggcattgatagaaagtcttacattcgtgaaaaagagggagtagcaacttaattttaggtccgtgcagtgttgatatccagattaacgaaatgtttttttttatccgtgatatgttcctctgtatatggtctgtgtaatacacatatactacttttaattattttggttttcttctcagatttcttcttgcgatttacttatgttaaagggtaattttatcattcttaatcaggtactgtcacaccccaatctgataccgccgtacaacggcacctgacaggagcgtgtcgtagggaaaatggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggatgaggaaacaccaacagcagcagcagcagcagcggaaccaacggtctaacacccaacaccacaggcgacggctgggaaccaggacgaaaccctaatcttcacttcactttatcttctcttcagggcggaggaactatatatatatatttatatagagcaagggtgagtactttcgtactcagcaagtcacgggaatttaggtgtttaatgcaagcttggaagagaggcaaggttgttttgcaaatcttttgtttgaaatcattttgaaatcactaagtgatttatttctttttaagtttgggtcgaaaagagaaacttgcgtctcaaatcgacttaagagatgcttttcaacagctcaattggaaatgtaccgacatcccgggtcagatcattacttctcggctcctagagccattccacttgattaatcggctcccagagcctttttcattttctcggactcccagagtccagctgcccagcagcacaacaatccgcttccactcgggaagcctagtctatgatgcccacagacatcccgaatcacacagattcgtttctgaccactcaggtcatccatctgccacataggctgattctggttacgattcccataccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcattcttgcattaccaggaacccggtttggctccaaccgaccccgccccggcgttcccaactattggcatgcgaggtttccctgaaccgactagttacttagccagggtgtctcattccaccttgtggttgcattttgattatgttcgatgagttttccacaggaatcggtccttatatgcgaatacgggacagtgccacataggcacaacccccgcatcgcgagttttcataattcattttattttcaaacacacctacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccacaactatacgcaaacaattaaaaacctacacaagacccaaaataaagatcctatttagactagataatagtaccattagatagatctcaattttacggaattattggaagttgaacggagtcaatcggatgagcggttgagaagatatggattttctaaggattaaggaatttctgtctaaagaaaaaggatttaataatttattaaaccctttctgcaaagaaattgaaggagggatatgatttagacttcctcgggtggcttgggtgcggcccaagagggaaggcacggctcggccgaactaatgggccggccggcccggagaggcggcccaagggggcgcggggagagtgagggagagagagagggccggtgggccaagtctaccttgcggggtcccgagtggggcccgcttgtcggtggcgcggctcactgtgggagcggcgcatgagggcggcgctagggtttcgggtgagcgcggttcacgcgcgtgcaccggatggaccagggatgcggcgggcccacgcgcagccggttggcgcaccgtggaccgcgcgcgggggggggggaggaggcggctgaccggctctgctcggtcaaagccgaggtggcgccgacgtggcgcctacgtggcagccacgcaggccggcgggaggaggaagaaggggaggctgagatggatggcggacggcggccgtgttcaccggagcaagcgcgacggatttggtcttcgggggggcacaccggagtaacgagggcgtcgagaaggagcgagccaacggctcggattcgccggagggagttcgacggcggtggaattcgacagcggcgtccggcggcgagagaaaggggaaatcaccgaggggcgacgaagactcaattaaaggcggcgggagcatcttcggtgttcaaggagctcatttccggggtcggatgggtctgagcggcgccgtgaaggtccggcgatgagaggcggcctccgggggtgggcggcaatggcggcggggccatgccgggtggcggcggtccttggggcggcgtctacgcgcggtcaaggggaggagctggcggtcgcgcccgtggtccaggcggtggcaggcggtgacgccgatggtggtagggaaaaggaaaaaggagggggagaaagggagctctgctccttgctgtttcgggaaaagttgaaggagggagagggagtgagagaggggctgcctctctcggctttggaagctagcggcgtggagcggcagagcggcagcgcacgacgcaggcgacgccagggcttgacgcggcggcaaccgggcggctgcgcggcgcaggcgcggcagggctgacggcggcacgaccggccggtcggccacgcgcgagcgcgggaaagagcgaaggcggtggcgggttttgggcggcgacggcgggaagcggcgtcggcgcgagagagagaaaacgagagagagagggagaaacagcgagagcgagagagctctctctcggctcggctcggcacgtgcaactcacgtgcgaggctgagggaggagaaacggctgagggagggaggtggctaaggggggaaacggcccacaacacccgagggaggtaaaatagacttttgtagagaagactgatttggagtggattcgaattggggttttggattcgaattcaaatttgacattcgaactcgatggtttagggaggaatcaagggagactcgaggagaagtcaaggaagagattcaaaacggaaacttggatattttttttgtagtcggagcgaatattcggcaaggattcaaaggaagggattgactttcggaatttgatttcggagacttgaattttggataggaaatcttgaggtggaggatttttgatttcgatgagagggaacaacgggatcgaattgagatccatggcataacttagactctcacacaaagaacgaaaattttcgcaattaggattttgccgagttagtttttaacgactcacgaaaagcggagcgttacaggtaccaggaagtaaaatattttctaatataaaatttagtacctcctggcattaggtatatggagatataccaaaatttttaatgtaaaattttaagtacatttttttcatgtactagctacctccgtcccaaaagaaaaactcacttcaaggcttaaatctggatatatgcaaaccctaaagtgtttttttaagcaaaattcatgcgaaattcctgggaaccattgagccacttctgagcacacggcgacacatgtaggttatatacagtggtgacaaatgattagagcactctactcggttgaactttctatactcatcatcatccaagttatccatggatggataaagcgcacaaaaagcactacactacaagaggccaacgagttgcatgaagaagatatagatatctaattatctatcagcatcaccaatgattaatcatgcaagagaccatatacagttgcaccgtctagtcacgatcgattagtatcatagtacgtacacctccattcctaatataagtatctataacttatttctacaattttaaaattgaagatatttttgcctgtagtttggtacgtcattcgtgtataaattggtttttaagtttgttcacttttaaaaatacatattcgtatttgagtcgggttataagttcgttcgtttttagaaatacagaaggagttgcataagaaatttatttaaaaaaactcacatactaacttaagatgattggacttctaattgtagctcatgattttctagacaaatatatatccaaacaaattctcatagtgaatttcatcttaactaaaccgtataacaataataggattaaaatagtctttacccgttgcaatgcacgggttttttttatagcttagtaaaacataaaagtataaagaagcaatatctctcggtcatctcattggttaaatctcaaattttaaattgtttagatttcggtcttatgtacttgattgactgaaaagatgtttagattgttgtgcactggaatcaatgttccagaaatgcttatattgtaataaatcttagaaatatttatatttgagaacctgagggagtataagcaacttatatatcaagcatactaattaatccttagatctccccgaaaagaagatgtaatcctaggtgattacatagtgcatatttctactcaccggacaagattattctgcaatctgcagattctgcactattgagaatcgattcattggttattattttatatacatatattggcgtaagcagccttggtgcgaatctggttccaactttccgccttccgagatcgaaagcgtgttccatccacatgccgctaactgacagcgtcacagcggttactaacgtacccgtcttctctgttggaaagcgtattttattcgcaacgtgcggttcttccagtttctcggcgcctcggcggtgcccgcgcagcgatcgaggggaaattcctgagagttaaattcgttgaatcttaccatcttgtttgttatgattggatccatttgcccttgcatgcttgattttgcaggtgtgggcgaaggggaagcctcgaagtgcaaagccgcccctgcttgcacgcgatgtgttcggtgaaatgcctctgggacgcacaggtgtcatttcccgaggaagctctgttctcgtaacattttgaggtagaggtcactgattctgattttttaacacgatgttttaagcaagaagttaacttttctcagcaactcgatctaacttttagggagatgcacattgccagtggtgctactacagattactgaaccataggcgctctatgctgtgaaaaggtaaatccagtaatgctgtccgctgttctccacaatttttctgaaattggtagcattatgtctgctttgtgggcattgatgtgccactgccgcctcagtcaaagttaaaatcgacgggatctccatgttcctgacacggcaaattcttcgattcgaatgaaatgtttgctttagcatcctaaagaaattcttttgttatatttatttttcttttaatcaataatcagttatgccaacacggtgcacaacctacaaacagggcagctaaaatttcaatcaaatggatcaggagcaccttctgacattgaatgcttgcacgtcatggaatgtggttaatgtgatcaactgatcatccatgtgctgatgggatctttaagtagctgctttgtgtccatcaccctatctgtcaacatcgtagagttcttcaccatatcaactttgaggtgtttcagattctttttatttggttgctgtcatagttagtggagacaatggggatatccaggcaaggaatctgaagagtatgtaacttctactcacgcgcatcaaaatttcagtatctcatcttttactgcctgcttatctggtgagatattataagagggaggactcagtaaactcctctaaaaaatggttcgaagtaaaccatttcaattattcagctcagtacgcaaaacaatgaggctggctttaggtatgtatccttcctccctgcttccactgtaacagttcattagtctaagtgaaattatttagcaattaggtcctaggtaactagctgagtagactaataaactaggctctaaaaatcttctggatcttattttgtagcagaaggggttgaccaggactgctctgtcaaagagcagaatgtccttaacatcagcactgcctgcttgcaaattatatgcttacatggtatgtctcttgctctcttcattagtcattacaaaacagtgttcgtagagatgcatacttagatccatgctattgttgcccaaatagaaaaaaaaaattatgattaacatcgtaacatgttctgtagaatgaatgggtatggaagcattatcagtatataccattgatagactagctagctgattcgcccctccttccagaaaacagagaagtgattggttgaatgtactcatgaaagtcgcaaaccaaggaccactatggaggcttcaccttaagatatgcatattaacactggaaactatgttcatgcattggctggcaatggcacatacatggttggttttgtcaaagtgcattgcatgacaagatctcatacgatttgatctctgggttctaggaatgcctaagatgcatgcaaagtttacttctagaaaaacccaaataaaaaaaagataatattagaagtatatacactatttccctttttttcttcattgtcctgaaaagattggtggcaatcattccaacagtagtgacagaactcataaaaatagccctgtacaatgtaaggtgtcccccttgtacattcagtcattcacttccccttatatataggggagagactagagagggaccctcaccctgagctcattgaggtggccaaataggttctgatcacacctttctcctcctccatgcttactacactggcactgtagtgcatgcaagaggagaggcaaaaagatgatgatgtccttagcagcttaggttgtggctacctagctcttcaactagcttcttcccagaatccacatagagaggcagagctatatagcagagtaggaagatacatacacacacatatgcatataattcctagctctagctggtgctagctctaggagatgtgtccattccattgcagtgccacagagggctcgactagactagtctgcatagcttctttcggtttacacaagagtnnaggtgtttgtttccaagaggccagagtgatcgatcgagcttagctcatcggttcttgggccatcgatcgatcgaccgatcatgcaggggcagcagaagcagaatgcaggtggtggtggtggtgacaatgcgagcccttgcattgtgctggatgggcccatcatcgtcggcgccgggccgtcggggctggccgtggcggcgacgctccggcagcacggagcgccgttcaccgtggtggagcggtccggtggcgtggccgacctgtggacgaaccgcacgtacgaccgcctccgcctccacctccccaaggtgttctgcgagctcccccacgtcgccttcccgccggacttccccacctaccccaccaagcacgacttcctccgctacctccactcctacgccgcccgcttcgccatcgccccgctcctccgccgcaccgtcacccgcgcctggtacgaccacccggcctccctgtggcgcgtgacgacgacgacaacgtcgtcgtcggcgacgtctgtgatcaccgagtacgcgtcgccgtggctggtggtggcgagcggggagaacgcggaggtggtggtgcccaaggtgaaggggagggagaggttcgccggcgaggcgctgcactcgagcgagtaccggagcggggagaggttcaggggcatgagggtgctggtcgtcggctgcggcaactctgggatggagatgtgcctggacctctgcgagcatggcgccatgccgtt

SEQ ID NO: 61069 - DNA, 71954 bp, Oryza sativa
cccagctcggtatcgcgctcgatacctcgccggcgacgctccgcgacgccgcaactactctgagcaagagcgctccttccttcgccccgaatcctcgatacctcgccggcaccgcctgcaactactccaagtagggactcccccaagccagaacctggctcggtatcgcgcgcggaggcgtgcgatacctcgccggcgacgctccgcgacgccgcaactactccgagcagccccagccagaacccggcacgcctcactccgagcaggagtgctccttcttctgcccagacaggtatcatcttctctagtttttgggtatcagtgtttttctctagtttaggtatcagcttgtctctagtgtaggtatcagcatgtctatttttttcaagctataatggtttgtgttctgcttgttatgtgtggggccaaaaaatgactgaaaaaatgtgtgaattattcatgctgttgtagtttcagttaaaaaatggactcctcggttggatccgctggaagaatgatagaaaagatagcaaatgaagggagtgatttccttggtgaaagaagtatcaaagaccagtagagtggcaagaagatgtctctgttgaaagagcaatggaacaagtatcaagtcatgatgatgatgcctgatactgaatggaaagcttctgaacaattgtgatgtatggtcagagaatgtcaaattttgttgcacttgatacttgaattttatctgatacttgtactgtgaggtgatcttggtaccttgttgtgagaagtactgagttggtcatgcctaatacatgtactaagctagtcatgactgtgtagtaccagtcatgatacctatagtgaccatgtgctgtaaggtatcaggtctggtgccttggttttttgtgaggtaccagacctgatacctaggttgtttctaagcaccagaccctggtacttgtattttgtgaggctggtacccctatcctgtgaggaatcatgtctggttcctaggttaagacatggtacctgggtttttttttgaggtaccaggtctggtaccttggttgtttctagacaccagaccctggtacctgtattgtattgtgtgaggctggtacccctatcctgtgaggaaccatgtctggttcctaggtttagacctggtacctgggttttatgtgaggtaccggtaccttggttgttgctaggcaccagaccctggtacctgtatttgtgaggttggtacccctatcctgtgaggtgccatgtttggttcctaggtttagacctgatacctgggttttcattgaggtacaaggtctggtacctagtttagacaaggtggtggtagcaggtaccgtgtgcctcacagtaaccctaggttcaggtgtggtacctggtactaggtaccaaatcccattgtgtgaggtaccaaggtaccatatcatggtaccttcactggaaggtaccaatcaaagcctcctatgcttgtaggtaccaaccccattttgtgaggtaccaagaccctgatacctttcaaatacagggaaaaaatattttaggtaccaacccccatatacttattgacattttgatttcatggtttaaattcgcggtatatatttttttaaaaaaatatcacacaacaagcataaaaaaagttgagtgctgcaaatgaaagataagtttggatgtatttcacatggtgacactgcagtagccattacatggtgacatttgttcacatattcacatgatttaaaacaaaaaaaatggtggtaccaccagatagttggtctggttgttgggggggggggaggtccgtacatggttcaaaagcactatggagttgcctttacattttaaaacaaacaccatcactatactttaaatgacgcgatgtggatgtaggttgttgaagcgatggtaaatcaacctatggccggagcacgacaggtaccagtggaaagaaacgaagggagccaaaagaagatgcagcactgccgacgtggaggatggaggaatcggccggagtggagtgcgccgagtggaggagccgattccgatcgaaggaaggatgtgatgggagtggcgccgcagcaccgccggcgtgggggacggagggaggaagaggagcggcggcgcaggctcgccggcgtggggaggcggagggagggaggggagcggctgcgcacgccggcgagcgctgtgaatagaggggaaaaacacagagagaggaagggagctgtgagtagctgcaagctgtaagccgtggcgtttcggacacattaagggcccatttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagatgtctaacttcttggaacatttcctctgagtctatctctctcatctgattcttgcgtttttcctgtggtccaatcaaacggccattcctgtgtttttcctgtgttttgtaatcctctgttttacaattgtattcctgtcagaatcctgtgtttttcctattactctgttttttcattcatacgattcaaagggaccctaaagctgtcccgtgaccgcccgcaccgccacgggatgccgtgcgatagattttctgttcgcaataaaaggcgaccttccgattctccactccaaaaccccaaccaaacccctctcgctctccccgccccctccgcatcccccgattcccccgccatggcttccggtgccctagcccgcctcctcctcggccgccgcgcggccgccacccctctcctcgcgcgccccttcgccgcgaaggcccgcgcgtcgcgccggccgcaggagccggccttcccgtcggaggacgaggacgacttcgccggcggcgaggtggccgcgcccgcgcccaccgaaggcatcagcaagccgctcgccgaggtcctcagggagctcggtaagagggtccccgaggccctcgtcaagacgcgcgtcgaagatggcttctccctgaagtacatcccatggtgagcccgctcgatcactttcgatggcctatcgaaatcctcccttcctacacaccaacacagggatcggcttattttgggagatttccctgttagtttttaacgcgttgcgcgtatttgcggatttttgatgtggtttacattaatgtcctagattatacttgtagaatcgtgcttagcagctgaatgatgcttggacctaacacactacactgttctgcgaagtgtgaactacatgtaattgttggttcgttcgtgtaaaaatttgggattgattgatggagaggaaaaaatttggccacctgctgctttgagaggagctagattaaatataaaaaacttgaaggtcttgattcttgagagcaattcatcttctttttaattctcaatggtagcattatggtctcctttatatacatgtattcactaacaacttctccaataagaagggataaaacatacgatcttccttaaacaaccatatccacctagctaactttacaatcggtaatgccatgagcttcagcaaccataccattgtttgagttgggtaaatgacgctcatatagttgtatttgtgttttcacttctgatgacttttgcaggcacattgttaacaaaattctgaatatacatgctccaggtgagtttttttctggtcactactacattggctgtttacttatactcttgtagagggattagtttcaaagtgggccagaagttgagtgatcatatttgctgttttaattttagatttttgtatccattgcagaatggtctggcgaggttcgcagcattgtttattcatctgatggaaaatctgtatctgttatttatcgcgtgactctccatggaactgatgcagaggtacctattttccccaggaaatcatattttgtatagatgacaagctctctgcaactaaattactaaatgtcattccgaaactagaagatatggatgaattattgaatcccaggccttctagtatggtactattgacaatctgctgataaatttcaaactaagtatggctgccccctttttgatgcaggatttcttttgatgctgaactaggatttcatgccatagttcatcaaaatttactaggcatgctttgtgtcgtactgttatgtatggtttaggttatttagattcatatactgcattttctactattctcccatttgtaatcttccagtatgttactagttcttcaatcatggagtgcacatgctgatgcatataaatatactaatgaaattctattccaaatggtaaggcgaggatcctggagatcactcagcattcctttgttaaatacaaactcatctcaactcgaagcgttgaaatgctaggctttaacatactaacattacatagttctgtttaattaacatatggtagaactgacctatttgggatatatttctttcagatctacagagaagccactggaacttcttctgctgatgatacaggctatggagatcctgtgcagaaggctgaagcaatggcttttcgccgagcttgtacccgtcttggtcttggacttcatctctatcatgaagatatgtcataaatgcttaatgtcaattgtctgcggtattaaactcttgcatgtctcatggtgcacagacccccttttgtgctggatacacttttcttgtgcatgttatgaacgtccagcatatgaagctaggtactttaggtggttgcgtagatcgctaaatgtaagctactaatgcaactactgttgaactattaccttattatgaaccagcctgctgttccaagatatatgtccctttttcgtatcaagaaattcctggttactgctggaattaaattatttcatatgaaattcctgcgattgaaaatatgcatatgctatttattccactgattcttatgggaatcggacttctattctttctgatctataacattcttttactatatatttcatttgcatgctcgctggaaggaaacatattgcatgttagcggttgttcccgtattaatggttttgcagggtgatcaggcaagtttttttgtacagttatgtttactatttgaatttcaatccaatagaattttttgatgacgcaactgttcttcaatatttatagcaccttcttttctcttgttaggtcaaatgatttatatgtacttacttgagtttgttctaagggatgctgagtcattctgacttccaaaatttccacgactgatgtagctaactagctatactaggcaataacttctgacaaaataacagtctaaactaaccttcatcagtattttgtatattacaaacaatctggttattgccatcttcgtatagaactggacatgcaaactgttggtttatatcgattgtagttggacctatgtgctgttttaccgtaataatttgagcaaattggttatttgtccacagcttaggtatgattcttaactcaggctccttttggaattgcgttggattatgataatatcatttggtgcaactgctttttagacatttccgcattttatgcttgacttctctctctctctctctctctctctctctatctttgttgcaaaagataatgttattattgtttcccaaaaatatggaactgatgggagagacatgactgttaaataacatatttcattctaaccttaattttataggtaaaacaaactgtagcgattataagttttcattcccacaacaactttaaacaataagcacaacaccacacagcatggaaactgcaaagcacgccttgagagtggcttggtactttgtagaaaatagcagcagctgaagtgatttctttaattgtaattggtgcatcactatctcactggataatttgagtttatttagctaaaatattactggatggtggttcaaatgaactgccttaactgagtgattttaacacatacttttcacatcagtaattcctgtttatttaaattctgatttctgagatgaaactaggtaaaagataaacgagcaagaaatttgcatcacggtaggtagattttacataacattatacaataaactacaacatcaggaatggatgtggcagaaatgcaggattgaatagtaaacagttctgcttgactgcttgtcctaaaagtgtcacagtactactttattattacaatcaccatgtccgataatagtacattaaaaagcattaaggcttctctctgtacacacagagagagggaagagaggtggggaaggagggaagggagcagaaaggagtgatcctggacctaaccatggtagtgacattggggaagcaatggacatctagatgagtggccgacccaagacaataaaatatatctatgggtccattggggttaatgaatgaaatacataggcagtgtctggcatttccaaagccttctttggggtaccatcactatgttagaaatgacaggaggtagcactaagtgccaaaaacaaacattagcactcctctgaacctgtctctgacaaggggcacaggctctccttagagccttaaccacctagatgcaagctataaactggaagataaaaaaggaatgttagttggagcacctaatagttgcttactaaaggttaaaagttggttacacaagttaacacgtggtgttagataagttgctgggggctaatttgcatgggaagaggttaaagactggttacatgtcaaattgatttcctctaggtaacagcaagactagaagattagggtctgctaaatggtttgtgcttcatccagaagcacatggcctatgctaaatacaatatagattccactgacgaaattttgaagtggcattcttgctcgatcagttgtttagatgtcacttttgtccaattggcctgtatcagcatgaaccctccctgggttaatgcttgattgttagggttacttttgcccatagccttctctgctagggttgaaattaatccatgaagtccttccttggactgttgttaaattggttggtttgtgcttctctgttagtacagccccatccatgggggcattaagctttgagcccatcctggggctgaagcttatctccaatcaccacatgaccatgtgggatatggagtgtgcacttttagctgatgagcatgaggtcaacaatagtgccttctggtgttagagatggatgcatggactcaacatgtgggaaataaaaatgagagtgacgatgagaaaggagaccatggttaggccaagggttgctctggagcagcagacacagcaaagtgcgagggaatgagccggtaaggatgagcagcctgagttggagtcggcaaagtaggagctgtgagagccatagtcatgcctgtttaatggggacacacactgtgaatgtattagtgtcactactgagcaagaaagaaataatgtaactatattatgagaaaatgatagctttcttagcaaacaagcgtgaaaaagtaaaccatactttgtatcattctcattacatgtccactagttaggattctttatgcactgactgattgacaaatgcgtaaaagacagctaatttgtccttagaaatgtactggggcagactgaaaagttccatattgaaatgcaaccttttgttagggttgaaatgcaacctagtaacagctgctggattgcttttcttgttttaatattcatgcaaagtaacctctgaattgcatttttgtcaagtgaagagaaaaaaaaatctaatgtacttttgaaagctctatattttacctaggaaactaggatcatgcctacacagaggatttgaattatgatggaggtgcatatacaagagagctagtaatacctgcttgggcttgaggactcgctgcaagagacaatggccctccatattgctgtgcaaaacctgttacagcagcagctgtagaagccacagttgagaagtgaaacatctgtgggtattgcaagttgtagccttgtccacttgcatagttggttgtagtgcttcctgattgcccaaactggaaatatggataaaaggggctgcttccagtcaccatgccagctgctgctgctgccgccgccgccgccgctccataaaatgggtattgagctcctccgtagatgttgtagtagttctaattaacagcacaaggagaagataagtcttgattccatgacgtttgttctttctgatataattctgtgatgtatgttaggaactctgttataattcagttcacattacattcaaaacatacctatatgcagcttgaatctgttaggtttgcaagagatgcattttagcatctgtaactttatgtaaaaagttgaattaagtgcttgcatattctgttaagttttcttgcttcttgttgaaaatttactaatgaatttgaatcagtgactctgatagtactatattaaggcggctaaggcgtaagtgcataaccgttagcaactgttaaagtaaaggcaacaatttggtttaattgtcattttaatattttggatatgccttttacagtacataaccaataatctaattctgggtatcacagtcactatgcagatgtacaatttacctacttttaaaaggtgttctgttgcattattctagaaaatatcctactatatccaaacaagtaacttattttgttttttcctcgctccaacactagtaaatggatggtgtcaaaatgcatggtttggaaattggaactgagagagagaggagggggagaagggggcaggctatagtcccgttattagagtggtatacctcaaatagttttttttttctagctcatgtaaactatcaaacagtattgaaataccaagtttctgtgcttcctatttgacttcatgaaaatcatgtgcctctgcaacagattacatgttagacagacacttgactgttcctgtcatatgcagtgcatcaatctgggacaaagctaaattggcgcactaactgcaaaaacctgtattctggactacatttaggtccatgcatcaaaggcccaataggtgacttaggtctttatggagccaaacagaggtatagctttgaatagaattgtggacccacgcatgtgctgtcactaagtttatttggctaacaaaggggtctagctgatgggaggatggacccagtgtttaacaggtttggtctggacaagctagggcccatgtcatgtgcgcctgtaccaggtaagatagaagctgctaggaccataaggcactatacttgatggaggctcaggatggataattgatgattttttttaatgcaggcatggacattgtttggactgggctcatctcatatgggacaactgtttgaggggggttggaaaacaacctcatatccattagcgaagctggactcagaaattcaacattataatacctgttacacgtgaagggaatggttttgaaaggatgcatggcttagggcctttcagcacaatagcacataatattgtcactgaacatggaggaagctaggcaggcgatggatattcttaagagctgctaactcatgccaactgacaggtaaaaactactggtaaaggaaaatctttatcagcctgtggtatttcaaatggttcaatgtattgaaattgctaggatttttggttttctagtagcaaaagtgattattttgatagcttttctttttgtatattcatgttattatatttatataggggtactggggtagtgctacacactaatgtttatttggtgtggggctgtgggcttgtattagctagttatgtgctttccattagtaacattttaatgggatctgtacatgatttacaagtttgagtgtttgacaagcatgctatgccagtttttaagtgacggtgcatgcaggatgtcagtttgtaagtaaaacctgtgtaggatttgctatgaagacagatttcatttagtacactagagtatggagacaaaccgtccaggttggcttgaaagctcgcggttgaagaggctaatatgcttagcatttctcaccttctttgggttactgtttgctatagcagtatagtatatgttcctgtagcagcatttaatttcgtgcaatgtcttgttttgctattagatgtttatgtgctactattttctatgcagcatgtatcatatcttgattgctattgcaaatgcatactacaaaactaatttctggtacacctataagcattgtcacaatggtatgttagcttaaaattgatatgcttaatatttgtccccgcacccacccccaacacacacagaaactgatctcagttaaataataagaacatcagcatcctattatattttttatccaactaatagtacttgctggatttgcaagaggaacttactgtgggataactgtagtctggagaatagggagagtacctgcagtagttaagggaaggagaagaaataatatcaattttgtatcaatcatggttatgaaatcatctactcgactaagcatctaatagcttgcgccagagggagagtagggcgtgcttgcagtctaagggagataacaagactgccctttcatgtgccactggatcagcatgcactgccagtgccagcctgccactgtgtgtgtgtgagagaggaggggttggggccttgggggtgcaagctaaaaagcttccatgccattcaccattgaccaaggcggcatgtcatgatgcacatgtcatgcatgtgataagccccccgtcatagttggtccttgggaactttaaggggggagagagagagagagagaacttacccatagacatggtaagggagaccttgtgggatagcataatgggggaaggtggcgtgagaaggaaaagctgcgcccagaccaccttggatccctgcctgctggctaaaggacttcatcaccctaaagctcctagcccctcctgtagcaacatcgtcaagaaaattagagcaaatttacccacattgccttgctagcattatctgcaaaaagacacttgaaagcagccttgcacttgttctgatgcaccactaatgagtttattcacagagatggtcaaaccattcttcggtcgctgaattgcaagacgacataatagaagtaaaagattctctgaatctgtcccgattaatttagggttaaggtttgatcctatagtttattatctgagcctaggatttataattagtatagcgcattatccgaaacaaggcacttatttcaaggataactaacatctttgtactgctaatgttgttcgtcctccttatctacttttccagtaactaaattccaagataatatcgtcaagactatggatttttttgctgctaggtaaaagggcagtcctgtcaaaatgtatgctctgtacttagtaaaaattagttagcactaagctaaaccaatgcatttaaaaggtcctcatctaacaaggcttagccaattagcaaagttaggcaaacttgatgtcgtgttctttaagctcttatttattctattggcaggaaggaacttttttgcgcataaaatcataacagctaagtttgcgatcatgaaactatatgtggaaatcatagaaaatgccagagttagtgcatctataatgattatcacttctctttttcaagagcttttggtgttgggctgttttcaactcataagaagttgtcatcgaaggctttcaagcaagctagctaactgtgtgttctatgttgcttttgttagctggtgagataatggcaaatgtctaaccatgctgtggggttggaggcctagatctctgaaccccaagggaagccagattacagttagcccttctcccgtcgatcaccggcgcgggatcaacgcaagccctcatcgccgcatccgggtcccggaaggtaacctacaatacgaatttgtggtgcataatttaataaaaattaagcattctttgcatattgcagcaaaccaaaaaggaaagaaaaaactcgtggactagaactgaaaggtttgcaaagtaaactgctgcaattaagtgcacgtaaaggaaagatagaactgtaaatgatcatacaaatccatagcccttggatctgccagtgttcttgtcagtgataacaactgcctccaggatctccccaaactgctcaaagtacttcctcatggtctccttctgggtctcccatgccagccctcctacaaacaccttggtgtaggttgtgtccccaaattgccctatcacactcggtggactcatgatactaacttcaactcagcagcaagaaatctagctcagaaaaggaacaagaaaaaccagcaactaaggatctgaatttagctaggacttgttaggggaagattaggagatggaagagaagagaagagaagagaagagaggagggaaagaaggagggaggcaggaaaagctaaaggttagaaggaaaagggggtaggagagaggggaagggagagtacagaagggcaatatatacaagtgtctgctataatgcaccactcttgtccttttggtccaaaccatgctcgtataataatactacacaccgggagacacacccaccccggccaaagcatcagtagaatgactcaactgtccttattggatgaacagtagttacagggtggcgttgagctgtccttgtctggatagtggcaaaaacggaacggagttagggagggattccgtcgggaattagggaacttaacagaatttcgtaagatgcaggccttgtgagcgtatcccgattttgtttgtttagattggaggtaggtcattatagataatcaagcgtaatcagtctagcgctgttcgtgctctgaatgcaattataacatagtagtttgattattatattctagcagaacagaggacataatggatttatggatgtactctcttgcgtaattggaggtttatggtggacagaatgggtttatgggcgcatcaacatatcttctggtcatacttggtacaatctaataccaagcagaatatgatgtgtagagatcattttgagtactgttttgcttcaaagtggtagataagcatgggttgaggaagtgggcagaaagagtttaaaggtaaaatcactgcaccactaatataggttattttgtgctatatttctaggtgagaataatttatgcctgataggactgcaattgcagataagttctattttataaagcccagggctttttttacctgaacaaatcctttgtgcaaatcttaggctagttgtttatccgagttatatctcatgccccatttccaacccatgttaaatatcctaattcctatctgagacgttttgccaacaattgtgaaggttatattacttcactcaataaatatatgctacattaaatgaactaatcagtagagcaatatagttagagattatcagcatcactctcactcgtgatcctaggctgctagccgctttgagttggagcaaagctgtggtggaggctttcttccttgtacatcaagcacgtagaaaaatatgccccaccaatggagggagagatatttgatgatgtgcactgcctggcaaactgagggaatgcatgatgtgccatcagatctgatctggagatggacggctggagttgccaccccaattggagtggttgggggagtactgaactgtttcgaggcttgacaaggacgcaggtgccaaagcttttgcctgtctctctagctcctcctaactctagatctctcttggcctgtaagccacctctgataacaacagcctcctccatcactttgtcatgtcccagacaacaacaatacaatctttggcgccccgtgtgtatgtacctatccatgcaatatcttgctgctgactaatagttgtccctttcttttcaagacgaaaataaagaatatgcggaaagtgtatatcatgtaacatgtgtctgcaactgcaaggttagatttattaacatagaaagcatatgttcgttcatacttgtgagtacaagtacttcaaacagtctgaagcacctttggaatctgacatggtagcgtaaatactaatataataaagtaggctagagtgggttctcatatataatagtgtctaagcgaggagactctccttagctttagatactcttgcatgagattaggagtacctgcaggagagattagtatattacagaaatccatgaagaaaagtgtaatgtgcataatccgagaacattcgcttaaattatatgaatatcagtgtgagggggctatcacctcgctttagctgactgaaaatggatgtctaatgtggaatttataatctcgtagtactagctggctagctgcaagtgcagtattcacatgaactagaaataagatgtatgttatgaatcattgaattacatatgctttgatattttatcacttttgtctctttcattccgatggatgttgtctactaatcatttggctacatgcttcattgcaaggggaatcttttttaacaaccaggggagtatttctctctggagaagggaggaatcttagcttggtccagtatacagcctgacgtttgtatcagactacagtatctgcgtcctagattaacttctccccaggccggctgtccttgttgactggtcgaggtggactgaccctggagcaagggggtcttggctaattggacatgtgaagcactgaggcgtcagtccattggtgcctggtcctgtatgcaagtgatcactgttcacatccaattctgctcttccaccagcgcactaaagtttggaactttggatactctctagtctgaaccagaatccagaaaacttggtaagctgctggcacatctcgtagtacaattggtaagttctactgcacgatgtttgaattatgggattgaatgggggaattatcggctagctcaatcactcaccagtgatatactgtagtagggtttttctgccttcctttacatgatttccatcatgccgcatttggtacgtatgtatttcgagggattttcactaacaaatcaaccattttttttcaggaacagtagaatctttgaaaagaaaagcgcaactgctgcttatctttgaaaagaatagtagtacttcgtatatctgttgtcagcgtgtcgtctttcgcccgatgaatatttgttgagacttgagaagggtacgtaaacggctgtgcccatactgcgcagcaattaggattccacatttccactacccaactgtccaagcttccaacctgtattattctggttaggagatattgggcggtgccactgacgtaggaagacctcgctaagtctttccacttgtaggaaaagattgacgtaaagagagaatcgtctggaattttggttggtggtgcaatgaatttttggctgctagtcgaacatagaacatgcccaattaaagcctcgtaggattagaatttttatcggtaacatacggcctcttgaaaaatctcatctaccaatatcttacaagatctttatacaactcaagttcatgagttatagtagtggtactatactgcggagtactctacaacttgggctgcatgcatgcatgattgcatggacctgactactgtccaaattaacgtaacgtgagcaggggactgatccgtttttcgttttgaccactggtccacggttcaaaccaacagggcacagcgtgaacatgactccggtactagtagtaggagtaggagtgcacaataggctaactatacctctgagcactctgtctgtgggccacgtcgtgtttttagccgcaataattcaggaaataattgggcagagagagagagagggagagaggaggggagagaagagctgaggctgtctgtcccacgtgactggacagagtgcccccctgccggggaggagaaaccagctgtaaagcggggccccctcctctatcgaggtcacttgcgcgcaaaaagccaccgcccactgcctccccccgcgggctcgccggcacgtgcggcccaggtacggcccgcgtgcaccgtgctggccgcgcggatcctcttcgccacgagaaaacccgctacgcgcacaaaccacacaacccaacgggaatgctatatataccacttgacacatttttgagcaggtacagtagcaggctataagccagctgtaaacatattttaaggagataagtgaggagagagaagaacagcgggctatatatttatagtcagctgtagcacggattccaaaacacagtgtgtgtatgacaggtggaaccaagtattaatagtgtagtatgtaaccattgtattaatgagctattagattagctatagatgaattggagctagtagttggctatactattaaacttgctcttagggtgaagatcactcgaattttgagccttcagatatgctctaagattcgtgcttcgtctgtctctgataagccctgaactacatactataatggtttcaaagttgagggtgagagagaaaatggggtttggaggcagggaagtgagaattgttccctagctaagaggaatggttaaggcggtgatagtctgatggtggacccacggtcatggttgggcggcgagacagtggtgttgtcgtctcgacgaaaaaaaaaaggtgattggtctatattggcgatggaagcatggatccaaagtggttaggtgaccgtggtgtctccggtggtctcgaaacagggagaaagcatggctgggggaatggaggagcttgatcggatgtatctcgtcacgtgttggtagtggctcctggcgctagcaaggtcgaggacggcacgctggtatgggaagacggttgcaatggagagggcatgaggatcgggagaagaagagcctgtcgcgatggtgtcgtgagtgaacgagaagaatataatgacgggttggggctagagaggtgttgaacagatcttaaagtagtctaaaacatccaaagtcgtgtgattttaaaaggggaaatgtgcccagcgatgtaggataggaccatttttaggttgttgtcaaaaaatatgtttgaatggtattagtgtatatttggattaaacccaaataattgataattccaacggtcagtttagcattaatttaaaaccttcctctccatatgatcaatatttggctttatactagtatcattccaaatatgtgtgatacatgcatatctatctaccaaaaatattattagtaccaaaacttaccaagaatagagtagtggcggacctatgcataaactgtggggtcagctgacctcacagctttttgaaaaataccactatagactttcattttcatatataaatccaaaataattaaataaatgacctcgtttaagtacaaactagtaattgaccccacagagttaaatttctacttcgccagttgggagagaaccaaaaatcccccgtaagagcaaggctaataatacagccgacctgttggttataaggttctttgtagtcttctttcaacctacccatatactcccttcgtcccataatataagggattttgagtttttgtttgcactgtttaaccactcgtcttattaaaaaaattgtgcaaatataaaaaacaaaaaaataggcttaaagtactttggaaaataaagtaagtcaaaaaaaataattctaattttttttgaataagacgagtggtcaaacagtgcaagcaaaaactcaaaatcccttatattataggacggagggagtaataattagctctttacaattaatacatgacccacttgtctctctcacagagctttttggttcttatgtctaagctgactgtaagtttatagcccacttctcttagccggcatatagcctactgctctaacgtatggacgtatggacgtatgcacagcaattccaggctcgaatggcaagcagtgcggcgttggccctaccacgcggcgaatcattgctggtgcagatctcgagggtgaggaggagggtccccaggccacttgtgacaagcgtcgcagattctgaggccgccgcccctccaaccctccctccctccctcgtcctcccgtagccggcagcggcagcggcagtggcgccgcgcggcgtaggtaggcctgcgcggctgcgccgcacgctgcatccatcgttcttgcccgccgatctcaccggaaaagccgagggggggtgaaagacatcatcgctttggctcagactgccccttctccggcggtccggcctgcacttccactccgtacagaggcacagccagttataattaactgaccaaaatattcctgcagcggcacatcgcagttggcagatggccggcttcttgtcaacgtcattttagatgattctgccgtagaaacgtgtcattttccacaggaaatcaggatctaagtacatggtcaaaatgggactacgtaccgtaccgtaccgtcaacgtgacgatcctggaggtaaatgcacgctgcatgcgctgtagttaagtccataaataaatactccctccgtcacatattacaacagagtttgaagagatatgatatatactaggacaacaaatctggacatactcctatccagattggttgtcctagtatatatcgcatccctccaaaatcccttagggcatgtacaatggtgtctaataacgggctctcttcattgttatgcaagtaaatttggtgacgtggaagaaaaagtggaaaggaatgagaaatattattgctacgcatgacaacggctcagagataactcttaacatttattaacagaaagtttattgcatgagggtagagaaaaggaaagaagtataataataacattatttatgcattaatggtttagaatttttattgtctctaatattgtaggagaatagtctctaattacattaattaatatagagagctcatattagtctctacctttgtacatgaccttatattatgagccagagggagtatgtgtcatggtgactgtggtacgagtttatttctttcatcatgtacaagacaaattttaggttgtgttcggtggtgggtggtgggtgatgggaaccggagcggtctattatcgcgtgattaattaagtattagctttttttttttcaaaaatgaatcaatatgatttttttaagcaactttcatatataaactttttacaaaaagcacaccgtttagtagtttaaaaagtgtacacgcggaaaacgagagggggagttgggaacggctggtatcgaacacggccttagtacagaatataacacatactaatacgggaggtttgttttttaggatgaagaaaatatgtgtatgtttggggaaacttctaagctagtactacaatttcttttagaatattcagctgtcagaaactatctaaataatccagatttttataatatgtaatcgtagaatttgaaaaaaaaaaataaaaagttaaaaactgaaaataaaaataagtttttttcagattttttaccggctgtttattttaagtgccgtctatgtgatgctagacgacagcagctggaatctacagccatgcaaagcacatggagtacatgattgatgattccgtctgtgaagacgactaacctgatctctatcatttgacgctaaaagataaacatgcatatatgcaggagattataaaaacggaacgaacccgacaactcgaagatccccgtcgtgacatagcgtatggtcgcgtggatgtatgtatgtatatgccgtcgccaacagtgcatcggtcgggcaccttttggcgttgcgtccgtagcggtgaaccgtgaaagatatgaatatgatgagccaacggctgggacctttttctccggaatgtgacaaattatgtacgttacgggctcgtcaaacagccacgttgcctctcatccgtacgtactgcatggcgatgttggagttggagacgatgaaggacgatacggctatgtgactttcatggataaattagtttttgcctggtcattttcattagcttaacaatctggtctttaatttggatttattagttggtgcgtgtaaatgaacagaaatggcaaagatatactcctttagtcaggtttgggtgaagcctgaaacagagctagcaatacttcctttagatctagggttaaaaggctgagtttcagagtgtttttcggattagctattctctcgtttatcattagcacatttttactaatatcttacgatgctatgaaaccaaagacaacaatttccagtgtaaaacaattttgcctttttacaaatacttcctatacagaatttttttaattaaataaatctatttttaaattgtaatactcaatgctcaaataataatttgctaatagctcgtctgatttcacgtgccgatgaaaatctagtccaagcagccatctcgaacgaagccaaaggatactctacggatacacggcctaaagaatgcataccaacttgcatataaaaaaaaattctgcaaaaggtatcgcctagagcatataagggtcggagacgcacccaattatgtaaggatttcatgacatatttgaactcaactagaatggcacgggtacatgacaaaaaatcatgagtctctcaagacaatggagcctacgagcataaataccatcgagatacaagcaaagaaagatcccagagactattccaacaatcacttttcaccaaaccccttcatcgagagcgtcaacaagttactactctaccaggtctaaaatatagtttgttgtactttgttgtacacatactttccgtaaaattaataggttgtagagttataatcttgaggtgtatgtgccttatagttacatataagaaaagggtaacacaataggaacacaaaataaacgaaactcccagcaatatatgagatgacgacacctttagctttaatatcataaacccgcaattcacactagttcattccatttgtactgaactttgatctgtttactgtcaactatttcgatggcttgaaagtatttcctaccaaatagggaaaagcctctccaagagtggctgaccggctgacgggtatatgggctatggtccatgcagaccatggagagtggacgctcgctcctcgtcccaagcaggaatataaattttggttcgaaatttcaggaatattcaaaattttgggaatttcatccctttccgacaagcaaatattctgatcgaaatttcagaccttttcaaatatttgtaaatttagtcataatttatttaaattcagtaaatatatgttaaaaattttaaaaaatcgttaggaatatccgaaattccggaattttgatgcccaccgaaattttcttcctttcctagagggaaaaccccggtcccaagtgctgtggaatcggtctcccaccggcactgcagggcagtaccagtactgcaccggtatacacaaaagaatgcaaaagagcaacagattaggagtaggagtacgtatgctaaaatagtcggtggcagctggctccaactgtaaggaaagagaggcttctttgaccggcgaatgtgacagcccatcgccccatccacccatcaacagcggtagagaagaacatgcggttaaaaaaagtttcagcgacacaaccaccacagcagactcctctccttccttgcttgcttgctgcccagttcggttcttcagttactggagtaccagtaccagtaccactggtagtactcatcactcactacactgttcacaatttcacgcgcacagcagcaaagccagccccgcagtaacagcaacagagagagaggatccgagaccattctcctggcacgtagcgtagcaaaacccatgacgttgctgcaagcccgcaacagctgcagacaggggcggagcccaataggcccggggggttcccaggaacccggcccaatttctgaaataccttgttacccccataaattcaccacatcagcaccccctcagcccaaaaccaggaacccctccttcgtctggcccaaaacaaggcccatcgatgtgtatctgttagagacagcccagctgagaggagaggaggagtcgcgcacgtggttggatccacacggcgcagcggcggcgtcgtttcatctcccaaaatcaagcgcgtgattatttctttctcctcgtccgtcgccgctgagcacctgctccacgcgactccacgaccggcgaccacgcctgacgtctccgactccatcccgtcgtgcgcccgtcaccgttcgcccatggaccgccacagccgtgctcgacgcggcgaccgcccggcgctcgcttgccgacgccgcccgtttcccacacactccgacgactccgcgacctatgacagcccctaaatcctatcatccaatctgccactctgtaagtcatgtactcctacttcttctctcttccaattttgctagtttaccattgatttaatcttaattttcttgcttgcttttgcgatgaacgcagccattcagggcagtctgggagtagaagtttaggacggccggcgggcagcggcagcagcaagctggccggcaatggctggatccatgagctcgccggcttgccctcattgactcgtcaaatccgcctagtgaccacaagtgcttctatcaaaaatcacatccgatagccaccacttacaacaagtggtttatcggttcatgaatataaccaccgcaaatatgataaagattaataggtaactgtttttatttatgtcaaatcatttcatgacttattgtttgttgataattaaactatgccttgttgcatggaggaatgaagatggtgacatcgcattttacatgatatattcatttgttttgggtatggagctcatgacacattattaacttcatatatattattatcagttggtttcttcattatggtacgtattttttttaattttttcatgcactttctcatatattgtcattaattaggaagatgatgcttatatgtattgagtatacaactatttagtataatatcgttccagagctgtacatgtcgatactacgtaaagaaagttaggaacccctcggtttttctctagctccgcccctggctgaagatgcagatgcagaggcgcagctgtttggtattgatcgtcgcatgtgatgcagagttgtgtgggtaaaggccgtgtcccgtactgcccgtttctgaacccgagcctgaaactggagcacgcatggtgtccatgccctgtactctctctctccctcttttgcaggaggaaatcgagggtgtcgcttgcattgcattgcaccgctcgagagacagagcatgccgtgttctgtgttttggtggcaaactggcaactggcaaagcaaatgcaagttcatgttggttcttctgatcttgccaaagaaaccactgcagattattcagaacggtgataggagtagcacacattacttccttttgtcgtggggagaaaagttttataatttagagatgtggatgcgtatgaattggttttacaacagaaaggctgccaaagctgtgctcctttcattttcgtacttctgtctttttatgagggaaatggttgggtgctagcgcaacaaagctgatcaagatattctgtccaaatcataggcgatatataggctcattttcatagactaatcaactcttatatattactctatttactatagtgtcttttattccaaggaattgttgtttacttgttttttttcctccctttcggttagggagagaaggataggtaggctgatcgccattcatcaactaccgcttcccaaccactgccttagaaaaatggcctcctggaggctgtcataatccgggcctgatttacatctgggccaaataaaactttactatgatgcaagtccaatagcccaaatcaaacaaaatgtgcagtcttcacactggtacattttgtcagtttgttttgcaattatccttcaaataccatttattatccagaaaattcatttacaaattcatccatcaaatgccatttattattcagaaaattcatttacaaattcccagtgtttatgtatgagtatgagtcggactatagctgctcaaaattgtactggcaacgtgaacgaccgattaggtttcttacagtgaaacatgtttatccgaatttaagttttaaatttagcatatgttttttatttacggctaattattttattatggtagatgacgtattattctacgagatgtcgtgtatatgggcgcatgcgtcggtaccgtgtttaggaaaaaaaaaaggaattgtacgggcaacgtggcatgcatatgacggcgagattttagaatagtgttttacagggctgccctgtttgtgaacacacatgatcagctcgagtccatgtttgaaacagctcccaccctgcaaattcttgtaccctgttgagtactgtttcttctgtaccgtagttcgtggtaactgacagatgctggcatagtggcattggtatgtttctcaaaccctgcattgggcataattgcattaccccaggattaactagcaagcaaaagcaatgtctctcatcttcggttacagcggtgaatgggcttatcgtcagggtttagtaacggaaataacctagctcctagcatatcaaccatcaacaattaaacaaagctttaatttttttttgttaaagtttgctcagttttgctaccgcggtaggaagaggtaacccccttaccatcgttaagaaaacccgctggcaagcgagcccaagttttttacatgaaaacaaaatcaaccagcaaagcctttcacagcaaatactccgtaaattgtactccatgttgctaagacaattacgatttaacaagacgggcaaggtttttcatggacagcacagcacgtagactaaaacaaactatacgtgtaaatgtaattacagttgcacaagcgatgtgccgctcatcgctggacacaattgaagcctttgcacacgatcatccacacgacgaacaggacgaggaacagcaccaactccacgccgatcacgaccttgctgtagcgccaccacgagcgccgcgttcgccgccgcgcgccgtccgccgcgacggccatcgcttcgccgccacgatcatcctcctcctcctcgtcgtccttgtcgccgtcggcgctcgacgcgtcacctccacctcgtgagtcgtcgccggggaacagcgctgccgtccctcttcccgcggaggcccgcagcgcccgcacgaactgccacacgacggcgtccacggcgtcgtcgcgctggttgcgccgcctggtcgcgccgccgccgccgccgccgccgcagctgccgaacgcgtcgcggacgcgctgcaggaaccggaccgtctcggcgctgccaggcgtcgggtccgccacggcaaagtacgtgcggccgtcgtccccggcgaggaacgcgaacgtgcgccgcccgacgacggtgtggtggtgccagtggtggtgctccggcgcgtggtcgaggcagagcgcggcggtggcgcgggccacctcctccgcgtcgtcgccgtccccttccgcctggaagtaggacagccggtccgtcctgcccctggacgtcaccgccacgcagaagaagacgccgccgccgccttcttcttcaccggcggccgccggctgcacccccgggctctccatcttcatcgcctcctctcttggctttgaccggcgagaaatcatacacactccaatggattcaataagagtcttacccagaaaagtccttgtacgtgcgttgcgtagtcttggtcttcgatgttgtcagcttgcaatgccgagagacagcgtcaaacgagcaagtgcagcagtacggcagatgcaaagtctgcaactgcaactggagcaacaagatccaaaacgtttttttgcagaggaaagatgccgcgctagcattggttatgcacaattggtttcagttttcatattgctctagttgcaacggaaaaatagcacaatgcagagatggcatgtgacttgtacatgctactactccaagaagtgaaggaaagaacccctggaggctaggtttagtagagcatcagaagtaacttacactagaggagatatgcaacgagaagcagcacctctgatacgtgtcttgaggtgtggttttcaccttgaagaaggttaatcgaggggacccaaagtgatgatcttttcagtagaattttcgtttcaggataggataccttttgggttaggtgagtcaaaatgggagtgttttagtgccatcctgtctacctgtgaagttttgtgtgtctgtcttatgtgttttttggtataggtggaacacaatggaactgcactagtagagaaatgatcaaaatttgcctagctccaacgtatgcatcacctcacctaacacataaaaaggaatgcaatgcccaagataagcctaaaatttactagctagcaatgacaggtgacaaacgaatagagaactgcaaagcgaaacatcagccaagccactaccacttaaccatcacaaaatagggttagttggcaatgccacattgcagcaacttgcctgtccctgacactgacagagactcatttctgtgatgtgcacggacaaagaagtaaagaacagttgacttgattcggttccataaaaaatctacagctgatgttgagacatcaacatcttctagtattacagagtaacggtcattcaagtacacgacaaagattgctttcaaggctttaagagtccacacgcacgcttcccgaactactcatcggtacgttttttgtaaaaaaattctataggaaagttgctttaaaaaatcatattaatccatttttgaagtttaaaatacttaatagtcaattaatcatgtgctaatggctcacctcgttttgcgtatcttcccaatctcctctatctcctctcctcaaatacagcctaagcgtgcatagctcattgtttcgagagttggaggaggcgtagtacagccttcgctgttgcagccctcccgtccccaaagaagagaaggatgagtgttgtactaagattttctaattaccattcataaaagagagccatattctgtacatgtatgacaatgatgtgcattaagagatgaaaatttcagggagctaatcccaaccagcctactctatcaacaactcaacataccagattcccttctttggtgcctagtaggacggatacaacattggttgcctcggagctccatggccagcagcattcaaaacataatctccatacctaccattaacaatagaaccaaatatgcatgtactgcaatcatacgtaccattgctgaaccctctgtagctatgcacgggtccaactggtaatgctggttagcaaaagaatagtaggattagattaagagtgacatatatgcagcgtacaacagtacatatagataggcccaggaaataatctcaccttggggattagcactataaggataatagtttgaaaagccataatctcttgtcccaccatttaccattggatccgctggggtatgcaatacatgcatatcactatgatgcacaaactgaggctgctttggtaatggtacaggattgagtttaggcattactggattattgccatttgatgagggtttgtcttgtccagagatctgcaaaagacaatgatataaattcagaaaactgaccctcttcatatccgcataaatatagataagtatgaactaaaacattatctaaaggatgtggaagaaattcgaaatcagaattatcaatcttttgggaaatcagaattatcaatcttttgcgaaattgtatggcacagaacacaagaacaactactagcactctaatttcgcaagctgtaatcatattggtacagtttaatcataagaagctgatgatcatatagaagtaacacatccaaacaaaaaaaaaacagataaaaaggaaacctaccgcaaatttgagtgttttaccataaagccgaacaagtcctgaaaaaagttgaacagcatactgtgcgatttcctctgtttcatactcagcaaaagcgtaacctttgggacaactagtttccttgtcacgaggtatgcataggtctactacacgacctggctgaataagaatctcatacaatattctttcagttaccttttcatccaagttacctattgtaggaaaaaattgcaatataattaatacaatactctgatacagagaaatgaagctgcttagactacataaaacactagatatacaatatacatacaaacaataccagatgacaccaggactgtccacaaaaaacattgcatttgcaggcaaataaattgacaaggttccgaataaattagcatagcccagagaattgctaagaaagctaacaactggagaaaagttcaatagactagagccgctacagattcactaatgcaacaaacagtaaaagactaaaagttcctcgcaaccaaaaaaaaaaagagagaaaagtggaagttcagtatctccatgccaggtaagtttaagaaacgtgtagaaattgaaatgctacttgtgaaacacagtccaacgttattatcaagtaaagttcatagcagcaacagtgcaatcacttgtcaagctttgatactagcatctagcagctctatttccaaatgcactcatcgttttagccagtaaaagaaatacaaggggaacaacaggaatcctttcaacgatacatttgcagttgcacccatcagaaatcagaggaacagcaaccacgctaaatccacaaatcacgcgtaaccacgctaaccgaggacaccacggaaacatcatacaacttaaccaacctaccaagtaccaaccaactaattgatcaatcaaatcaccgaggtgtacatcaatctactccaatccgaactaaaaccaaaatctgaagccaccgcgagcgccgcggggagggggaagaggagacagacgctcacctatgtagacggtgcgggtagggttcctcgccatggccgcccggatctgggcgtgaagctctctcgctcgcagtcgcgccgcaatcaagagggagaaaaaaagcccacgaaagtaagaaaccgcacggacaagttggggctttaaggctccgccgttcgatggcctcttgcgcctcgagattcggaaacgggttgggcccttgccccgaggcctcggtgcaaacggagacggagatgatgctgggctggttgtgtgggcccctttatcggtagttgaataaatgggcctccgccgcgctggtgaaaacacggcccatcgagtcaacgggttaactattattgacccgaggagagagagaagggaagacgtacagtgctactccttgagtccacgtggaggctcgctgttggctgacacgcgtggcgtgcaccctacgtgtaccaagcaagcacagctgtgacgtgtatgcttcaactccggaattgacgtggaaccatccaactacaactcgacaaaacctacaattgaagtagtactactagtactccgtatatttattggctgcaaaattcttttcttctagtacaaccatctttgtttgcgtaacatatcaaagtcggcttaaattattttatctaaagcatcatggttacacactcagtaccccatgtttttatatatgatgtataccgatgtttactcctactatataatcttgtagtaatataaatatataatgctacaatcacatgataatttagttttatttttgcacgggtgacatctgccgtagttagaaaaaaaaaaagataccaccactggccattaaacaaaatctacacatttgagactaaacaacttgattgtttggcactgatttttaacaatcaataaagcgttcgcgaaaaaaataacaatcaataaataatttataggtagaggaaaactctcacatatgcgttcttacggatttaaaagctaatgggagattgtttaaaatgagaaaaaaaatccttaaaatcaaatcaaaatttaacttttcgactgcggcaagtaaccaaaaagcaaacggtgagcctgaaatggacatgatttctctctctggcttttgaatttgaactagtccacccagcaaacggtaataagattgtactcctccacgctggacggaataaacaagggagccaaagagtccagaagaatccacctcaccaccacgcgcaccggtaacaaacaggttggcattggggattggacaggtctcacgatttcacaagtgcgaacgggggtggagaagccgacaagatctcgcggtacaaaagccatcaacgccttcctccccttcctccgatggagccacctcaaaagcccccgcccatccaccgccacgcggcgatccaacccccttccccttcgccggcgcagcatcggacctcgccgccgcggcggttcttctgagcggggccggggcggggcggcagctggggattcgtcccgtgccccgtgctcttcctctgcgtgggccggggcggagggagggaggggaagtcggtggtgaggtggcgtgttgtgtggcgcagatgtgagggcggaggaatgcagaggtcgcggagagcccttctgaagaggaaggcggcggcggcggcgaaggaggaggaggaggaggcaggggtgggcgtggctaccgcggcggccgccgggaggaggcggcggcggcggctgtacggcttctccgtctcgcttgtcgtcgcctgctgggtcgtcctgctcctgctcaaccccctcgtcggtcatgggaacggtcaacgaggtacgatttcgttttggccttcgcggaatcaatttttgatcgatcgtgcttggtgggtggttgcgtggtggtgcgaacggtggttggggaagatggtcgttcgctgaatcggccgaacgtgaatcgcaatattacgcggttacaacatagatctatatatgcgcgtttcatttctgaattctgaataaacatcatggttttttgatgtcctgatgaaatttccgctttaattttaccatttttgaaagatatcgcatgtcaataattttcaaattgacgttatgcgtatttctcggtgtcgattgggctcatgttcggtgctgtctgatttctgcagatgaagggatttttgcggatgaaggaagctctgatccctcgtttgattctgttgagcctaccttgagcgaaggctctgttgattcagttgtacagcaggagaatggggaaaatcatgcgttgccaggtgatagctgtgctaaacccgatgaaaatcatgtgctttctgaagagacactgctggagaaagatcagctttgctccaatgatgaggcacagggtgatagcatggatgctctgcccaaggataacgttgatcagggtgagaatcttccacggacagatgatgattctgtagttcatccagagggggaggtggagagcgaaggtgttccaagaccagcaaggttatcacgagttgtccctcctggtcttgatgaattcaagacacgagcgattgcggaaagaggaaagggtgtccctagtggtcaacctggaaatgtgatccacagaagggagcctagtgggaagttgtacaattatgcctcggcagctaaaggggctaaggtcctggaattcaacaaggaggccaagggtgcttctaacatcctagacaaggataaagacaagtatctccgcaatccttgctcagcagaggggaagtttgtcattatagagctgtctgaagaaaccttggtagatacaatcgcaattgcaaattttgagcactattcttctaacttgaaagaatttgaaatgctgagcagtctgaattatcccacagatagctgggaaacactcgggagattcactgttgcaaatgccaagattgctcagaattttacttttcctgagccaaagtgggctagatatctgaaactcaacttgcttagccattatggttccgaattctactgcacgctcagtatgcttgaagtgtatggaatggatgcggtggaaaagatgctggagaacttgattccagttgagaataaaaggctggaacctgatgacaaaatgaaggaaccagtcgatcagcaaacacaattgaaggagcccactgagggaaaagaatcctcacatgaacccctggatgaagatgagtttgaactagaagatgataaactaaacggtgattcatcaaagaatggtgctcatgatcaagttaccgagacaaggccaattcaggctggcaggattcctggagatacagttcttaaggtactaatgcagaaggtgcaatctcttgatgtgagcttttctgtcttggagcggtatctagaagaactaaatagcagatatgggcaaatttttaaggattttgatgctgatattgataccaaagatgcactcttggagaaaatcaaattggagctgaagcatcttgagagaagcaaagatgactttgtatgcttttctattcacatgtatttttctttcttcttttgttggcattactttctttgccttatcatatattcattcatttcaggcgaaagaaattgaagggattctctcatggaaactagttgcttcctcacagttaaaccagctactcttggataatgtcataatcaggtttgtatagttaccgttttcccttttgtgtttttactctattctcgtattcgagatataggtctatcccgagttggcttccgtgtttgcttgtcaaaaagtgttttccttaattcttttttctgttagctaattatagcttctaatcgtactattgagagttcagataaactacttgaactgctttggtattaatgaataattatgtcggcttgggatgattataactttgtgattcatgttatggtgtctctgcagatcagaacttgaaagatttcgggaaaagcaggctgacttggagaatagaagctttgctgtaatattcctgagttttgtttttggatgtttagcgattgctaagctgtctataggcatgatatttaatacctgtagattatataattttgaaaaattcgatagggtaaaatctggatggcttgtgttgctgttcagcagttgcattatagcctccattttgataatacagtgatgtacctatcaactccatataattgcggctgcgctttgtaattgcctgaggtgtctaattcaaaatctattacaatgcatctttgagatcttacacaagggagtgtagttattataactcgtcggcgatctcagtttggagggtagaaaaggaaaaggctgtggtacccaggtcatttttaagttgcagcaagctaccagtgctagattatttttgtcagctgcatggtcctctccagtggaatgtagaagcaaatctacctggaaagcatgtgcatgcacctggagccaggcaatttcttttataagttcagaaccatgacaggcctccatgtgcttccttgtatattccaagaagagatggagtaatatatatcttggcatgatcgctgtgcactcgatgttcttaatctgagtggccttcctgcctggtgcacatggcctcaacatcatgttgctttacaaggcagtactccgtttgcttccagcttgagaggccgcattgataactgctaacggtactgaatgaagtcaatgacctcaaacatgtactacaaatgtacagctcttttagttgaaacagtactttgcactggtttgctgtaaatttgttggttgcttccagttccagatctcttgatagccatttttgcacatatctataaattataggagacttttgcacatatctataaattaaagtaagtaggcttccatgatgtctgacatttattttagggactacctattgcacgatacagtacttatttgtgatccctggttactggtcaacttgtttcatagaatatacattcatctgctttcattagcaaactgttggctttcttgcccccatggatatcccagttatccacagttttgtacgacattctcttatgtcaacttcagcattacttttgcttgcttcttttgttattcccttaaataccactcttccgtctggagcaacttgatacggtgggctggtggctaaaaaaacaacctataatagcttcctttttttttacgcaaaaggtgcttccatttttcaagcttgcttctgttatctctatctcaagtttacttgtaaatgttcaaaaaaaaagtttacttgtattatcaacaaagcatgctgcagatttagcctcctagctgggtaatcattcataatctaattgcttgggagtaaattactcatcgtatcttttgaccactttgttcctgcgaatgaagtccgtacgggactatgccttacatcttaattgccatcttggctttggattgctataaacagcagactggttgccaggttgggcattggtgcctgcatttgtgctatggtttcgataatttatttaggggtatccgggtatggttggggaattggtgcctgatgggaagtgatgggaagagccgagcatcagaagatctgagcccacctgcttagattataactcacttggcccacccaatcaaggcagggctacgtatcagcccagaggccagagcccccagaccactactgactcttgaagcccaatgtaaggccttatttccattcctcaatgtatgaacatcacacttagaaatgttttttgtttttcaaaaatgaaaacatgaaaacaaacagaatttccacttatgaataatgaattcaggggtatgctcattaatggtacagtactagataaaatatcatacactttaaacactactacatgagtctccctcagaatcggcatatgcctacacgttttccttcagatgacacgtctctctctctctctcttcgatgccatcgatcatcagcaaagtgatgaacataacttagctcctgcactgtacgatgattggaacttccaagcacaagaatggcccaggcagagaatccaagttgcacactccaagaaacgttgcaaacacacagcttgcaccggcccgtgacccgtcgttacccaaccagagacaagaacaataggcaggtcgctgtcagcgtcggtgtgtttgcaccaattaaactctggacgacgcaagatcaaagatgaaactttgagtggcatccacacaaaattcatagaccatggtaaaactcgtgccctggacaagcgccggattcctctcctggattcaggaaatcatcgacgacttgagagctcgagatatagtgcgacaaagctgtgatttgcatggcgtccaagtaacagatatcccagccttgaagcctgaaacagaagggtctttcgatgtgcatcattgcatcttgctgtttgtttttatgtaaataaagaaaaggattgggttggaagatatacgtgtatgctagctagttttgtaggtaggcaccgctcggcgtgatggatatctgacgagagatgtgtacgccaaatggcagcttgcgataagccccaactgttaacgtggccgtctgaccatggttccattatgtgttcacttgcttggagacaagtccaagaagaaagaaagttcttctgcccctttataaaaacgaacatataagattttttttcaaagaagatgagtgttcttctgtatctgttaaagactctgaagatcgaccgtgttgttttgccacacaatcacaccaactttctttttttcaaaaaaagatctctcaacattttcttattcttttccttccttttttggccacttcatttaccgactaccggtcacactgtcacagttcactgcacgcaatccccttcagtaacatacaagtataatactaaagtactctctgaaacaacaacggaagcaagacatgcacacctaacttcagatgtctccttctcagtttatcaaattctcatgatgaaaattaaccgtccatttttgttagacgcgctagtggaacatccatctttctctttctgaacaacagtgcggcgcgcattttcctttttgaacccaaaaggacgcgtaagcaacgctgcagacgcagcaatcctcgcgtcccgccacaacactcaataaaaaacgaagcagaaacccgacgatatatcccaaatccgaatggcgtacgcagatatatatgtccagcgcggaacggcaaggcatcgactcagttctccgcattcgcaagcagcagcatccattttgagtacagataatactcatgctgttcttgtgcaccactcggaagctgcataatctcttgatttttagcccaacggctttgctaatatatgtgcgtcgcttgcgttgccattaattcttggatgttgttgctactgttgttttggaagcgatagcttggagttgtaaggtgaggtgaggtgcagggtggtcgatcagtaggtggaaaggaggaatcgaggagatggacggcgagattggggaggacatgctcacggagattctggtgaggctgccgtacaagtcgctggcgaggttccagtgcgtggccacgtcgtggcggcgcctcatctccggcgactacctccgccggaggctgccgctcatcacctccggtgtgctgtaccaggaaggccggggcggcggcggcggcggcggcggcgaagggaggaggaggcaggcgtacacgtacgcgtgcgcgtcggggggtggtgaccacggcggcggcgtggcggaggccgacatgggattcttccccgggcacgagacgtccaccatcatcgacgggtgcaacggcatgctgctgtactacgcatcgcaaccggcggcggcgttccacgtcgtgaacccgacgacgcggcggtgggcgaggctgccgccgccgcgcgggaagacgctgctgtccgtgctggcgttcgacccctccgcgtccccgcactacagggtggtgtgcttcaccgggtggctcccccgcggcgcgtccgtcgaggtgttcgactccgagggcggcgcgtggcgcgaccacgagctcgacttcgggctcgacaccgacgccatgtcggccaccatgcactacttcgacggcgcgatccacgtgctggcctactcgggccacgtcgtccgcatcgacctcgggaccatggcgtgcgcggtgaccgcgctcccggccccggtcagctgccgggcgcgcgccgggcactgccgtggccgcctccggtacgcgtccagcgacggcacgcgcctcaagttctgggagctcaagaacgcggccacatcggagtgggcactgaagcacgagctgggggtcaatgacctcgtcgccggcgaggcgagcggagcttgccaggccgtcaccttcttgttcatggcgttccacccggacagggagatggtgtacctgtggacgccatggaagctcgtggcgttcgacatggagaagaggcgcgtcgaggaggagtgggaggtcgggccgagaaggagaaggaaggcgcgcatctcattcagatttggctgtttccgtctcgcgccatctggccaacagcttggcctgattggtctatgtggctgataggctggccggcgatgttgacaatggcatgtgggcccaatgcttgtctgcaacattgggcacaatgccgttccgttcgagtgtccaactgtacaaagaaggtacaagacaatcaaaagaaaaaaaagggaaaaaatatatgctattcgtttgttctatggagtaaaattcatctctaatcccatcaggatagtggacagttcttctgtttccataagaaaattgatttgtttttttttacaaaattcaaaattgaattgtttcttgcaaaatttatgtaaaattcttgaatttcaaatgaatactcggtgtttccgctcgttggttgttgtgtactcccttccttccatattataagattttagatttcgactagttttataaataaaaaaaatactaacattcacaacaccaaccctttcataaattcaagcaaattattcataaatccaagcaaactttttataaattcaaacaaccttttcacaaaaccaaacattaatatattaatttccttataaatgtaaatattgctatatttttttaaaaaaaattgacttactagagacctaaacgatctacaatttagaacagataggagcagcttcggctaacaagatatgacagttttgtgtacgaagtgctagatacaccaattaaattgtcttagcttcggctagaatatgagcggttagcagtgacaaatcactgcaattgaccgattgccatttcacaacggtagcgacaacggcgtccgctgatgatgataccagcaaagccactgcatgcgtttgagagtgattacgccaagactattccattcacataattacaccaacaaattgactgaaatcaaattcattatcggcatcatcgacgagttgttttttcgaaaagatcatcagttaattacaaagctccattaaacctatgacatttaattctcacctcatatagctgaactctcactctcaggctttgcgagttcatagaattttgcagccaccgctcgttcacttgggtgctaattaaacatcaaatctaagctaatctactccagttggtaataaggtccaaaagcagaaaaaaaagatatgtgcaaaagaattcgttcgcgcgctcgccatggccgctactcacggaggacgttcggaaacaacccgcggatgtaacccggcatgaagtcgtgtcgcgtcaggatcccgaccaccggcggcctctgcaaaatcatcatcaagattcagatgcaaaaatggcggaaaagcatgtaggattcagctaagttggtaagctctattacccccggcgtcctcggcacgacgcacatgtggcggaggccgagctggcggaagagcacggcggccttggccagcgacatgttctccactacggtgtacggcgagcggttggcgatcgggtggaggtcgacgtacatggccatctcctcctcggtgaggtccaggtcgtcgacggtgaggcccttgcccgacccgggcttggcgaagtcgaacggcgcgagcttgcggaacacctcggcggcgccggtcttgacgcggtcggcggtgaaggtcttggcgcggaggagcacgaggaggtgggagcgcagcacgaggccgcacagctccggctccggcgcgaacggcgcgtcctcgatcaccgggaacccgttgtgccccgtgcggcgcagcgtgtccacgacggtgccgacgctctcgacgctggagaaggcgatgagcggcgcggacacgacgtcgccggcgaccaggctgcgcatgcacggctcggcgtgcgcctccaggtaagggagccccttcatgcgcaccatctgctcgtacacgcccttgttgaagcagtcggccaccgtcttggagacgagcagcaccagcatgatgagcggcagcagcaggaggtcgttggtgagctccaggaggatgacgcacaccgacaccgtcatccgcatcgtcccgccgaggaaggacgccgcgccgagcagcgcgaagagccccgtgtcgaggccggtgagcacgccgagcagcttcccgagcagccggccgaacgacgcgccggagaggatcacggggatgaagaggcccgacggcacggccacgccgtaggtgaccaggccgagcgagtagacggcggtgaagaacgcgagcagcatgggcacgccgaactcgctctccgtgccgccgctgaagaggttgcggatggcgtcgtcgttggtgttgaggaacagcgacgccatggcgttgtactgccccggcggacaccggaagttcttgaagttgccggagcggccgatggtcgggcagtggccgctggcggccagctccggcgggcatggcgtgcacgccgtcagccacggcaagccgaaggagcagcacgaggtgaccagcgagatgaccaccgtaagaatgatcttgtacggcgcgcctttcctgcaaaattaacccaaatgcatgcaaagctcagtgatcatcttgccgaagttgcaacagatgattgaaaattttgaaatgcattgattcgggtgaagattactcgttgatgtagctatacacacgaaggatccgattgaggaggaagttgaagagtgctccaagtagcccgccgacgatggcgagcagcacaaccgcggcgagatccatggtggtgtatgatgtcacctgtgaacttacgtcgaacatgatcagccctcctttcccgaacaggccacagttgccgctgcggcagtactctattagggaccttagcaccattgccgccactgctgtcgtggagaatgtcctccagagaagcgcgctccgccacctgagaaagcgcaaaggttaatagtttcaattgagtaattgggatgtggattttcaattgacaatgtgcaaagattacaattgacaattcaaaagacatgctgggtgtactgtagcatatctggcaaaatggtatttcagatgcaacttggtttttattttggggaattaccaggatgttgcttcttcaagtgcgaagaggacaccgccgacaggggcgcggaaggctgctgtaactcctgctgcagctccacaggtgatcagatccctgcggtccaaatcattcttgaagtacctgagccaattccaagtgaagccatacttgcgcgacccgccttgtcctagaaaggaggcaacacaagccccagtgtgcaccataggaccttccttgcccagcacaaacccagcagacaccccaaatatagacccaacaatctgcaagtacaaagctcaccaacatgatccaatgcacatcgaaaatcggtgtcgtgatgatcaaattagagttagaaagattgaatgtttcaatcaggatcatacataccttgacgaagagggtactgggcgctaagatggacggcgcgtcgacaccattcagataggccttcacctcaggtatgccagatccggcagccgctgggccaaagtaagcgcacaatgctgcagcggctgctgccaacattgcattgcagctgataaaccatagaaaggccgccttgtacctaaagtaccaagaaatgttgagctcaaaaaaaatttttgactggttttgttcatcaattgcaatgaaccgcattggaagggtggactctacctgttctggagcattagattggtcgtcaggagcagcttgaacccggctatgttttcgacggcaatgttgttgaagaatcctattaggccaactattaatccaacaagaagtgctaggacccatttaaggatctgatagtggaagatttgcaatttcccccttgatctccagtcctgcttgtacacttcattctccacaagtctgtgtcatcattagtcaatatggaaaatccattaattaccacacttacattgatcacctcacttgtaaaattgtagtcaaactcaaactagtgttcataataacatactttgggttgtcccttgtaaaattatcctatctctagtcataagatttaagtaaaacttttgacagtcactgacttctcaaatgcttagttaattagtttataaacaaaaataatggcgtatgcactatcattgtataaaaaaattattatacgtccgctccaaaaaaaaacttattatactttataagacaaattttacgtctttcagaaagtgcatgtaaataccaaatttactatattttataaagctactaaattggtattgacggtcaaagttaaaaagttcaaccattttgggaagtagtcaaaccaaatatagtattccatcattagcatgaagcgcgtctataataaaaaatagatattaaaacatacatgaaacatcgaaacaaatctaatcgaaaataaataccggtaccatgaatctctaagggcttgttcggtttaaaggagattgaaaagtattggagagaattgagggggaataattccacaccgcgataggtgtggaataaatcccctccaatcctccctcgcggattaactgaacaaggcctaaagaaaaaaaaaactcgcgagagttagagaggaaggcagagatgtcacgattgacacacgtactcgtaatcgaggctctcgatggggcagacgttggcgccgacgatggccatctgcgacgtggtgttggtgccgcggcggcgcagcagcggccgctccagcccgccgcctccctcctcgatgtccggcatgtcgctctcccacctcaccgacctcgccgatatgggcgttgttgtcattgccgacattggcgtcgagggggcgctctcggctacgccgcccgagccactctctgttcctacagccatcgtcgtactggattccccgcttatggatagcttatttcagttatttacctggcactttaggtagtcgcatcgaaatccatgcagatacaagatcttttacatgttcttcgttagacagctggattttgcaaactatacaagatcttgcactgtatatgtaagattaagacaagagttagttaacgagagatatattaagaaaaatattctgtagtaaaattgtttggataatgtgttatacggaaaaaaacatacaagtacatgtatatgattcggaatactccgtatgatattttttcaacaaaaatatattcaggatatgttatgttgaacttgcatgggaacaacccgcattagcttgtgattgaatttgtcaattcatctccgagaacaaattaggaaaagaattaactattaataatgcagttaaaactcatcgatcaaggcaatgctgcaagggagtacaccaatcaaactaacagcaacatttaccatgaatcaatcaacaaggcgtcaacaaccctaaaaaaaaaagaaaaacaaggcgtcaacagaatcaacgagcttacacggtaggttcgatcttcaatcgtcgtcagggaggccggctaggtcgatctcacaccgaagcgcgggcattgaattgcggtgcgatgcgagcgctcggagaagaggaagaagagaagggatacggcggcgaagcgatgtggttgcaggcccagaattgcgaaggcaaaagggtgattcggtggtgaggcgcgagaggaacggcggttaattagggacgggctctctctctcgccaccgttttttatccacaatgatccgcatactatgttaggttcggcagatgtttttattaggtttttttagaagaatttcgattccgacaagaactctaaactcaaatacataaatcgctagaattcggaataaaatataataacatagtagtagtaataaaagaagagtccgtgtaaactccaattaattaaaattcaaaattaaaaatataactaggaatttgattctaatacgaatctcaaacttaaatgaatatgaatatgataaaaacatgatacaatattaattaaaattcagctaaataatagcaagcagcgtgcttatgaatagaaccggtaatcctgatttgcttgacgtgacatggaccggcgcgagcgcgccagagttacggctcgcaccatctcaccaataggtgggctgtgggcttcgtcgcctatcaacttcgtctcggaataagtctgttcagcctccctcaactcatgcccctggctgaatcacatccctcaaccgcaaaactgggtataacccgcccctaatttccaaaaccgttgcaaatatactccctgagcagtttcgtaggtggttttgtctgacgtggcagtcggctcgctgagtcacaggtgggacccacttgccagtaggcctccacctcatctccccgcctctctctctttcatctagtcctcttctctcctcttccattagcacagacgatgccgccggccatgccacgtgtagggaggacctagccggaaggccgcgccacccgcaggggaggaccttgccggccggccgcgccacacattggggaggacctcatcggccgggaaagccgcgtgcgtgggaagacctcgtcggccaatggctgtgcatggggaggatctcactggtcggctgcgtgaggggtggagctcacaggccggctcctactttggcacccatcatccacgcagggagtagcaggacggcatgaggggtggggtgacaggaatctcgccgtggcgtatctctcctcgccgacgcctcctctgacctcgccatcgctgcctcatctgcgccagagctcagcagtagggcaacagggcggcgaggctcgaggcagcaagatggtgggagctgcggcacctcctctccccaccaccacctcctcatccgcgccctcgccgcagcctcctatcctcccttcccgccgcgttgatggcagcgtcaatggtgttggtgtcggtgcggttcaaggcagcaggaatggtgggagcggaggcgtctcatctcatcgtcggtgcctcctccaaccttgtcggcgccgccttccctccctcgcccatcctctgccgcctcatccccaccctcccctcctctaacctcgccaccgcctcatctcctttctctgcaccgccgcctccctggcctcctcatcccaggcctcccctcctccgaccttgccgccacctcctctcctccctccccgccgtgttaagggtggcggtcaggttgatggcgacgtcgacggtgttggggtcggcagctaagctgttggcagcgtcggcagcgttggggtcctagtcgagggcatctccgtcggccggtttgatggcggcggccggtgggtggtggaggaggtgaggtgaggtgagggcgttgggcgtgggcggtgcaagccgcgcggcggtgactgcctcctcctccctcggtgagttttcaccggccacaccttgcactgacatgtggggctcacgtgttgactcagcatgtcaacagagtctcaaagacgctacgtaggacaaaatcgtctcccaaaccgtccaaggagtcaatttggaatggttttgtgagttggaggatagattatacccggttttgcggttgaagatgcaattcaaccatgcgcatgagttaagagaggtaaagtagacttattccacttggtctctgcgtctcctgaaaggctggcctgctaccaagcaggccactacaaatctggccctaatactgactcgtactctttcaactgctaccaagcctcgaagacaccgagagtccagcttgccatgggagattggaagtctcgaaagcacattggtattggtcagaatccacgatttcttggggcgtagatcaagctggctttattcgtttttgtagattgcgactgcgatgctgcatgatccggacattctgcactgtttttagtggatttctatgcttgctttgtcctcgaaactaactgccattctgcgacaacatggacgtacagcttctcttgtacattatcaaggagagagatgccttgggaaaatgaaatcattcctcgagggatatcctctcgttttgtgcatgtcacctaaatagttataaaaaaataaaaaaaaattggcaacatagattaatatgaaatatatcactccacaaacatgcaagtttaaattcaacttctacaagttgtaacaaaaataacaaatatagttacgaatgtgcgataattattttcagtttaatttgttatttttgttgcaacttatagaagttcaattggtcttgcatgtttgtggagtgatatatttcatattaatctatgttgtcaattgtttttaaaaaaaatgataactatttagatgacatacaaacaacaggggatgtcccctcgagggatgaaaatccacatccatatgccttatcgtaaacaaaatcaccatgtcttatatgtagcaatagtagtagtacttcccatggtccttgaaagaacaaacatgcagtcctagaagcgcaacttccttttccttgaatcctcctctctttttggcatttttctctgcgtatattcatgcctttcttaaattgatctcaaagtatatatacctttctcgttctatgtccgtgtctcgtgttcttgaagctccagatggaagaatcaggaattggagattggagtgcggcctagttcatcttggtatcttatgctagctagtcttccaagctatggatcatctatggcgtcgttaaaatctcctctccttgttcatccatgtcaagcagaagcagctgtactttgaactggccatagtgtagtttgattcactctttgatagcttttgccgtttagctaattgtacagtgttgtacgtctgcattttgttgcattccactgtgacaagcatgaaggccgccatggctgatgaattcaagattgtgctcacgaggaaggagaggttcctctacctcgccaaagccgtcgtgttccttgtgatcttcgcgctcggcgtggtcgccggcctatggacggccaccgggcctcgccggtgctgcagcacatacaccaacattcttttcccgagcaccaccgtgtaccgctaccgcggcggcggcggcggtagcttctcggagttcgtggctccgacgcggctcatgcacgatatgacggacgagcagctgttctggcgcgctacgatggcgccggcgtcgtccggtggcgcgtacccgttccagcgcgtgcccaaggtggccttcatgttcctcgccggccgcggcgtcctgccgctggcgccgctctgggagcgattcttccgtggacacgagggcctcttctccatctacgtccacgcgccgcccgggatggtgctcaacgtgtccgacgactcgccgttctacggccggcagatccccagccaggtgcacgagcacgacacaaacacaatgccgaacaacagcgcgacgccatcattcgcagcaaagcatcatgatctgatcctcgcgatttcatggcttgcttgcaggaaacctcatggggatccataacactcatggacgccgagaagcggctgctggcgaacgcgctgctggacttctccaacgatcggttcgtcctcctctccgagagctgcataccggtgcagagcttcccggtggcgtacggctacctcaccggctcgcgccacagcttcgtggaggtctactaccacaagggcaagacgtgccgcggccggtacagccgccgcatggagccggacatcacgctgccgcagtggaggaagggctcccagtggttcgagctcaggcgagacctcgccgtggccgccctgacggacgccaggtactacccgctcttccggcggcactgccggccgtcgtgctaccccgacgagcactacctcccgacgttcgtcgccatgctccacggcgcggacaactcgaaccgcaccgtgacgtacgtcgactggtccagaggcggcgcgcacccggcgacgtacaccgccggcgacgtcacgccggagctgatcctgagcatcaggaggagcgaggtgccctgcatgtacaactcccggccgaccacggcgtgcttcctgttcgcgaggaagttctccgccgacgcgctggagccgctgctcaacatctcatcgacggtgatgcagtactagttctcctcgccgccaactattgtttgtaacataggatttcacacaacatattcaggtaccaattgtacctgtcaagcaaaaggggaaaaagaagaagaaagtgttcattttgcgggaattttgtcgaatttcctacagtgcgatgcgacaatgcaaaatggaggttggttaggcacagtgcagcagcacaccggcctcattgactgaccaagccccagcctgtctacttgtctcgtggtatcagtgcatcaccccaacttgcagagtcgcagcatcaacagcttgttgccgctgccgcctaaccaaaggtgcattggctaattggcattgaaacaacaaccaaccactgcgtctgcgtgctgcaacaggggacgatttggttgtgctttctaatcaaggaacacgcaggggcccaacattctgatgggggagcctgcactgcaccaacaaccattccagctcttttctcaactttgtgatccaacaactagatcatcgcattcaatttcttcgcacttcactcgagtatgaacgatcgatctattcatggctgtggtccagttcgtcgattttctcggatcggccgatgcttcgctggcccaagaaatggcccattggcaacatatcatatgtaagcagtgtgatgacccttgaatcccttggggtttcagcaactgcagcctgtcaactagtgcagcaaaagcaggggggaaaagcacaaagtaaagctgcagttcatcagccaaggaagggattaggcaaagctgttaccagcacgtccgttgtaactgacgagaacaatcgacaattaggcgaatgattgttagtgcttttcgcaaaagacaatgagcctggagaacaggtggacatagcaggtgggagtggcattgggtacggtagtagaatgatagtatgaagcttcacttttagatacttaaataaatgaagtggggttagtaattaattaaatgggccattatatatggacaaaaagaagagggcgagatctcatcaaaataaacccatacagctcatctggaaaggcatgtactatccacagaagacttggttttcatcatatattatacctgtatatacaagggcatctctctttatgtactcattctgattgtttaacacaaggctgagaaaatttgatacacttggaccttgcatttcaatctcatcaatcccatgcacatcctctcagaatttgagcaagaccgtcgcgttgctcgtcagtaagctgcttcgggaacgcgatctcaaacttcacccttagatcaccccgtgctcctttctgatcggcaattggcatcccttcccctttgatgatcttctcatatcctgggcagatgatctcatcctgaaatgagcagctcaccttcttgccactcaggagcctgaatgagaaggaccagccggtgagcgcgctcaccaatggcacctcggctttcagcaccaggtcgttgcctaccctcttgaagacagggtgtttcttctccgatatgacgaagacggcatcggccggtaggcaccctggcctctcatcccccatgccttcaaatgtgatcttgttccctttcttccaccctggtttcaccagcaccatctggctcacctccttcttgactattgacctgtccaagattgtaaatccattgaaggtgattagtccagcaacactgaaagagagaatccaaggaggaaaggtgcttaatagtcactgtcactgaaccttcctagactaccaccaccatcaacatgcaaaagaaaatgtggatagtgcttattgcccaaatggtccactttgctagatgctagatccaaaactactgtattctaagccctcgacaaacacgtatacgcataagtggcaacgaaagcaacttgagttgagattttatctcctcaagattggatcttaacatgtactaaaccctgatcaacactgctgttattatgctttgtgttaggtaggataatgttgcaagaataggatagataccccggaagagaaaaggtacacaccaaagggaacttgtgtaaaaaggttttcatgtgttccaaagtaagctaaatattccactgacaaatgcaggctataataaagcagtcaccctccactgtaaaaaagaagtgcgccatagcctggaaaggaaggaagtggtcgtgctgtttcactgttcatggatcattttgttccgaacagtgcagagaattggggaggcacaaagcggaatggatgtcgccatcagaacaaattctgaattcttgcctactctgaagtttccaagcatcgatccattaaaattggcatgcaagtgagcgaatcacatcagggttgttccggttgcatcgaattgttagttttaaaagaggaaaatggatggatggatgacaagcgattgctcgccagaattcaggtgaaagctccaatcaatcttggctcacggattaggtggaggaagaaaggggtatacccgttcttggtgacgacgtcgcgggtgaacttgacctccttcttgcagccgtggcagagctcctcgagggtgcagtcgagcttgcgctccagcggcggcgccttgcgcatgattgagctggagaactcggcgaacgcgcgccgcccgccggagttgccggagctgtacaccttcttgaactccctcgccggcgtgccgggcgccatcctcgcgccgaagtcgtcgctgcgcgtcctcgcgatgtgtgcccctccgccgccgaccacgccgcacgccatggccttctcgcccgcgcggccgtcgttgcagcacaccccgaacaccgccctgttctcctgctggtcaaggagcgcctgcgcaaccaagaatcgcccaacatcacgacacgacgccgtcgcaatctacagccaacgcacgcacgcaacgcacggctaggggctcacctcgtaggcctcggtgatggccttgaagcgggcctcggcctcgggcttggaggacggcgggtgcttgtcggggtgccatttcttgacgaggctcttgtaggcggcgcggatttcctgcggcgaggtctccctggggatgttgaggatgcggtggtacagctcgggagggttccccattggagagggaagagaagacacggtggatggatggatcggtggtggtcgcggaggaggaagaagaagaagaagaagaagaagagcaagggaggggagcgaaatgaggagtttgttacggagggaggtggttaagcggcagaggagaaacacagcgagtgtggctgtgtgggtgagtgagtgagtgagagagaagagtggcttttatgtaggggcatttatttgaactggtgtttagagagagggagggaaaaaattgcatgtggggacatagcggcatgaggggtgaattggcaatggacaaggactggagtggagtggactgcctaccatctacttctccagtggaggagaaaaagaattttgatggttacaaccctataaaaaaattcaattctgagcattatttgaataagtgcatgtctatttcgtaattaggattgtgtttttttttacaaaaagagtatgttctaagctatgggctacaagaaataaaaaattagcagattcattagtttgtttagttacaaaaattggaatacacaaactgatctaggggtactactagtactacaaatataattttagaaccaaatccatcattaacggatttttgccgtaagacggaatcgtaaaaagccgtcgtaatgttttttataatatatagtcctgaagaaaggtgccaactacagagggagaaggcgccaaagacttactgcgtgtacggccgacgagagctggagtgttctgtgtgttgcagtagtgcatgattacaagatggttttatctgatggaggtgaatgattggggaataagaacggcacggttagcaattattgccttgtccgtaccggcccaaatgaaaatgctttgctcgtgcatatgatgtgtgtgtgtgtgtctctacttgatccccccattcagatcaagtggctctcctcgcactgtgctgcctgtcagcctatcacgctggctgagtcaccacaacacatataaaattttctttgtacactatcagacagattgtcatataaaattatatgagctactacgcgtactcgattggattttagaaactgcgagcggggcacgtacgcttctagtcaatggccatgcaaacgccttggattcttctgttcccgagcgcgtcgtctcgtcacggccgtgtgcgcatgtgcgaagctggtggtggagatggcgatcgatcggtcggtcgatggccatcgccacctggtccatctctgtgcagacgcgacgccacgtatacggacgtgtaggcgggtacacatacacgtaccgatcttgatcgtccgggccgatggaaattgaatgagcacgttgtgtagtaagggtggcaacaaaatttgccagcggtgcgtacgtattctgtcgcagggtctggagccaaggtgcgtgacgaactgaccaccagtggccactggggcgttggacatgctgtagttgttggtgtagtggtagttgcagtaacttcttcggatctggagcgatgcgatctcacgtggtagattaattttggagttggttgtaaacttgtagtaaaaaatatactgatctctcgattgatggggtgattgcgaggatgcctgcgatcgacgaacacgtgcagtacagtagagggaaaccgaaaaccggatcgattcgcgattcgagggacaaactgtccgttattagcttctcgaatctcgattggggtgggtgatcaggatcaggattcaggatgcaatccccggcgaattaacaagccgccacgagcatatggtgaaccccccaccgaatcgtccgtgcggcgggcgccgcagcgcgagcccaaagatgtttgtcccacgtactactacgtagtgtaatacagtcgcacacgccgcgctccgcaccgcacaccgggttcgtcctgcggacaccgcgcggggcgagacgttttgcgccccccgcttgcgcgcgcgagattcgcccaatccatcgcggcccggcgggttgtgtgggcttgtgagagcacggcgatccccgcgtttgccgtcgcgcgctgcggctgcctcgcgggcctggatgtgggaaaaggctatacgtactaactttttcttattaaattcttactaacactgatctgtttgtaattttatctacttaattgctcatggatgtgttacgcatcgggtggatttcaccacgtacgcgcggggtgcgcgcgggtggcggctaggctcggcgcgcgcgaggagccacaggtaggtcgcgcgtacgcggcggttgctcgtccacgctgtgtcgcgatctttgtcacgtactacgtctcggctcggcgccgctagtttgggtcggttccgttctgttcgatgggctatcctcgtttctcgtttctcatgttcccttcccggagcgtaattggacatgtggcatcgaaacaaaccccgatccgtaactcatggaagccaatgccgaacagaacggacgtagtaaacgatccgtaactcaaccggacgtagtaaacgatcgcagttacaatactttgacgcgcccgatctacctgccaagaaatccttgtacatatatacagagatcgagcaaggagggtaccaggagactcactcactccactatgttcagtagtaatcgcctcactagggacagtcacgtgaaggtccaagaagccataacgttgcttgcagttggggggtcacttttggccgacaatcctgccgaattaagaccatattactacccaacgattcaatgcaacgcattccttggaaaataaatcatcggctagctcacgctagcttcacccagcaaagcagacatccacaacaaacctacagaaaacagaaatgagtcaatcataccagaaagactattcgacaggggtagtagtagcgacgaagtgacagcgagagaggctgcaacatgggcgtccctgtggctgagtgaaacatgaaaggtgaactggtttgacccccatatgacaagtctaaatcagatcaacatttttagataatgaaaatggattacatctacggcttctgttataagacacacagctataagtttaatagtaataaaaatataagataaaagtaaatcaaaatgagaaataaggtgataggacaaatccccaactcccctttaattattgactagcgttaaaccacataaaatattttagctagcaattcttatggaactacgccacccatagtggaataagagacccttggctaccgattccaagagtgtagcaccattgcgcatagtatcctgctcctcctgtagtagcattgtagaccaaaagtggagccagtaggaagacatgaagataacctgcatagggttagataattgtttaccattaaaaactttatcattgcgacaacgccaaattgaccaacatacagcactagctccaattacaatcatcttcttaatggacctagatacccctctaagccaattaccgaaaatgtttctggcgttacggggtgggggatattaaaagcaaaaaacacacatctccaaacaaactgagcgacatgacactcaaagaaaagatgttggattgtctcttgtgcatagcagaaagaacaatgtttgtctccccccattttcttttagccaggttatctttcgttagaattactttctcgtgaagaaaccacataaagaccttgatctttagtggaattttcaagtcccacagaattctctttttgatccgaacattacagttcatgattgcggtatacatagatttgacggaaaattgaccattcttatggagcgaccatacaaagcagtcattttcatttgacagagttatattagctagcctgaggatcaaatcgtcccactcgattagcttttggtcaacaatagctcttctaaaagagatatttagcggcgttgtgctcatgacctctgccacagtagactgcttctttcgagccacattagataatgtagggtattgatctttgaaagcacgcgatcccaaccacgtgtcttcccaaaatcttatgtttgtcccattgccacatctaaaagaaccaaacctaagaaattggtctttgactttcattaaaccggctcagaactgagaaatacctatcttgctagacataccagaaagagctttaccctttaagtatttatttcgcaaaaggtcttgccataggccttcaccattaaacagctggaaaagccatttgcttaataagcagctattttttatatcaaggttatggacacctagtccaccttgatcttttggtcgacatatgttttcccacttagttagtctatattttcttttccggtcatcattactccaaaaaaaaacgtgacccaaagtaatccagtctttgaagcacacctcgtgaaatttcaaaagaaggataacataaacaagggaaggctcgaaagaactgagtttagaagggccaatctcccaccatatgacatgtttttgcctttccatgtgctgagtttcctctcaaatctatcttcaactcctttccaatcaacattccagagtttccgataatgaataggaataccaagatatctaaacgggaaagatccagaattacagccaaatagttatctatattgatcctccacttccttggctttcccaaagcaaaaaaatcttacttttatgaaagtttattttcagccctgagagctgttcgaatacacataggatggctttcatatcagatcaacatttaattcgtgatttggacactcaaacgaatgttagttacagaagggggaagttggggtgaaattgtgtagacccagtggaaaagaagatccgaatcgcttagctctgtcagcggtgagtgagcaatcatgtgctatgtatctttgttagttgtgatgggatcagcatttgcatccatgctatttcactcgaagaaatactgggagtaatgtcgagacaagaacatgggggatccaatgataaattgaagccaaaagaatccaatgatttggtcattttctctttagcaatttcgttcttagcatttgaaaacgatatacccaggatcatatatagttgatgatattccccgcaagaaaatatatttaattgatgatatattttttatttgtcaaaattagatctcttcaacctaggaaaaacactggaccatactgaaataatcctatttgaggatttttttagatggagcgaaataagtgtagctcaattaactagttagactagtggaacctattcacttgagttcaagttttaggcttgtcacttgatcgggagaaactgagcaaagagggaaacaacaatgaaatttctagctctcaaacaagtagatgaataaataaattgtttttaattaaatttgttcataggttaacttgaacatttgatatctccatttttcagaattggtacattttctttctttttttttccgaactatcggtggtacaatcatggaaaagttgtgtatgcaatgaagaatagtattttatacttaccaaggacttaccaaaaatgctaaagttgtggctattggctagacaggggacccccccccccccccctccgaaaatatacagatatctctcaagaaaaaagttcacaatatgatatatatatttcgtttggcaaatcattggcctgtatattacaagttgttggagcctatctaggtgcgtagtattttcatctcctttgggcttgccttttcctgatagaaaattaagatatgtctccctagctgatgatgacttcgattttgtcctttgccctcctactggaaactgtataatagtaaatgttgcttagaatacagtcacttgacaatgatattgtaggtcggactcgaagccaggagagcatgattagattcttcgttacgtcatctcttcaaactattaggattatcacaaaagaggattagagcaatgtgatgacagtttggcacgcacactgctggcgtccaaatcacaaataatccatgagctccaaggtaaaccgagcaattaactattggaatcattttctttcttcctttcccttaacttggttttccttcatgtctttgttggtacctgtgaaacgacctgatgcaacatcagtatacgacatcatagttaacagaggtgtctcccactcaagtgtcggcagattggggaaagatatctagctgcctttttgcctagacggctatagaacctccaaactatgcagaagcagaaccactaatttttcttttgttcaaatattgtatgcattccatcagattatctttacaaaagaggctctgattgatctgtgatatattgtttgattgaagttttgaacaagtggcataaacaagaaacttctgccccccccccccccccccccaatcttcaaggatgtgattgctaaagttgccaatctttcttgctacaagggggagccttatcttgtcgccgggccggctttgccggccaaactttgtattaagaagaagaaaaattcagagtctgtacagaaaaaagaaaaagagagcccgaggctctcacaccacaggggcaaagcccaaaacatggagaatcacccacgcaccgaaccggacacactggttcaccacagggagccttatctttacttgcatcaatcttcagatgagaggcttgtgttaaaagatagcacaaatcattcatgtcccgggccctgcatatttacaccaaatcatgcaatgcccgctgctattacaatatatatgtacgacacgcttggtctgcaattagtatatcctaatattgctcagagcggagaaatggctgggcctgccttgcaatctattctggatattcttccaatgcgctagtacagtccttagtattcaatacacacctgtatgcattatctcacaagtcataatactgcttaatgtctgaaattaataagtggatgacagatgaacagccgggctaatcttagcaaaaacaaattagttggctagtcttcagaaatacaatgttgaagacttaccttacaaggctctaaatggataaaatcttttgcaagaactttaaattttgcacaagatggttttcgagcctgaaacttattgggaaatgctttttcggcaaatactcttttatctttctggaatgaacttgccggagtaagagaaaagattctgttcgctgagatgtcaccgatcattactcgaatgagtcaatgatggaaaaacaagagagcaatgtgtttaaatacgctctgcctctgctttcttaaatacttgtatgtttcacaaatgatgattccacaaggtacttttctaaattatccacatttaactatacaaaaccatacgcatgtcataatgtcagtgtatgtacacaatatttggagggtattttcgttacgttttactgaaaatataacgtgtctctctccatgacatgaaccactttgcatatatttccaacccaattatccaaacctcgagtccatttttctctaggaaaccaaacatatgatggttactgagtgcccgctggtgcacgtacacgaagtaccaagcgtttcaaaccggtatatggggctttcaaaaattgacaccaacctctcaaacctaacatccgaatattgttcccaacaaccaatgttgtctagtatcctaattcttacatgtccattgacgaacttttcgcgcttcaaatttcaactagccatctatcgatgaattccaatagaaactgtgatttcctattcttcaccagccaaaggggatgcggtttccctgttgttcctgttccgatccatgtcccgtagttgatcaacggcagatatcatcagtggtgggccctacatgtcatattcaatcttcttgattggtttcctcatctcgttgttcatatactatacacccttattgcctcctctctctcatgacattataaacaccaagggatcaatcaaatcaaaatggaataattgtatgaaaaccatcgttcaatcatagttttatgtgatttcacgatcaaaccatattatttaaagcggagttgagattactgaaaccaatctggaatcatttttctctctgaattgctttgcggtgtactttcggcggctttggttcacgaaccttactgaaacggcagacaaaaatcactcaaactgaagcactcaacagaaatcactctcatgattgcaagagattggaacaagggagaatgaaatctctgttttccttttcgatggagatgattcctccaatatttatttattccctgatactgtacaagtaccatggcctatcaatggagtcatgaaaccactacggaagaagggagaagaggaagggaacaggctgtgggtgattaggacttaattcgagggcccctaaataatactcacatgacaaggaaaacatgaagcggcatccagtcaaaggccccggctccttaatccatggctaatcaaagatttaataacatccattccgtacgccatggaatggaatgcagatcttacttaatcttatccagaatctacggccaatggagccacaagctagtggtttcttccgcactgtgatcttagcaacatcacagtacccgcacagtgagcaacttatttttgtctccccaatcataacgagagatgaactactgtgttgaccacctgctgcctcaaccatagattcattcacaggttaatccagaaatatcatgacgcgacacaacatgaagagagcaatccaagaactttctccagtgcgatctggtgtctacatatcagcaagtctaaacacgaagaaaatgacaattatgaaatgtttcatgggcatcgcaatatatcatattatattatatcccattccttttgggctcatagaagctcgttcatgccttcatgtttctgaatcatacagtagtccattgcaaacctgggaatgcagtgcaattaattcctttgctcgggtggatggttagcatccacaatggcgacccgtcaagggtacctggacatattgttgagcaaaagagaagtcaaagaaacaaagtgccaaatcatgctcataacaggtcgtaatctaaatctaggtaggatttcacttcgaagttgttgtagtatgctactgtaccaagcactataagcttcaagttgatgagcgaatctgtagcgatggatctcattgctgagttaaactccttaagagcagtctgcctcaatcgcaagtgttttggtgaccccagggcataaatcttctccaaatccctcgtctgacaaggagacggtacagccattcatgttcagacaggcctgccaagataaagtaaacaacagttcagcacaattataaagtttgatggtcagtaatatcaagatctccatataacttcagtccagaaatagttattggacaactcatagggaactcatggctcctttgaaatggaaagtttttaccctcctatgtgcccaacccagtgttccctggtttggaacagtaaaaacataatataattccagttgctctatggctacaagtcagaactgatggatctaaatccacatgcatcgacgtatatcagaaagtcagaatcaaaggctctcaagttttagattagatgtgcactttttgtgcaagaactgtgcatattaccttctcaacaacagatattgagttcggatggtggcagcttccttgttggtaagatctgcaggttccactggggtttccaaaactcacaaacttaacagaagagatacttttacccttggggcaagacaactgtacttttgctgcgtctctaccatcattttgggtattcctatcccaggattccaagtcaatggaagggtagtgctctgacacgaaggagcacacacttgccacagttcttcttgagaatgtgatctttgtaggatcccctcccttctcctcaaaaatcacaagggtgtttcctgatggatgaaaccatgaccgtgggacatggtaccttgaccaaatgcaaacagaaatgtgaaatgtgagaagtatgaaaaaaaaggtattgtgagctgtgccaaaaatcgtcacataccatctttgagttggctgcccacatcctctcctgcacttatttggagaaaacgttcctctatagtcacaactggaagtacacctgtcactgacaggacttatcctgggccaatacctcccaatggcatttccattcaaccaagccaggcctttccccatagactgcatatctaatccaactggatcatctccttggggaacatcaacgtttacctagaagtatgttgcattagtagtttaccgcaagtagtacgatgagaaaaacacgtatggaaaatatagaccgaagaaggctaccttgtaccatgtcattggttgattttttggtggctcagactgtggcatccaccttatgtccttccccttatcagccttgaacaaactataatattccccttccaatccaatctaccaacaaatacataagattcacataaacattacacctcaccttgccccaaatactggatatgtcatcatagaaagcaaacccaagtacatagaaagagaggagaaaaattatagaatggctttgaaggaacagtatactactttatcatcaattgagttcattacacaaatatctgaacaaattcaacaatcttgtaccttgtattcccatttattggaagacaagtcaattattctgttttccattcctgagatcttcacacttgtaatgccggctcctgcccattcgtacatgggtcctccattcttaaaaggcacacagtttttatcaatcagatgattcaagcatttttaacttgaagctaaaatagcaggcttaacaaactatagggtacagttagaactttcttttgacaaaagtgggtacaattgacatgccataaatagcaatttgcatgtaaaggatatgcctcaagtttagtcatacactcgtatgtaaaactcagtaaacgtaggcacttacttgcaaaccaacagtcatactcaatagggaaagtttgttcttcccagccctcaaattgacgggcatttccacgctgaaatttgattttgagccattaccatatgcactacctaagaaagatttgcaagtagtaatgacattaaacagaagaactcaataattgaagagaactgtaaagtgtatatatgcaaagaaagtgctgctgaagatatatatggttgtctttttggggaaaaaaagatgaagaagaagaggtgacaattatataaaactctcatttcagggatatattttgattatatggaaatgattgggcattcagaagattcggctgaactgaaaatggtattggatggtgatttgatgatggtctctcagcaaagtaagggtaagcaacaaacctataagctcattgttcaggaaagcctgaacagcatggcctttggattcaatatgaagaacatggttgccacctgccagatgacttccatctacgtcaaaactgcatattccacaaagaataaagaccacataattaactgaaagttcatagttaaaaaaacttataatatggacaatactaagatctcttttttggattgttacatgcatatctatttgcaatagaagtagtatatatgaaacagactgcagtataccaaccttgttgtgtaccataggtagtcagtagagtcttttgttgtattaatatggtctacaaatccatttcggactaagtcgatattaccccaaatcccatatttctctctgaaaatgctccacccatcaacttttgatgattccaaatttgcagggaccatatccatcatcagagtttgagatcgcacctaaagatgaagagccaggagctacaattatttgggagaaaagaacttcgtgcaatatggcactttttatataactcggattaagcataaaatattctgatatttgccatttattttgctcctttttaattcctttgctatccatgttccatttgttgagaagggtgctatccgttttgttttgacaaggctttttttcttttaagaaaaacattttttgcagcaatgcatgttgtaattcagaagaccattgacatagaaaatcaaatacctttgcagtgttgaacgccacattcttgcagtcaggcaggatactgaccgaccaagcaggaagatcatacgaccggctctggaaagtaacaactttgtccttttctgaatcaacattagaaaggaatgcaacacatcctcctgattgatcagtgtaaacatcagcctgcaagcaaaaatgggacactatcaattccataagttggtagaagaaaataatgatttaatcaggggataaatacaggagcaaaaagtgaatagcagtgtgcattaaaacaccaatgggttacagtatggtagacataagcagcatttaaatgtacaatgctccttacagcagagatgggttgaagttaatatccataagaagttttgatgcaagctttcatataatattgaaaccagatttaggtcaaaggttataacgataaaacctacctcttgttgaggccccagagaaacaaatgacgaattaccatacaacagggtatgctcgcccaatttgatagatttgtgaaggtcccttagatgagcccatttcggaagtctcctaaggcctgcatttcagatcaactaatactactaagaactctttaggcttaatagtttgatggaattaataacagcaataaatccaaaccatattcatcgatcggtgcatcatagtcatagctagtagtaatgaatggccctccagtagtgcgaccgaaatttgttccaccatggtacttcaaaaggatagagaaaacttgattcaactttcagaaatatggagcttccactagttattcatactgacaaattgtattcaaatgactaaaaatgtatcaagatgcttgaacttgactgtaaatctttggtagtgcaatcaacagaaaacaattatcagtgtgcctttatcaaattaaaatgtaacttctgcaacagcaattaccacatagtaattctgaaggctgccacctttcccaaaaaaacgtgcaacagaaaatgcaacatcttcagggggcctgtggggattactttcgccaaaggtctggaacctaaattcaaataggaagaaacaagcagcagcacatcaattagcttctcttttaaaacatctacaatattaactccatattgtgctataaagacatgagaagtactagatggagtctgttgctaatatgtcaaaatcgttaccatcctggccaattctcagtccaaaattttggcttggttggtgaatttggcttgaattgatcacagtagaatgaattgcaagtgtttatctgcaaaagtaaatttgaatgcgtgagtgtaaccgcaaaagaaaagttactgcatatgcaaaaactttatttacatcagtatcaatcacatgaatatgccaagatgttatgaatcacacaatgacgggaagaatacttgaagacgttatggaaagacaatcctgatagctatagcagtacaaaaacaccaattgcgaggttacgatttcaagtgccacagattatctgctgttcactgttcagtttgcctaccacaatctctcagattttgaaaaaacttttcaaaggattttataccatacactgtcagtgacaaaatatagcagatgtgctggtctttcaaagaattttacaccatacactgactgccagtatgtttcatggagcaattcatggttgaaatgtttcattaagcaaaatgtgttgaatgttagaaactaaccactggatcaggcgcatcatactgctggcacatgatccaagggacaccagtattctgagccagagccatactagctgcccacattgcatatggcttggcaccagctccgtacgcttgttccatatctccgtattcattttcaacctacagtgcaccaattctgccgtcaattgtgaagtacacctatctcaaagttgatagaaacagattgatgtttcagcgccccaattaggattagtatgacaatgtccagacctgagctaggatgatgtgcccaccctgcgaagcgaagaattgttctttcttcatcatatccacaatgtacgtcgtgaatctcttcatgtgagactgcgtaagtaaatgtcagtataaccatcaccaaacttgcaaactccccaaataaaacgccacgaaattcacaagcccgccacaccttgaacggctcattgttcgtccggaacaccgtcccgggcgcgtaatgcagccacaccggcacgcccctgtacatccacgcacacataaacggataaacccatcaacccagagaaatcgaatcaccataattctgcacaactacaaccaatcgtgacactgcatcagtataacgaagaggcaaacccgaaggtccattctgcggcgacgaacggcccaatgcgcaggatcatgtacagcccggcgtccttgacgatcttcgcgaatcgcaccaaatcgaaccgctcctcgaagtagtactgcaatcagcattcaccaatcgcacacaaaacacacaggtttatcacggatcgaacatgctaaatccatcacaaattttggagaggcggcccggacctggccctgggcgggctcgtggccgttccagaacacgtaggtctcgacgcagtcggcgccgccgtccttggcctcggccaccagcttcggccacatctgcgagcacgagcagcgaggttaccggtagtaccaccgcaatgcgcgcgtgctggcgttcggggtggggtgcatacctcggggacgctgcgggggtagtggatggaggtggagatgaggaggcggcggcggccggagatgatgagggagcggtggtcatacgtgacgctcgagttggcgcccgctgcggcggcggtggtggcgccgagcaacggtaccagcggcagcagcaggaggagtagcctccgcaacgagaagtaggaggaggcgcccgccatggccgccgtcgagggtggtggtcgatacggcgtatgagcaagtaccacgcggtggtggtggtggtggtataaaatagcgtggggagggagacgccgcgccgggggagtggggacagtggagtgcagttgtttggattggatgcggcacctctctcggtgtgccgcgccgtgcccacagtcccgacgacggtgtggacgccccatctctcccgccgttccgcgcaagcaaacgcaacgcgacacacgcgatgggcacgcacgcagtgtcactcgcggcttgggttgggcagccggcgcgaggacggtgcgtgcgtgcgctgcagctggccgtggccgatgggttcgggggatagcggacgcagcggattggggatggatatgccgtacgcgacgcgacgcggggagggaggggaagccggggaaccgtggatcgcgtcggcgtcgcggagtcgcggggcgcatccgcgcatgtgaccttggtcgggcctcgggtgacgatgagtccatgagagcgaccgctgcttcggcggtggacccccgtcccgtctcctggacgagtgccacgttttcgtgacgacccccgtgtgatgcacagcctgtacaggggtagtggagtgaagatgcgttcaggatctgtgtccagcgaacggcgctctgtcacagctttcaacaagtttgatcctaacttctcaactcaaacttgtactaccagaaatcgacttcaattagggttccacatctactttccaacttcaacatacaaacaaaatccccgaaggaaaaaaaaaacagctttcgatcacaaaaatgaacaatcaccacttttcacatatctagtgttttatttaaatttcactttggatacttttaggaagctccagggcaggggcatgttgaagccaacctcagacatgcaaaatataaatatttgccattatcacattttgacaaggtagggtgtagagtcaagtgtttgttacatttccgaatttcaaggggaaattatagtattgcgtaggtttgaatttgttgctgcgtatttttttggtaagatagtggtatttttaaagcatgtatggtttgttatcttaccaaaatcagatggtgccaaaatctaatagtgttagaaattgcagcgaaccaaatatgccattggaatttgttttgttccagatttaggcgctacaaattttagcaaactaacaaatcatgttgtttagcccttctaacgcgttgaattgtgttaaaaattgatttagttttattataataatatatttattgttatgaatacaattctctctatttaaaattattttagctaggtcgaatattcttacctttgaccgtattttcttttaaaaaatcatataatttaacatcataagatttaggtttatgttttcaaattcattagagaaagcaattttatgatatatgattcacatgtcgttaagctatataaatttctagtaattaatggtcaaaattgaaaatatttgacttagaacaaatctcagataataagtagttcaaaacgaagggagtgacatcataacaaaatcaatgttgaagatacaagtggttgatggttactcaaatgcacaacgtctagattacagtcgcaaatgcaagtactcaggattccatcaaaaaaaaaataatacacaatatttaaaatttatcctaaaagtagtaacatttttttcacctacattctaatttcaatcaatcacaacatctctttgttcaccagacatacagagcacaatctaatttagagcccagtcatcgagccaagcgttgttgggacttaggagaggagaggagcgtggttaggagggagagagaggagtttatgtgaatgatcgatcgggtaagagtgtgtttagttcacgccaaaattgaaagtttagttgaaattggaacgatgtgatggaaaagttgaaagtttatgtgtgtaggaaagttttgatgtgatggaaaagttaaaagtttgaataaaaagtttggaactaaacaaggcctaaattgggtcaaccacatcagttagtcacttataatgcccttataacctatttgataacactctagctaactccaagagcgaaatctcaagtatagctttggagtagtctgaatcccgcttcatctttttagtttatcttttcagatcactctaacatgctcggctctttttaaaggtagagttaaagcctaaaatcgcatggttggactgcagctatagatgatacttttttcgtcaataaaaaacaaacataatacgacatttgagtatatccaaatctatagtactaaaatgtgttacatctaggtgacacttttttcatcccataaaaaacaaacataatatgataatccattctccgtagtattctcgtattaggtttgtttttttataaaatttgtactaaatatgatctgatggcttaaaattgttgatgatgtggcttcttgcatgtcttactttatagaagtaaatgtctcttaatgggtaccaactatataagaagataggatggagggagtatggatctccaataacagtgcaggcagtggcggagccaaagcccggcttgaacaggcaatggccctggctccaccagctgcacgcaacaattcaccagtaaattagtgcctaattatcttagtaatcacctttcttagtcaccggcaagacagtacaatgcaactagtacaacagtaaacgcgctcaacacaaacttttaaaacaaatgttcatactaaagttatctatgaattatataggcttgtatatacctcatttgttgttagacttgcccgactcataaaaatttttgaatccgccactgagtgcaggttagcccatccgttcgctatcttcgatctgctgttcaacaattccgcttccgccttccagtggcggttacgtaaacgcctggcctcctgttattctccgccccgtacagaaggaacagtagagctgtagagcacacatcattctcgttctcctcccccaaaacctccacttgtttcttcagaccccaagccgatggcggaggcgtcctcgtcctcggcggcggcggtcccgccgctggacccggaggcgattgccgccgtggcggaggcagcgccaccggaggagatgacgctggtggcgaagtggaaagggaacgactacacggtgcgggtggtcggggacgacacgctgggggagctgaagcggcgcatctgcgaggtcacgggggttctccctaaacggcagaagctgctctaccccaagttcaagctcaacgagtgcaaggactccgagctcatctcctccatccccttcaagcccaacgtcaagatcaacatgatcgggtaagcgcaataccctccttcctcctcgaaccctacacctccatgtgccgtcccgtgtctactctcgctcgtgttctgcagatacctgactgcgaaaacatttggttactcgtcgttgaactggatgattagctcgtaattcgggggaatgttggatttcggttggtgattcgaccgatctattcgatccagtggcatcgcgttgttcatgatttgaaattgttgtttatttcctatgggttctcagatgctgggaacggtatttgaagtttgggattgacatccagtagcagtatgtggagacgtttgtctattagattagtttcacgaatggacgtggagtaacgtggagtgactgaggttatgtggtgttcatctgagaggaaggaataaccttctcaaaccttgattcctcacagtttgaacacattcgggagtgctgtagttgcaatggaatcatccgtggagcatgtgaatttattgttaaattgatgcattagtgttaccaatggctgcaaaatgattatggattagtgggttttttaaatagaaaaacagcaggatgttgtttttcttaaatctctagaggcccgttatcgtttcttttctgatgtgtttctgatagtgatgcgaaattggatggtggttgatgttatatgttcagttggcatgtttttggtggtgattgaagaacctgaatgatgatccaggggcaaactagttagtctgtttgtacagtaccatttaagcctatgatctgtgttgatgtgttctaatctgaaagtgtgctttgttgaacttgaactttaaagaaagtctgtttcgagtttggacaataccatttaggccgggagatcagatcatttaccgtttagatggaaaattgaggatttaccctcctatgccaatgacatgtttgagtcatctaaggtcatttacatgtgggtcagcagggtgaatcctcaatttcaatcaaaacggagggtatatggtcaaaattttcgtttagggtatagatctgtgtcctattctgaaagtttgctttgttgaacttgaaaccctacctatggacataattcgattagcttccttttattctgttttataatgtgaagttactcattatgctttgccacttatgtgaatgttatttcttggtaaaatttgcaaactaatttatatgtcagtatgttcttgactgttaaatgcttatgtgctatgtggtttgagccactgatgtaatccgatattctgcacatggttggatcatgattcgttattgctaactaaactcatgctttgcaacagatctcaagtaaatataccagaagagctaaacatgaaaagttgtatatgtttctcagagaacatatatacttccaaccataaatcaatgagataaccctattacagcacatgtgcacaaatgagctatccacaaaaacccaattagttcaagaggttccttattatccgcatgaatcgcaccaactcaaggaatagtattgtgatggcagactcaccaccaccaccactaatatgtcccttttatgtagtagagatcttaattatacacagtaaggttgtatagctggcaaattgtaaattgggtgtagattgattattattgttcattcatgtgataaccttctaatggtgtagaagactaggaggatcttatgctatttatattgggacggctgttacaaagaactttcatttgacacacctttttgtttctaatattttgtccactccatagtacttccatttgtaggatcagtagtggatgcttggatggtgagaaaaatgcatgtaattgcgctaattatgaacacttgtaatgtagtattcctctttagggaaaaaaacatgccttatggagggcttgcagaggaagtttgtgaagcatttaccttgaatatactttggtgtgacacttgtggtttttctagtgaggcactgtgaggtgagagctttgatacctttcctgattcagatctgtttttatcatttccaagatgaaccatgggagatggacctcctcttaatattgatttagcactctggctttactcaacagtcaacagcagcatattcaagttttcagggttttttttttcaatggttcaaatcactcttttgctgcgttacatctcaaagataatggttctgtttgaaaatttgaatttgtacaccatgtacttatgtcccatttgaaggtgctttctatttactttgcattaattttgtatatctttcagcactgttgaagatgaaatatttgtggaccaagaagatgatccagagatactcaatgattatgaaataggccagaatgaagttactgctatcaaggataaagatgtctacaagcaaaaactaaaacggcgtgcaagtcaatataaggtatattcccgtgtcattttcgtttcctgtcatatgcttcttccttatccatgcttttatggttccacaatatcctgtttgttctgacagcctgagccacatcttagtgcttgttcctttgacctacatgaagttggtaatatttcctagcgtggttcaggttgttagtatgtcagcatgtcgattctagaaatattttgtggtttcacttgctcatagaccaaagccataacagtgacgagggttattctctctcttgtgtggtgctgattgaagccatagccagaaacttcttttcttagcaatgatccataagtctaagcccctaggggaggtagtttttgtggatagagattttggacatttgtgggcgct

SEQ ID NO: 61070 - DNA, 7593 bp, Oryza sativa
agggattcggcccatcgaaccgcgagggaggcgaaatagacttttgcggagggatttgatttgggaaggatttggattcgggatgaactcgacgatagatcggggatttgagatctgagatggcacggacactagacaacaagcaaagaaacagatttcgcaattaggatttttaagagatagttttcccgctaggcgccacgacggaacgggcgctacagtccgcccccatgtgcgcggatcttgctatgacaaggcagatctagagcgggtgatggcgggaggtatggaggtggctgcggcaacctcagcggcgggcgggtgatgacgggagtggcgacgatggttgcgatgacctcagcagcggtggctcagtctcagacggttggctgggcgtgggactgccgtcgacgaaggagccggaacagcggcggcgacaggctcagcctcaaacggccgacgggtgtgggaccgccgccgccgaaggagcgggtaggtgggggggtttcggtgcttgggttttttcttgttgggattttttttcgtggttatttttttcatgcggttagcttaagcacccgtatgttaaaatcggatttttgcaaagctttgggtgcaagcgggcaacccgtcctcatgcaaaaataataattttggccgccgaatctttagtagcgagtgtcaggcatatgtcaaaatcagaatattaaattaattttctgtaatatgggaatatgcgatattcttatgttgtacggtgattcctgaaccaatagtagcagtatcatctatatcattaattctgcagtcactctactgcagcctgttgagggacaaatgcgatttccttggaacaaaactaacatgtaaaattaagaaaaaaatcagatttaaactattggcataaatctgcataatgttcaaattacaaaccacatagctagcactaccttttcaaagttaaggtgatagtgtacacgtgcccctagtaataacagaactcaaacttaaacattattatgtctcgacagacatttccagcaatccttacaattactaactaactttgcatcatgcgtgtattctggtcggctatctgctgatctcgtatataggacactgtgattcattatctaaaaaattattaaagcctaactccaaaaacaccgtcaaaaaactgtcagcgctgccaagtactgatatctgaagatcctgcaggcgccgatttgcctgtctaccatatattaattcatctgaattgacattaccttattcatgtagaacatctgaatcttattgagatctctacttgtttatgtagaacatccaaactgatcaatcatcggtttgattaattgcagcaccgatgcagccaaattaaatactatcgctccgtaccaagacaagcagtaatctgattgcaccgtaccacacggaactctcactctcaagagaccagatcgatttgctgaaaattctagcatctaagggtgtgtttaggccctatttatttccaaagtttttttttcaaacttccaactttccatcacatcaaatattttatacacacataacttttctatcacatcgtaccaatttcaaccaaacttccaaatttcagtgtgaactaaacacagccttaagttcacgtcaaaattggaaatttgattgaagttgaatgatgtgacgaaaaagttggaagtttgtgtatgggaaagttttgatgtgatgaaaaagttgaaagtttgaagaaaaagttgggaactaaaccatgcattaattggttaccttcactttctctatacatgcatgtgtggtcagtactaaacgcctgactgtaaaaggctaaatgattttttcccactattttctagcagggcgaactatcggtgtccaatatatagtcgacacacgcatatgcaatggcaaccggtcaataaatgcaacacttgcaaataagaaatcagtggcatgtgtatgtatatgcctgtactgttgaatatagtcttatttgatactgttgaacttgaggttataattggtgatggagagtaaagttaaagtcagacaccataaccggataaccctttaaatagagagggtgtgttacagtgtaaccatgacgactactataatataacgtagacatgcacatagagagaggatgacgatgaggctaagaactcatagcggctagtaggcgctatgtgagttagggaggaacaaccataattcaagtttcggggattaagtttcggatgaagtaagacttatcaatacacagtattttcgaacaagttgaagtactatatagtactgcattagctaaaatttggacctactgaatctctcaagaaaaggtccaaacacatcggtttaatttatcgtcgtaatcttcgggatccaagtcagtgcctgcgttattgtatggcagcctctagtagcagcggcgcgcgacggcgcgagatcgataaattaatgtgcagcgcgtttatctggtgtcacgacgactcaggactcacgagaatgcatggcaacacgtaccggccgccgggtcgttgcccatggcaccgccacacggtcggtgtgtgacagtgtgagcagtgagcgcgcgcgccacatgctgcgttctccattgccacgaacacgaagtcgtcacggacccgtgcacgcgctgcaaatctacctgcatatgcatgcgctttgacgcacgaaacactcaacgtggagcatatcaatggcacaacgcacaacgctggtacatactgtagcacactagcactaggacactgtacgcctctctagctacaaagtgctaggctactgtagagctagcccggatgaaaattgagacctatatcatctatccatggatctgatcgatcgatatcgttcgaccatgcaacgtacgtgcgaggctcttatctctcttgcggtggcgccgaccgccggcggccgcatttactgtgtctcgggccgcgaagatcgatcgaagaggggaacatggggatcgagaacgagctagctgaccatggcggatcgatgcgcgcgcgacgacgcgaaattccgccctgattggcggtggtggatggcgcgcgcgcggatgccggttgcatttatgttttcgtgcgtgcatttgccgtcccgcgtcccgcgtcgcgcgctcgatcgagcatgggatggccggtttcgcgtagtgagtagcgacgttacgtacgggaagatgcattcttgccattttgaattggttgtagaattctgtgtaggcgcgccggccgaatgggttctgaaaaggatggcatgcagttttgtgtaggttttctatcgtacgtgtgtgtgtgatgagagttgtattatcactttggaattatggaagtctgcatgtacgtgatggcccagaaaattaagttcagcatatgggcacctgtacgtatctagctatagttgtgggattttgatttgctaaacttcttatatatccattgcatcgaacgttgtttaattgtcactctcagatacattgtcgatctagttatctgctgaaacgatcatgtcagttcctgtataccaatggctatatctacaagaacagcttgaaacatttctgttcagtctcgacgagtagtcgacgtaaccaattaagagaacagagaaggacaccaaaacacagaagagatcgatcgacttgtcgagctaatcaccctgaataaactacagaccatatcagtttttagcccttcgtccagggcctaaccgagtagtagtaggggttgttaattcgcgcatacgcgctagtaatagagccgtgcgcgcgttttccttttttccttttttcaaatttggcgtacgtctccctcccctcagcggcttagcgcgtttttcttttcgatttttttaaatctatctcacgtgttttcaattttgatttgaaagctttcaaatcttaacttaaaagttttacaatctgaattaaaagttttaactcaaaattcaaacttgaacaaatcttgagtcgaaagttttcaaatctgggttgaaagttttcaaaagttgacttaaaaggtttaaaaatttgagttgaaagtttttaaatatgaattgggagtttcaaatttaaaggcgaatgtttaaaaattgagttagaaagttttaaattatagatgtactcaaacatgcactaatcacgtcgttaatcacacgctaattatgaggctaattacgtgaaggatgacgggcgtgtgcatgggcagtgggcctgcgcgtccaaaacgcgcgcgagttggctcgccagcgcgtacatgcgcaatagcaatctctgtagtagtggccattcaagatgttgtaccgtacctagctgttggtattatccgatgatatatatactccctatttaaaaaatttatgagaaaattagtcacgtataaagtattatttgtattttatgatctaataaaagatactaatcgtagaaaattttttgataaaacaaagagttagggtgtgtttagttcatatcaaaattgaaagtttggttgaaattggaatgatgtgatggaaaagttggaaagtttgtgtgtaggaaagtttttatgtgatgaaaaagttgaaagtttgaagaaaaaatttgaaacgtttgtgtttaattcacatcaaaattaaaagtttggttgaaattagaacgatgtgacggaaaagttgaaaatttgtgttgtaggaaaattttgatgcgatggaaaagttataagtttgaaactaaacccggccctaaacgttgtatccaaatgaaatgaaattttggtagtacggagggagtaggagcgtgacggcggggcggggcctggatggaaaaaaacgcggagatcgcaagtagcgcattgaaggcctggggaagaggattcatgtgaccctgcaccggagaaatttgattccattatcgtcccatcagcctgagcaagatactgtgtgcggtccaagcttcggcaatgggggccctagcttcgctgatggtcgccgcggtttcggcgtcgacgacccctgctaatggtgaactttaatggtgaactttgccgagcaccaccactgcagtttcacaactgttgatcacctattcatctgcatgcgtatggctggcatgtgcctaaagaatcgaacatccatatgaacattgtgaaaccgggggggccatgcatagcggtcttgtgtttggacgccaaaaactgttgagcatatgaccggttttccggtgaagctacaataatctgctagctgttctacgagtgtgacgtagtatacgttttcacttacagctaccatattaaatcctgcaaatcttgacaggtgcgcaacagttcaattaaaactggtgaacaataatcctatcaacacaaaacactaaaaataaacccctcaaatcgttggtgatttttttttagacatgtacaaatatctatatacaaaggcatgtacttccacatttccataaaaaacaacctagtgttagagctgttgttgacgaaaaaatcgaacacaccggcctgggagatctgcttagctcctggcaggtccaaatcttgatgagattcgggcgtgccagtcagtttgatcctgcaactgacaagatatgcaaatagtagatcaaaatagccgatcggatgacaagccgatggagtagtttcagccgatagccgataatagccgatgccgataccaaccgatagcgatagggtttaagcaatcggctatatgtccaatgtagataatgatataaaggcaattggctgatgatgatgtaataaaataacaatataatccaatataaaccaattagctagcaatgatatgataaataagcatcgatccgaaggttaaagcacacatcggctggaggtccggtgtcatgaaatccacaagattagattaaacaatgaaacctttgttgtcattggctaaatccaacttatatgtatatgcaatcctcatgagccgatgcaacgtccagataactcaccggctgaaaccccgatgaaacccttattggcaatcaataagcaggctagagattatggttctaagcacgacttagtagatcaaacttaactgatgcagcactaagtatgaaaagaaacataatatctagacaatcaagccgatgactgattttcagggtggtagatgcctaggctaatctaatctagaaaggcgatttagctgataccggcagaaaccctaaagcgagagatagtcgatagagctaaattgatatgctaagactagattaacatagacatatgataaataggtaggcaaatatatcatccaaaccagagcaattcaagaggtcgaatgtactgatgcagccttgaacgacgccgacgtaaacgatacaattgcctgggccggcggaacattggacttaccccttagccggagatcgaacactgatgcagccccgcgtcaggtgccaagtcccgccggacgataaaataaagtagaaaaggtaaaaggtggcgatgcgccgaattgtattgatcgtgaagatagattacatagaccccgggtgtacatatttatacccacgggttgatacaagtccttatcggataagaaagaaactttcctaaagataaaaggaaaagataaagttcttataggacactaaacacactttcctaaagataaaaggaaactaacaaactattcctaattaatagataacttgccatgccgcatcctctttgaactcggtctcatctggataagctccctttagtagatcaatttccttaaccgaatatagcaagaatccgacaactgacgacttgacaactctcatcggctaatcttaggacttcgaagccgatgctgactctaagccgatgactacttcgggcttaccaaatttcactgttaacagctgtccagattcattttaataaaaaaatatcacctccaatgctagattagttttctttttgaaacggtgggagtacatgtgagtaagtagcaacatcatgatactatgtattgctagatgctttccttcggccggtcagtactgttaggatgcgtttgattgcaagccacactttaacacagtttaccacatcctgacaaatttaataggtgtttggttgtagccacaattatcgcaatattatcttttccaactaattgggtcctacgtgtcaatgactaaaaaaattattgcaaaatttccttaggcttgataaattatggctaagaatttaatcacctcgccttaggcaaggtgtagcaaactagcaactatattattcacacatgtaatagtgtgtcccatgatctcccgcgtagtacgtacgcgaggctacatcgtggttaactccatgacccatattcacgtagtacgatacccatgtgtccatgacccggctgcgcctacacatgactacgtgacacggtcgggagatcatataccggcgcctcgtttttcttcctacttggacgcatatgtacttgtacacgggcaaagcacatgccacatggcgccgcaacttaattaaccgctacctcctcaaccacagcttcccgccattattactccccccccccccc

SEQ ID NO: 61071 - DNA, 592 bp, Oryza sativa
tgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacaagtgtacacctctgatcagagtaaaacta

SEQ ID NO: 61072 - DNA, 2170 bp, Oryza sativa
gatctggcgtagtgcgggaagcctcacgctcctcctctatttatacatgaaaaaccctcctactcaaagtagacgtaggactcctattcacaataggactcaaaccttaatttccaaactcatctaaaccggaattcaatccacatagaatcccagccatatagcaaatctcagcgccgtcaaccgagccggactcggtctcctacgctcgtcccagctaactcgctcctgcggcttgtcctcccaggccgagccaaccagcaagcagcaagctgcacatgtacagcaccgtacatgcaaacacacacatgcatatgcaacagcatgcatatgcaccatgctacagtaccacgagtaaccaaatattatcacacaatttccttcgcgaacaccgacgcttgcacgcacacctcgtgaagcccgttgcgaagatctctcccacacgatatccatccaccgtgtgccatctcgtatccaacttcgtcatccggtatccttaaccgtctggacctcaactcctccctgagtctagtcccgatctccaccgttgaccgaagttgacctccaagaatcctgactctagtcaccttctcatatggtatcccgaccacactagacctctgctcctccctgagcatagtcccggtcctcaccattgaccaaggccgacctcaagtcacctgcacacaatcagacaaaacaaccgttcctgggcacagatatcacaacctgacccacattagtcacacgcactcacaccaacattcacacaaactctcaaaccaattctttgaataaatcattcgcacagccaattattcatcacaaataataatcatgacagtgatttcacatatagctagtactctgcttcaagttcggggatgcatggagatcgtcacgctggtcagtaaacatgcatcaccatacatatagtcatcacaatcccatagggcaagttgtacattgatcactgccgaaaatttgacattttggccccttttgaaaactatttgcaaatttggtccctggcaaaaactatcaccagatctggaccccgaccttagcgcaaggccgacggcgctgaggttgaacaactcagcgccaaccgcatcggcgctgagtacttgacggccctaagggaaggatgaacggaacggcgcaatgccagcgccgaccgacttggcgctaagcttcgggacctcagcgccatcgggtctggcgcggaggtcctatcacctttggccgacccgcgcacagcagccggggccttctttcttcctcagtggctctcgactgaggcgcgcgggcgccgaaccatctctctcttcccctccaaaaaatcgaaaaaatctccactaaatcgtcgcattttggaggggaaattattggaggacatagtggcaaggtattctcctcagaatcctctcgtcatttcgcatttttttgcttggatttgctcattgatggatgaaccctagaatcgtgatttggggttattttcccaaattagttggttctctactctgtggttgtagttgttgttggtgatgtaatggttagatgctcatagaaccctaatttttagtggagattttcggcacttagggaagaaccctaatttttcccccaaattagtaaagaacacttcttttttgtttaattttcatcacaatgcgagagttcaaatttaggatggatcgttacaaatggaagtttgcgtatgtttagatatttatggacaatttcgttgggggacatagttgtaggttagatttttttttattgcaaattcaagtttttaaaaaatgcaatatgctaatatgtcggttaatgttgtagatggatagattagtacgattgcactatggtggttcggtggtagagcaaagtaacagtggtaacaatttcgaggggatgagtgttaagcaacttatatttggtggaaaacctagttttgaggagttagtttgtcatacaaaggatgtgctggggtggagcaatcagtctatagctatacaaggtagatatgatgttggagcaggacccatttcacacaagtacatgctagatttgaatggggagttggagtggaacacatatgtggatatagtgttgggctcccaattcaagtcgcttgaggtggttgcttcgaagcttgatcgtactg

SEQ ID NO: 61073 - DNA, 43446 bp, Oryza sativa
ccccccccccccccccccccccccccccgttttcctttggttttttttttttggtcaggatgtgagcaacatcaggcaagtccccgaccatcaggttcgtgcacctctcgcttttgatcccttttgagtttggttttgtgttcggggggggggggggggggggtggcggagtttctgcgggtggctgatgcgtatactttgattgggttggggtttgctgcgcaggaggtgttcgttgacccggcccgcgacgagagcctcatcttcgagctgctcgacctcaagggcgaggtagaggacggcggcagcgcgctctggttcctgcgcgacatcgccaacgagcaggacgcgggggacaacttggtgaggataacctgttagtgcttcagcatactacttcgtcaaacattagagttaggagtcgatgtaacgtaatcaggagttcctgactgtttgtgttaagattcgagggctcatgcctttaaactgagttaaattcatgtttgttggctaggtagttgagcattctgggacgatcgagctaggtggtctgcgatttggagatgctcctgcagtggctggaactgcggttggtcagctggtaagattatttcctctttgtgttgtgctttgccaactccagattattctgcaccttgcgataaatcaatatccagcacattagattttcaccttctttttcaacaatacaaatatatgatggcacaatattgctggagttgtataggtttaggtgatcacacttcatacttgaacagctgcacattacagagaatggaaacagattttggtagcaattggcatgcctaagaaaaataacaatgatgtatggataaatactagggattactggacgttttgttggttgaactgtaggtgggctgaaccattctcatataattgatgacccctttaaatcatagtgttggaggtatatgtttctaggttctacatccttctctttccagataagtagtaatgcagatgtctaagtggaaaataaagtttgggagaaattaatgatcaagaatcctccataacataaatagatccatgaaacattatgatttgtgcaaaattatcgaactactgtgtatcatgatttcattaactctggtagttcagttcattgatgcacattgatacttgatagcttggatatgctgtataatcaacactggatggtgaattgaccaggaaagtgcaaaatcttgtgcttaattttcttcctttttgtaggctatctcaaaaggaaggcaaggcagagaagcacagaacattgttcgagtgagtgcatccattccttcattagtatgtacaacaggaaaattgtgaaatcttggttcttcaaactgagttcttggattacctattgcagctttacttggccaatatacgcctcaagaatgcagctactgatgtagttattactgcatatgagccactgttgataaagtaagcgcagtatatcactaattacgtatactttctgttagacaggtcatttctattagtttgtacttaagcagggtgaaaagctcatttggacttcccatcacagaaactaccattcagtgtcatctgttggtcatagcttggctaatatttgattatgcattctaagaactacggattgtctgtatcagtctttcctttttaaagtctggtcgcatcttgacatgtttgtggtgagtgttgataatcttgtttggtgaaacatgcttactgtttaggaacacacctgtgcttacaaaatgaaacagccctattgtgttcagcctgatgtttgaattttcttgtcatactgattgctagtgcactggtggatagttaaacaagacgaaactagatttgtagttaaattctgataaacagcattaggtggtaatgttagattgttagaggttattgaagactttattacagcttttctgcccttctatatcaaagtttacagcataatccttcagatattgtttttgtaaattgagaatttgatgttgtttctgttgctattcattcagccccttgagtgaaagcgccagtgcagttgcagccggtccagcagtaccagcagaacaagcaggatgcttagcaatgtctgagatcttcaagctcgccgtgatgaacttcaatgtccatgactggaatcttttcaatggcagcagttgaaacagggtggatagtttatcatagtaccactactgagcatcgcatgaacttttccttggtctagtatctgaacattattttagatcggcaacattcgttttgttaatgtagtgtcatcagcagacccctgttgaacttgagtatcatgttagcttcaggaatttactcatttggcccatgatagttaatagtaagcactaaatcagtaaagaagaattatgtgtatctatcaagttagctatgagttctggacttctagttagctagagttctggacttcttcatttttgagtccacaggttcgaaaagttcgttctgaaatcaattggatttccgaaggaaaatgtcgtcctccctacattgtatggactggaatatttgtcctacacagtaccatatattcttgatccttgctcattgcaacaggcaccaaggatcaggatgacgaacatgtgaactatgagttaccaaatgaacacgccccacgttgaccaggtcatgatccatttggattggggcaatttgtttcaaccattcatcgcgcatttgacgcatcgtctcgatcgtggtaagatcctctggtcaccgttaaattttgtatctaaaggcggtctcgctcctaattcattacgtatttaatttccctgtgagttttacctttaaaagtcatttacatttcctcatgttataagttaattaagattcacgcatcacagaaaaactaacaaaaatggtcccaagcaacatgctgaaattctataccagaacctggcaaccggtgtccggtagtatatacggtattacacatgaacattacacagcattgcgatttccaattgccggaagtcgataataatccgtgccggacagtgaaaagtcagatgaggtggggaagaaaagcaaagaaagaaacaagaaactgtgttgggcgctcgaaacttcgaaattctcattacaaaggatcgagaggaagaaggaagaagtctggggaaaatttttggagcgaggtggagttacaaaggcagcagcagcagcagcttctacgttctcacttccactggttggcgacgatgtcggcgaggtcgacgaccctctgcgagtatccccactcgttgtcgtaccaggcgatgaccttcaccatgtcgtcgcccatgaccatgctgagcgacgcgtcgatggtgcacgacacgtcggagcacctgaagtcgacggacacgagcggcacgtcgcagacctcgaggatgcccttgagctcgttggcggcgctgtcgcggaacgcctggttcacctcctcggcgagggtcttcttggacacctgcaccacgaggtcgaccacggacacgttcggcgtcggcacccggagcgcgatcccgttgagcttccccttgaggttcgggagcaccagcgccacggccttggccgcgccggtggacgtcggcacgatgttcagcgccgccgcacgcgcgcgccggaggtcacggtggctcgcgtcgagcagcctctggtcgccggtgtaggagtgggtggtggtcatcgtccccttgatgatgcctgcgccattgattggttaagcatcagagagagagagagagagtaaaattggtcgaggatcgctgatgcgcgcgtgtgcgcacgtaccgaacttctggtcgaggatcttcacgaagggggcgaggcagttggtggtgcaggaggcgttgctgatgatgggctcgtcggggctgtactggtcggcattgacgccgacgacgtaggtggggatgtcacccttgccgggggcggtgatgagcaccttcttggcgccggcctggatgtgcttgcccgcgccgtcgcggtcgacgaacacaccggtgccctcgatgacgaggtcgatgccgagctcgccccacggcaggttggacgggttgcggtcggagacgaccttgatcaccttgccgtcgacggagatggcgttgtcgcccacgggcttgacgtcggcgtcgaagatgccgagcgtggagtcgtacttgaggaggtgcgacgcctgcttcacgcctccggtgtcgttgatggcgatgacgtcgaggggcgagctgtcgccgcgcccgtgccagcaccgcaggaagttgcgcccgatgcggccgaacccgttgatcgccaccttcagcttcgcctccgtcggcgcccgccgcgccccgccgctcgtgccaacctgcgcccgccgcaacacaaacttcaacaccccgcgtcacgcacacgccgcctcgacgacgcaacaaaagttttccggtgcattgcttcacgcacgtaccgcgtgggtcctgaaggagaccgcgttcatgaagtcgtcggaggtggcattccgccgcagcggcagcgacgacgagctcctcaggccggagaactccgacaagccgcctccctgcacacataaccacacacacagacaccaaacacaatctttcagagcgattcttgcaaccaggagagacgagcagtaagcaactaaccaaacttacctggagtggcacggtggcggcggagagcatgggcgacgccatgtccgacgatcagatcaagaagaatgcagcagcagcaagctaggacggcgaggccgggaagtgtgtatatatgagtgtgggattgggcgcgccaggggtttgtggtgcgcggtgcagcgaggtgtcatcgtgaggcccggattgggcgagagatgagatttcggatagcccaacgtatggctcccagcgttctcgcacagccatcgcgtcacccacacaaacacatgtgtgtcacacacatctcaaagttcagctgctccatccattatgtgtccgccgttttttctttttcccctcggtgattcttgtcgcggtgaagaactgagcgttccagcctttcaggtagtacgtgatattgtacgcggtactgcatgggaggccctctctgcgacgcaggcggtgatggctacgcagctgatggatattcggcgttcgattctgtcattcttgaggaggtcgagctcgctttcggaggtaaaaatgccaaggttggctgctcgtggaccgagcggtacagctcttgcgaatgcgagattggcagattgcgtcggtaaacgatgggcgagggggaggggaagcgaggatttgcgagatgtggccatgcgggctcgcgcctgctgcaatgcatcttgcggtggccctcgcccccggtccatcatcagttcagtctcccggatcctcttgtttttctgaggcctggagtaagcttaacatccacgtcgctctccggtctcggccaacgtagcgctgttcttacgttccgggatgttcagaaattcagatttcgttgggcgcccacgttgccgctgccgttctttttctttcttttttccccctgttacacagaaaacacacgtgcactgtgcattgtgcacatacactatagttacacatttgcgggtagatctctaacacacgtttaagaaaaagaaagatagatgataaatcctctcaacattactaaattcctattaaaaacacacccgcacatgtggtgtgggatatgcgctagccatgcactgaactcatgactagcggttaaaaaaaaagccgatggtttcgaacggcttgaactcatagccatagtatattgagtcgagctaggtttttagctcattagcttaataagatataccgttagctacttgtgtagcttgctaggccatgaggtcaatatatatttttatacattttatacataagtacattagtccattaattgcttataaattatttggattcaatgagttatttatcatttggtgtttattcattatattaatatatgataaattggtaaatcaattcaaagatgcaaatgtgatattaatgagagaactcgttaacgagtcaagttgtgagtcgagccaagctgagttatgcttttagatcgttaaggttaccaaaccgagttaagataacaaacccaaacgcactaagctagctcaatatcctcccttcccacgactccaccatcgcatactgctccaccattctcttccggacgacttcaatgttcacgacttaaccatcacacgccctgctactgtcattctcttccggacagtttttaatcttcaattctataaaaatagtgaaataggacctacttggtaaaatttctatcttataaactgaactttaaaaacagatcgatatagtttgcgtctaaattgttcactttatgttttaattagcacaaaattgcaacggtttttattcattgtggcaattcacacgctgagtggtatagtgaagttaaaattttaactgtcattcacagttaaaatttaagttttaaaacttaattttagttccaggttgatttggggtttcttattcatagtctatctttcaaccttaacttttaaatcacaaactttgctggtttcttcatttatatttttttatagcctgtcactcgtggctgaaccaatcagagctatgattgtattaggtaccacggcaatacttgtgacaattgtatgttttcttggcaccttcctcacaacaatgatacaagaggaaatgtgacggttttgtcccttacttattgctagctaaagtttggctctgattttcctagccaaaccttatactaggacttcatgttagcttaaagagattattgtgggctcctccatctaaacgggctcttatctccttcctagcaatacaaagcccatctagatgacccacacaatccaaactgagacgagccggacataggtttgtccagggaaataagttcacttaggctcccttaactagtggtcgaatctaattcatatccctgaaccacgataccggatatctcgacccccaactattaaaaccagtgcaatttgactccctcagcggttttgaagggcagtttcgttgacgtggcgcctacgtggcggcattgaacagcggcgggtcgctgctgaccaaagaggggatcatcgacaccgccatggtcaccctcttcgccggccacgacacctcctccatctccggaggggtgagggccggagagatggtgtcgccgctccggctctcgcccgctcgctgccgaaggggagaggaagagaaacagagagggagggagaaggaaggatgagagaggggggatgacatgtcggccccacatgtcagtgagcctaaattttttgttgtgtgaatgacgaacgagtccacatatatgtttttcactagttaagcggctgaatctaattcgtatatctaaccacaataccagatttctcaaccatccaactattaaaaccggtataatttgacttcctcgatagtttggatgacagtttcagctgatgtgaaggtgttgacctggtcttcgttcaatatggtattgatatggtattagaatttaaaagtcatatgtgacctatttatcattaaaaaaattattatggggcccacaatcatcctctccttcccataaagctgaggttgagcggtggcaataagagatggagcggcgacgacggcatcaaagagctgggcggcggattcaagcggtgccgcgacgaggagagcaggagcggcagcagcgcgtctcgcggctggtggcggtgactgcaattgaggatgccggagacgagagcggcgacggtgggtgggcgggcgagagccctctcccttctccatcccccggcatagcctcggactgcagcagtgcttcagtaggcgacaacgcggaggtagaggagtagctcgacggcgcggatgatgctcacgagctcggcagcgccacctctctcctctcctttctagcccttgcccgcccgcccaccttcgtcgctccagccctcgcccgctgccgctgccactctcgtctccggcctcctcggccacggccatggccaccagccaagagacgcgctgccgctccagctctccccacaaatggcaaagggggagagaaagaaaggaaagaatggaaagggagggaggaggaagaagggaaggagaggatggttgtgggccccacgtgtaagtgggtctcacaatattttttttgtgaatgacaaatgagtctcatatgtatatatttaaaattcaaatgctatataaacgccacgtcaatgccacgctggatgaagatcggatcaatatcgtcatgtagacactacgtcagcgaaatcgttccctagaagcaccaagggagtgaaattgcattggttttaatagttagaaagacaatatatttagtattatggtttagaaatacgaatcagattcccgcggcgtttctcaccactcgtgggccgtggtgcgtccgaagaatgaacctgtgcgctgtacgagtgcgagagtttgcggagccgaagaaacacccagcgccccttttgatctaccccacaggccacagcagcagcagccaccctcctcgcaaaaatgaaagaccaaagaaagcggccactcgttcgaagttctcgtaagcattggttaactaatcacaagcttggtttccttatcaaaaaaccacaagcgtatggttcacccagtaaccatgcatgtatatcgagagcttcacggtcgcatgtgcccttggaattctttatccaaacttggcagcacggaatctttctggaactgcgccaacgaccaagctagtgccaaaacgttccgcacaaaattctgtcacacgctcacaccacctccagctccaaaccacacgcacatatgcccccgcgcctcctccgcccaaccgtgccgccgtgtgtgaaccgaacaggctcgcggcggcgcctttgcgtcccggcggccgcgcagcgcacagcgctccaggccagcgcacgccgaacacggggcggattcccccgcctcctgcctgcagctgcaggctgccgttcaggtggttcggttcggagctagcagcagcagctgctgctgctgctgctgcctgacgcctgccacggcacgcgcggctgccggccggagcggggcgcggtacacgggcagagtccatctgcgccgagcccatctgcgctccacgtgacggcgtgcagaactactcctaaaaaccggcacatgcgagggcctgcccttctagctttgggctgggtcggatgatcgtgttcgcgtcggacgcgacgcacctcggtcggtcgggccctaccgtggactacttggtcacatcactgactctcactgacccagtcgctccctccccagctcgtgccagccagccaccatcattcgaccatgcgagtgcgttgcatttgcacatatactatgctccaccctgatgtgcccaggacatggcccttcctgtcacacaccggcctgatcaccgggcacgggcagcctttcgttcgtgggtcactcacaggctcgactgttcaagcaggatcggccaggcccatgcatcccggagaaattttaaaaggaaccactggtggtctctctgcctacgtacaccggtacacgaccttttgttctgctgcggagtgagtgaccctacacagtggtacttggattcgtacgtgacaatagatgagtagaagtaactcgatcggtattcaatccgatatctcttcacgtagtgtaggatactggaagatgtggggcacatgaccggcccagggagtagttatgatatcgtacgttgtgtttaacgttactcgcaaaataatgatcgagcattcgagctgcccgttatggtgctggggcaatcagcctatgtacacggaccgttttataaaattgttgccttgtagtctgaataatccgtatctcccacctccacggttcgttctcatgcatgttgccattcagcggcatacggcggcattattcgttcgctggaaaatcattcgatcgagcggcatctcctccttggaggtcatgggcgacatgcatggtcctggtcgacaagctaggtagccagattatggtttgtgagggatggccatggtggaggcaggaggcagctcgatggtaccagtaagtgcctcttgataagcctttttttaaaaaaaaaataaaatcaggaaattataaacatattaaaaaaaatgtttgtacagtgaaagagaagatatctttccttctgttgggcttaaacgtgcttcatgacttttttttttcatttttgtcatttccacttcggtttggctaaaaaaaagttaacttaatttgtatttttcacataaggtttccactatagagcactagactttatgcactacttctatgattttttttttcaaatttgaaacaaaacaatttttaccaaaccataattatagtttacccaccccacggtaacaacatttaccgcggttgatgtggcgggaaccgttgctatactgtcaaccctatcatagagccattcgaaaggaatatcatatggtccaaaaaaaaaaagtacaagcctttgttccatagggccgtctaggaaaaattctatggaagcaaggagccctctcggacctctcgagttaaaggcaaaaggtaaacactagacatacaaaacgaaaacttccatctttgaagccatgccgaaatcctcaaaggcttctagaaggcttgaagatcactcgaggcagattgtaaaggcgcctcaaaggctcaaaggtgctagaagagactttcttatcaatggaggtttgccctggaccatgggatgatggaagaaaatgatgttgaatgtctcatatgcaaattgaagcacttcaaaacattccttgttggtatccaaggaccacagctagctagttggcgtcgtgattcgtgaaaatggcttgatccatgggccaaaccaaatggagatttaccacgatatcattaggttatacccccatgcaagggcaagcttgtacttcctctagtcataaatatttgaggaattaacttttgaaatgatgtttgacaattcatctcatcttattcaaaaatttacttcaaattgcaaaatgtaagtaaaggatagagtaacattagtaaaaacacaacttacaatagaataaagagtaatttcatattattatatgttattttttaataagatggatagtcaaaagttatatccaaaatcaattgcgagaaatatttatgaccaggtagagtaacttccctacatgcatcatttaggcttcgttcggattagcggttcgattgagatatttagcagcatgcgaaatgagacaagttattagcttataattaattgattattaattatacaaacttaaaaaatggattttataaaaaaaaacttctatgtatagtttgataaacgtgcttatagtctcacgtggaataaggaagttgccatttcgaatagctatttagagcgcattattaatcttaatatatcatattttatccattgtattagccctatacatataagcggacccgagaaatatttaataaacaaagataattttctcacactataagaggagttttagtcttcgaatactccttgtatcactactacgaaaaccatttttcgtggcggccattttagggtttttgctggcgaaatttagagccgccacaaagcaaaggccagtcaagatcttcgaccgctagcgaaaatgaatttttgctagcggtcgtcttaagccagccgccagcaaagatccatttttgctggctgttgtcttccaccaaccgccagcaaaaattcattttcgctgacggctgtgttaaatcgaccgccagcaaaaatcaaaaccatgcagctgccctagccgccagcgaagaggcggaaatttaaaaagcaaaaatatattttaaaaaaaacactgctccgtccacctccgtctgcgctccatccacacataaatttacatgtacaatttacagctaaaaatttccattctcccaagcattcaagcatcaaaaatatccacacatttaacaaaaaatttgaacaccaagcatcaatccaaatacaatgcttcacaaatatcatcacaaatattacaagcatcacaaatacagagaaccgctgtcgccggcgtcgtcgtccttgaagtcccctgcaccatcaccgttgccactaccgagccccgtcggcctcaaccgcctccgcctcgacgacgctgctgccgagccccggcgacctccaccgcctcgacgaccctgctgccgagccccggcgacctccaccgcctccgcctcgccaccaccgctgcaaagccacgcaacgctagatttgagagagggagagggggtggtggcggcgggggaagaggaggagtgaggagtgggggagagagacctgtggatccgccgccttgcgccttcccgtcgccggatccgccacctcgcacctccccatcgccggatccgccacctcgcgcctccccgtcgccggatccgccgcctcgcgcctccctgtcgccgagcgccgccgcccgggccgcctacgcctgacctcacgccgtcctctcctccgtcacccgtgcccgagcgccgccgcccacgcctgacctcaccacccgcgccccgagctcgccgccgcactctcctccgtcgcccgcacccgagcgctatcgcccacacccgagcacgccgcccgcgccccgagcccgccaccaccctctcctccgatcgcccgcggtgctgccgcctgtggatctgagggaggaggtgttggatctggagggactaggaaggaagagagggctggatatggagggaggagggaggagggaggaggagagaggataaggacgggtaggtggatgcgcggtgatttcttaatggcttgattttttatcctaagctctgcattatccgccagcgaaaattgtaacaacttcgccagcaaaaataggctattttgctggcggttttcttaacctaacaccagcgaaaataccaatttttgctggcgtcaagttaagagggccgccagcgaaaataacatatcttcgatggcggtcggcttaaggcgaccgctagcgaagatgtgtttccgctggcggcccgtgacccccgacccccgccattttctgcgctggcggttttttcacttagcctccatgaaaaatattttccaaatgccataaaaaatcgtttttctagtagggtattcctcatagaggagccttcgcttctctcgtatatagcccattctatccattgtatcatataggatacaaatccctataaaacactatatgttcctgttgtccaaaggaggattaacgcgagttcgagcactacaatgctatattttcctgttgtccaaaggaggattaatgtaagttcgagcactacaatatggaggcttaacgcaagttcgagcactacaaagataattttctcatgccataagaggagttttagtcttcgaatactccttgtattcctggagagaggagccttcgcttctctcgtatatatcccattttatccattgtatcatataggatacaaatccctacaaaacactatatattcttgttgtccaaaggaggattaacgcaagttcgagcactacaatgctatatgttcctgttgtccaaaggaggcctaacgcaagttcgagcactacaatatgacatgtgtttagaccatattgatgtaacatgaataagttaagctatggatattctaataactacaaattatttttaaaaaaaacacatggggatgtctctaatttattgtgttattgcacacctgacactgttagtggatccatccactggtggagaaaccatctttggtcagtctggcaaaatccacaatagtcccagatgcaaaaaaaaaaacggaactaaagattgtttttagtcccggttataaaaattttgatctttagtgatctttagtcccggttcatcccttgttagatgtatgtcagggggccgaggatctttagtcccggttgttagtaccacccgggactaaaattaaacacatagtatataatccctaacacttatcctctcctccacagttacaacttagacatatcgaatctcaccccctcttcttagatctatcctctctaactctcttctccaactcttccccttcctcctctcctcccccttctctccccttcctcctccccttcctggccagcctccccttcctatccggcgggccggccggcggtggggccacgcgcggcggcagccagcggcgggcggcggggcggcgcccggcggggtcgcgcgtggcagagggcggcggggcgacggccggcgaggccgcgcccggcggcgggcggcggcagtcggcggggccgcgccggcagccggcggccggcggggccgtgcccgtcgttcgtggcgaccggcagcgatagcgcattctttttttttaatttgtgatgattcaaattcactgagatgtatttgattgagatgttacaaatttgtgattcattgtttagatctgtgatgtatttgagtaatttcttaggatattgtgatgtatctgatttgtgtgtataagtaactttatttgtgatgtggattcagtgatgtgaatttgggatgttagttagatttggggattaattttgggatttgcctacttgattcgggagaaaataaaaaggaaaaaagaaaaagaaaaagggaccatctgtactgacgctattgtctctttagtcccggttggtaacatcaaccgagactaaagatccactctctttagttccggttggtggtaccaaccgggaataaagatatatctttagtcctagttatttcaaccgggattaaagatgtccatctttagtcccggatccttactttcggttggaaaaccgagattaaagggggttcccaaccgggagtaaagatggtttctccaccagtgatcctgaatcttgatcatagccaaaactatctaaggatgcatatgtttcatgatccgtacaaagacaaggccagtcactaagcaataaggacctgagatcaagtaaaaaagcaaacaaaaataatagtgccattagttccaaatggataaaacaaacatgatagaccatacgtacaagaaaacgtaaaatggtgcaccgtagagtactgaagccataggcgtcaagccgcaggaatctggtcgcgccatcaagaccggagcgtatgtgaatatgtgaccccactcttgacacatggcctgtcagcctctagccaaagccccgcgattagagcatctctaacggtatagctatctcactctttaaactaaaatttgataattttgaaaaaaaaacgagctccaacagactagctatcccactatcccactttccaagctatatggctggccaaataacctccctggccagccaaaacaggctctccaacggtgggattgtaggacccacgttctctctatctgtatcagcgatggtggacaacggcgacgacaacgacgcggctgccatccatgcgcgcatcctctcctatgcgaggcggcgttgcagccgccgacctccgctcgccgcgccccgcctactccgctcgcagcgacagccggcgccactccctcctacctccgcccccatcccaatgcccgacgagccgccttcaggctgctgccgcgccgacgccgccctctgcgccgcctccgccgcgcgccgccccaccgcgcagctcctcgccgccggcctccgctcgccgcgaccgccggccagccgccgtcctccgctcgccgcgacagccggcgccacaccctcctacctctgctcccatccccgacgccgacgagccgtcttcaggccgcggccgcggccgcgccggccggcgcccggctgggcacggttgtgctgacgccgccctctacgccgcctccaccgcacgctgcccaaccgcagctccccgccgccgtcgccccaaggccaccgccccgccgccatcacgccagaccaccgccccaccaccgcgcgccatgcctagctgcgccgccgcactcagccatcgacccgccgcgcgccacgccgcccggccccagcctccttccaccggcgccccggcctcctcctccccggtgcgccgccctgcaccaacccaccaccaccattcagacgcacaggagcagaggagaggaggaagaacaagaaaggaataaaattagttttggtggggaagaggggaagaaagaggattaagaagaagggagaggctgacatatgggtctcggtgtcatagagtcaaaatagagagggtagatgaagatactgttggagtgaacaattagtttgactagctaaatcggatgaagagttggctatataagtgtttgaagagtttgatctgaaaagactgttggagatgctcttaggctacacaaccggagagcgcgggacaaaagctacaagaacacaggctcgatcggcaatttgccgaaccggccggcaactcggcaaccatacggccagagtggaatccagtcacggagaactgttcgatctaacgtgaaacgagctgggccagcccttgaccgcagcctccctggcccgtgaccgcgcacgcgcgcgtgctcaccacaccacccgtcacccgccccgcactcgcccgtacgtgaaatttttcgcttgccaaagcgctatcgcgccaccggactcgccacgctacgcagcacgtacgcgcggtagcagagcagcagcatccgccgcccgcgtcgccgcgttgctcgtgtcgcgcttggggggcagcatgtgccgcggcctagagattcacgcttggcgtttgcggtttccgctcgtttcttgggcccgtgccgttctcgtcgtgcagctacggccacattgtttaaccggcgcggctgcttcagggagacagagaaaaaattgccccggcaaattgtggcctgtgagtgcgtgcgcctgcttccacgttctcgccatcctgttccccggaaatgacccaatcatttgcggcgcgcatcgggcatactgtactaatgccaatcttcaagacaagacttgcttggatgcagtacaaatacaaggcggccaaattggccttctattagtaattattgtagtataccgacagttccgttttggtataaacctagcacgtccaaggtgtaaaacgttagagccagctagtaaaactggccactggaagagacagagccagccaagcagaaggaagagcaaggaaaagatactactgtactacatgggggacactcgaattactaccaagatacgagccacagtttggcgtcatgtactcatttgtctgctagcttcgcttggccggagtggtccactgatttgcagcgtgtgcatgcaaggctgcggcgctgcgccatgaaaagtgctttcctctccccgcaagctggtccctaacctggacggattatctaccccgccatcgaaatagagaaggctaatcccgattgagttatatctatccccttcgtaagcaaacaaatcgaagataccctccactttgcaaagcatccccgtttccctgcgaggtgtctcctttgcacccattcacacacacgtatatatggactaatcatagtactatccctcccttatttattccaagggggacattgcagtagttggcaccttggcatcctcccggagcaaacatagaaccgtgcagttgtttttacctttgctagatgctatcactaccactctactaccgctcgatcagttaatagttcattcggttattactataccatctctacaggctacagcgttgttccaaactctttaataaggcggcagcagcagaagcaaacagtatggcgaggcgatcgccgttaactttggtccgcactacgctgcatatcactactgaaacgaaggcaacatatggatgcacgcatatgatccgcaacccggcgtcgctcctgcgaacttgcaggcttgcagcggcgcagatagcctgaccagctaagccagagacgcatctgccgccggccgtcgccgcgccgcccgcgcgccggcgagaggcgatcgactcacgctgacgatcactgcccttttggcgggtaccgcactatggaactgagcgggtgggccccacctgccgcaggccccaagggcatagtaggagtctcgtgatgccaaaatttcccgggcgcatcgcggccgtcggtgcgttctcctctgaccgatccggcggtcgcccttaattgcctccccggtgccagcgtttcgtgctcctaggattctttgaccgccacgatgaaacttttttttaataaaaaagagatttgaaaaagaaaagaaaaacaaagtgtgatccccacccaccgccacatcttgagaaattccggttttaatcttgttttgctccgctaatcccgtttccacatgctaattcctctcctccgtgcaaatgtctaatgacgtagagtagctgcttaggctgtatactttggatctgacgacatgtgggacgatcaagcagcagtttgaattactgccaagtttttcatcaagttggttttttcagtttctttgatctcgctcacatgctctacgcagaaagaccatgttttacctcggttattctatccaactccctgcatctgaatctggctgtgagcagtacatgtcgacgggttgactagaattttctatccacctcgagtttactgggagcataaaaatatggagatgcagtcgacttattgcttcgataaaaatatcgagtagtttatgcataatgccttgttatcttcaaacaagcttatcaatcatgttataatttgaaatgtgagtctgtgagttggaatataaagaccgaatatatgacgttatacagttatacaccaatttttgtcgccatgttccattttttttccaagctcaaatgatgtccaatagctcattgataaggttcggaattttcttcttgattgttatatagtacaagggcatcagtaggagtatttagtattttggcgggagagctagcatatcaatttagaacagcattaaccgaaactgtttctgtctcaggccgatgcacatgaataaaaatcctttgccgcactctcgaagctgttgcccacgcctgcgggtcccaccttctctgcgctcccaaggcgtggtccccagttcctgccaaggggtagcgggtaacttttcggtgggtgcggtctcagactggggctcttgtgttttttacctccagtaaataacatttctatttttttttgagaaaattgcatcctgggccacttttattgaccattgttacatgttggactagaggtagaacattcttttcagtttgaaccagaaatctttgcaaaaattttcatattgaactagtcttgttcttcctctagatctccccctcttctcttctcttccctcttttggttcaagctcaccacactttctcaggttccatctacgtgcttgacctacgtcagcgcctgagcttgagtgtgtggtagtctccgtcttaagctcaacacggcacacggcagagctccagcttaagctcaagcacatagccaatgaatcacggtggcacggtgggaaattctaacaccatatattatcactccacacttatactccaccaactagtcaataggtcacattctagcccaagtttatccatggcagcactagcttaattggagctagggcacttaatcaaggttgcatattaaatcttgagcacgaatgaatgtggcaggggcagcgaaggctgactggctgagtagagctcgagcatgactgtactggtgaagcttgagctctatctctactaaaaccaactagccaggtatgtgaatctcaaactgaaggtagagagagtgagaaagcagagctggaagaagaacactaggtcctaagtgtaacatattgtaaaaattactagcctaaagtgaaaataatagcttgttcctagtccaagctgcgaacatagtaaagaaagccagtccaatatgcaattaactattttttttttcaacccaagtccagtagtagtatactgcaatcgaaaggggagaaaagtaaaatcgatcgcaaaacccgtgtcacggtgtcatgtacattcacggaatacgctggcgtgtagtcgtacacgtaccattaccatacatggctgctagaccctacacacgtactgtacgtccagcggttgtactgtacgttgcgctcgtctcactcgcgcgtaacgtatacgatcaggagttctgacatgcgagccccaccgtccagtggcagccacaaatacaaaaaccttcgcagccctcccgtgcggcgtacggtcaccgaaaatcaccgcactgaaaactgcatcggacccctgcttagccgtgcggcccgtgcggcgtcaatggcgtggcgcacggcgtagcctaggctcacatccggtgacctgatcctctccgtctccaactcctatgcttccctctccccgagaaatgcagtttggttaagcacacccaaccaaaataatccgcagttgcgctgcttgcgttgcgcacactggaatagccgctctctcagtataagacgaggagggagcagccggagcgcgagagggagagaagcggcggcttgggagaggctgcgtttgggtgagctgagagatccaatgccaaggccgtgaggtgatcctgtggctcgggagagggggagaggaagagagagcgagagagagaggtgagcgtgcgtggcggcgatggcggatgagtcagggagctgcggcggcggcggcggtggcggagggggatgcgaggcggtgaagaagagggtggaccagagcgtggcgttccatgagctgttcgggttcgcggacccgctcgactggctgctcatggcggccgggagcgccggggcggtggtgcacggcgccgccatgccggtgttcttcctcctcttcggcgagctcatcaatggcttcggcaagaaccagcacagcctccgccggatgaccgacgaggtgtccaaggcacgtatcctgcgtcccatgtcccgctgcttgatagctctcgtctttcctcctgtgccattccgtgctctcgccattgacgcttaatcccgtggccttttgtttgctcgttccagtactcgctctacttcgtctacctgggcctcgtggtgtgcgcctcgtcttaccttggtgggtttcccctgctgctcgcgcgttcttgccggtgatgtcgttaatgtggccggcctcactcaccgcgtgtgtccttgtgtgcagagatcgcttgctggatgtacaccggggagcgccaggtgggcgcgctgcggcggcgatacctggaggccgtgctgcggcaggacgtggggttcttcgacaccgacgcgcgcaccggcgacgtcgtcttcagcgtctccacggacaccctccttgtccaggacgccatcggcgagaaggtgaccagcttcttaaactcgtcgctctcttgggctccggccacctcccgggcgtggccaatgacctgattgggacggttcgtcggtgcaggtcggcaacttcatccactacctatcgacgttcctggcgggtctcgtcgtcgggttcgtctccgcctggcggctcgcgctgctcagcatcgccgtcatcccgggcatcgccttcgccggcgggctgtacgcctacacgctcaccggcctcacgtccaagagccgggactcctacgccaacgccggaatcatagccgagcaggtagcatcactctcatcctactgtttctggatacccattttcattcagggaaaccaagatgcctcacaaggcgtggggaagaggagcagtgggctctagcggtctagccccgtagcccgtgccggtcaaagtgtagcacatgctatcaaaatgatgccattttgtattccttttagcttcttattagatccaatcaaccttttggataagatgatttcttgtttgatgtcgttttgcccttttcttgatgagtgattaacatggtacctcctcaagaacaggaaaaatagaggtttcttgatagataggtctcgttacccatgtacttttttcaatgtcaaccataaatgtaggataaaatgatatctttctcctttattgtgcaaatatgcgagtaattttgatgatcaagtgtgactgttgaacaggcgattgcccaagtcaggacagtgtattcctatgtgggggagtccaaggccctcaactcgtactcggaggcgattcagaacacattgaagctggggtacaaagcagggatggccaagggtcttggcattggctgcacttacggtatcgcctgcatgtcctgggcgctggtgttctggtacgcaggagtgttcatccggaatggccagaccgatggtggaaaggcattcaccgcgattttctctgcaattgtcggcggcctgtgagtactgaactttcattttctgtacaattctgtacctttaatgtttccgataaaaatatatgattgatatgtgtatgtggatctgatgatttcaggagtttgggacaatcgttctcgaatctaggcgctttcagtaaaggaaagattgccggatacaagctgttggaggtgataaggcagaggccgacaattgttcaggacccagcagatggaaggtgcctggatgaagtccatggcaacatagagtttaaggaagtggcctttagttatccgtcccgtccggatgtcatgatattccgtgacttttccctcttctttcctgccggtaaaactgcagctgttgttggaggtagtgggtctggaaagagtacagttgtggctctgattgaaagattttacgatcctaatcagggtaagcagatgaaatccacacggcacacctgatgttgattgttatcccaaccatttggttaattgctgattgctattttttgcaggtcaagttttgctggacaatgtggacatcaagacactacaattgaagtggctgagagatcagattggtttggtgaatcaagaacctgcactctttgctaccaccattcttgaaaatattctttacggcaagcctgatgccacaatggctgaggttgaggctgcggctacatctgccaatgcccatagcttcattgctcttcttcctaatggctataacactcaggtgggttctttgtctgttggtatgccaatgatatttgtactacttaaagaccgatattttggttagcagtacaattttcttctggtttggctaactattgcattactatattgatcttgcaactttgcatatacaaatttgctccatccaatgattaatccactatatttataacacaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaagggttattttttcaaactccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctggtatgaatcgataggttgctcttaaactgttcaaatttcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaacctggattagacaacgtgctaggaatctttggtggaataggagaattaccctttcacattaaaccgaatagtactttgcacgacgaactcactgagctcactgcaccgttgcgacgccgttttcggcgcagacaaccgtttgctgctcaattactccctccggagataggatgccagattaaatccatcagcattgctatggtaggatccgtggcccatgccactgccactgcttctgccgccgcagctgccataaattactgtgcgcggcatgtgcaaccctgccaagatgctccttggcctcctctctgcaaaggcaaagcggccgtgctaatcatagaactcggcgttaacaacggcaagtaaagctccaggacgtgcgctatttatcgcaacagatgcttgcttcctccgttcctctgatgcctaatggctttcgtgtttctgagactgggaggaagcaaagcaatagcatggccaactgccccaatctgtcgtctttctttcctgctgctcattagctgcccccagtggtagggttgtttttggtttcttgccgctcgtccccctggtggtcccgttgttcgcgacactgtctgcattgcacggccgccttgtgcacgggaatctggggcttcgcaatccgcagtgccgcacatggcgatcttgcagttgcagggcaggcaggcagtgtcgtgttgccgtggtcgcatggcgtggcgtacgttccgcgaggacagtgtcgccccagaatgccatgccaagccatatattttttgatcgtgttccagctgcattgcagagcccctcatgattccttgcgtgcaatgatgtccctctggcgattcgtaaaggattgcgtggtgcatgaacgaaccccattctctctgtcacttggccatgggctgcaagcctgcaaggtcttccgaaaactgtaactgccatcactggcgactttaactcgttgcaataggtcacgtgtatttacgctttgcactgtgaaatgatgggtacgtgaggtaggagtctgtctctctgtgcatgacgaacgagactggccgatactgtgatgactgatgactgcttgtgtggttgcagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgacccggatgaaccggaaaccgagcccgtcgagtccgtccgtggcgacatcgacttccggcacgtcgacttcgcctacccgtcgcgccctgacgtcatggtcttcaaggatttcagcctcaggatccgagctgggcagagtcaggcgctcgttggagcgagcgggtcagggaagagcaccgtcatcgctctcatcgagcgtttctacgaccctctcgccgggaaggtcatgatcgacggcaaggacatccggcggctgaacgtgaggtcgctgcgtctcaagatcggcctggtgcagcaggagcccgtgctgttcgccaccagcatctttgagaacatcgcctacggcaaggacggcgcgacggaggaggaggtgatcgaggccgccaaggtggccaacatgcacggcttcgtcagcgcgctcccggagggctacaagacccccgtcggcgagcgcggggtgcagctctcgggcgggcagaagcagcggatcgccatcgcgcgcgccgtgctcaaggaccccgccgtgctcctcctcgacgaggcgacgagcgcgctggacgcggagtccgagtgcgtgctgcaggaggcgctcgagcggatcatgaagggccggaccgcggtgctggtggcgcaccggctgtcgaccatccgcggcgtcgactcgatcgccgtggtgcaggacgggcgcgtcgtcgagcagggcagccacggcgagctcgtgtcgcggcccgacggcgcctactcgcggctgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttcccatgtttgatttcctcgccactacaaactgacgagaattggcaacaacgctttgcgtcgatccgtccacggatcagagacgaactacactagatgaagctaaaacatgaaatcaagaaggataagcttcacctccaaatacggggcagttgaggaggagcggcaccgaggcctcgcgccctcgccgatgattgggaccctgtcagatctgcggccaccggtcgccggctcgccgccgccatctctctctgatctccaattgagcaaggcaagttcaaggcttcgagaggctgtgggcccgcggccgaggatgaggacgtgaggtgatacctgggccttcatagatagtacagcccatatgatgtggcctgcacctgtaattccatgactagacaatcctgggcaaaatcttttaaaaagggaataagtccacattgactcccttaaaagtgacccgaatctaatacatgaccctcaaccgcaaaactgaataggacgactcaccgaactattgaaaccaatgcaatttaactccctatgaagggtcgttttgaccaatatatacacacttgacacccgcccagagaccactccttcacaagaacattggattttcacaagggtgttgtaccaagatcttgggacgtcaatttatattcctatttagttgatttccatcgttgcattgccctggtataaatgatgcatattatatcctagttgattgtagtgtatcatatataaatacacaacgcacccagcataacataattattggtgattagtactccctccattccaaaatataaggcacaaccaccttagacccaaagaccaagaaataattattatcacctctttgtttgaataatcccaactaatactatacatgcacccaatagaattaagcatcttgatttaaaaattaataatctaggtgagagaatttgctattaattgtcatgcatacatgcacgctttatattatgaaacacctttaaaaagtagttgcgccctatattttgaaacggagggagtaaatgcattgtatatttataagtaataattttacatattatttattaatggcatttaacttccttaaattggccttattgttttgatgtttcctttatactattttccattgtcttcccaccttcctgtttaccaataaataattcttgtatgttgatttactaaaaaagctataggaagttgtgaattttaaattatgaatcatatatgctatatgctcaaaatgattatctaaagagaccgcacttatttactatgaatattcacatttgacaactcacatactttttaaagaaatccatccaaatgattaagtagcttaacaaaatagaggattagaaggggaacgattttcactattacgtgagaagagaacggaagaggagagaagagtttggatctgagagaattgaggaaaaatgaacctatcttgctttgcccatctgaaaattcaggacttgaggacaactacggtgggcaccagcactggtgcggcgacacgatggaggaaggcgcgagctgctggtggagttggcggtggattagagcagcagtggtggtagatgacaacgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacggccattctcgagtcgaccaccctataaattgagcgtccctgcggttccactccaaccttgcgggccaagatggcgcagaagtttctcctcgggggcgtgggcgcgatcctcgtcgtcgcggtcgtcgtcggcgtggtcgccaccgtcacccgctccggcaacaaggccggggacaacttcaccgtcccgggggaggccaacctcgccacctccggcaagtccgtcgagtccctgtgcgcgcccacgctgtacaaggagtcgtgcgagaagacgctcaccacggccaccagtggcaccgagaaccccaaggaggtgttctctaccgtcgccaagtcggcgctcgagtcgatcaagtcggcggtggagaagtcgaaggcgatcggcgaagccaagacgagcgacagcatgacggagagcgcgcgcgaggactgcaaggccctcctggaggactccgtggacgacctcaggggcatggtcgagatggccggcggcgacgtcaaggtgctgttcagccgctccgacgacctcgagcactggctcaccggcgtcatgacattcatggacacctgcgccgacgggttcgccgacgagaagctcaaggccgacatgcacagtgtgctgcgcaacgccagcgagctcagcagcaacgcgctcgccatcaccaacaccctcggcgccatcttcaagaagctcgacctcgacatgttcaagggtgagaatcccattcaccggagcctcatcgcggagcaggaaacggtgggcggcttcccgtcgtggatgaaggcgcccgacaggaagctgctcgcctccggcgaccgcaaccggccgcagcccaacgcggtggtggcccaggacggcagcggccagttcaagaccatccaggaggccgtgaacagcatgcccaagggccaccagggccggtacgtcatctacgtgaaggccggcctgtacgacgagatcgtcatggtccccaaggacaaggtgaacatcttcatgtacggcgacgggcccaagcgcagccgcgtcaccggccgcaagagcttcgccgacggcatcaccaccatgaagaccgccaccttctccgtcgaggcggccgggttcatctgcaagaacatggggttccacaacaccgccggcgcggagcggcaccaggcggtggcgctgcgcatcaacggcgacctcggggccttctacaactgccggttcgacgcgttccaggacaccctgtacgtgcacgcccggcgccagttcttccgcaactgcgtcatctccggcaccatcgacttcatcttcggcaactccgccgccgtcttccagaactgcctcatcatcacccgccgccccatggacaaccagcagaactcggtgacggcgcacggccgcaccgaccccaacatgaagtccggcctcgtcatccagaactgccgcctcgtgcccgaccagaagctcttcccggacaggttcaagatcccctcctacctcggccgcccatggaaggagtactcccgcctcgtcatcatggagagcaccatcgccgacttcatcaagccggagggctacatgccatggaacggcgaattcgcgctcaacacgctctactacgccgagttcaacaaccgcggccccggcgccggcaccagcaagcgcgtcaactggaaggggttccgcgtcatcggccagaaggaggccgagcagttcaccgccgggccgttcgtcgacggcgggacctggctcaagttcaccggcacgccgcacttcctcggcttcaaggtctaaagaccctagccccctacatggcgtgaagggtgggatcgatgcatggacgtgtgcatgggagatttgcacgagaggatccgaggtgacattcatgcatgcgtacgttcgtgtgtgtaccaaatatgtgtgatggctgagacgtgcaggacacctgatcagggtgggcgtgctgcatgcgctggggggcagggctaacatttgtgcttttaactctttccggtttcttttttctcgaacagattttcttggagaatttcttctgtataagtatatgttgcaaaacgattgttgtacaatggcttggttggaaaagcgctgttcaaatgtcccgtttgttgctggcaatcttcacccatccgttcatcagaaacagtcaaaactcaaaacaagcttccaaagcaggctagctagcagttagcatttacacctcacccaagtggctaagtatcatgtgctctggcattcaactatcctctaatgcgtgacgacgccctggatgcaagaaaattacaaacggctatgaacaccagtagaaatttcggccaactcacacgacaagtgtcacacttcccaggatgcatcatctccttgcaccgtcttgcatcctcctacaaaaggaggggcctccacctcagtgtccctcaccgtgtgctcagtgttcatcttctccaaaacttcaatcaggttgtccctctgatctcctgaagaagaatggattcaatccagaggcaggactcctttgatgacttgattaacctcgccgacgatgtggttgtggaggcgcctactctctccagcgaggagatggaccgtgcaagggtatatctatgctctgttttagtatgtactacctgtaatttgtagtttttgtgccgtgcttctaggttcagatttagcatctacatatggtttgtgtttgttccaccatgtcgatttcgcgccttttttcaaacaagttttcgcgccttttctttgtttgaaccctttttttttaaaaaaaaaatgaggcacaatcattttgcgtttttgtgctcgttcagtttctagtgcgatagcacatagcgtatattttttttctactcaagttagattagttgaagtaatgttctttcactttggaacggatgatttttccatactgacgctggaattgaactgttcatatgagaatcctataatattattgtgtgattcctatgctcgaaagggaaactaatatgtataatagtagtgttcttaaccattatatagttccaatcaataggtacttcaattttacacaacatatatggcaacatagcaaatctgaataaaggatacagtaagcagatgccacaaacaactcaaagttacatgggccccaaattttatcacaatctaaatatggtgtgggatttccaagttggtactttgtgatcaataatagagggattttgccatccttgaagagataccaaaagatactccacttaagattgaaaataagctggaccaaattaactgaaaagaagtgaatcatatacgaggatactttccacattgagctttaggccttgttctcctagtagttttttctttaccgcgttttcagcagcagtattgattgcttggtatcttctgaagtgcacttaccacagtttgacccccccatccactgcagagggaggctctggagatactgagaaacaactcccctgaagaggctttcaggattttcacccaggtaataagctgtaatcactcctacacatccgttacttgcagattccagggagcactgtcggcacagaaattctctcgtaacatatcatagcagcacagcttctgactgctacctatctgatgttgcactgtaccagggtttaatagggcaggtggttcagagccctgtggtgggcaatgctactactcctcctactaccaatcaggccgtgaccgtgagcgtccctcccaaggccggcgacggcgagcccaagaccgcaccccgtcctccgaacaactgaccgagatcgactcgcggccggtcgggtcgagaagcctacctgctcctgcggtgcgtgcgccgtccagctcctctacccgctctgtgcctgagaataatcgtgtctagtgtgctgaacaccagccgtttcctttagagaagttaaaccatgtttgcttgttttggccgcccgtattccggtctcgtgttcgtcgtgcctctcatctgcctcctgcgtatgtgcggtcacggagataggtgtacgttgcgacattgcttcgtgcgttgtgcggagagttcacgcgcggtgcggcgcggcggacggaccacgtacgcgtgcaacgcctgcgcctaggcgtccggacgtgagcggcgcagcggcggtagcggaggaaggcctcggcgcccgcttggctcgtcgcgtgacgcgcgtttttcttttctttcttcggcttcggttttccgttcgccggttgccgatcaaccgcgcgctgccaaattcgtgacgaggctgggtctgttgccgccttgtccctgtctgagtgacggcctcttcatcgacaattttggccgatcgaccgaagtctgggaggttgagaaggtaagagcagtcatcacaattgttctcacgtttttaagtccacataaacttttgtacggaatttctccacttcatttaccgatctcctagaattttctcggaattctagcgtcgttttgatcgtgaaacggatgggatcaaggaatagtgcggcatacccccggaacggtactgccgctagcgtgccgcatcccctcatccgtcgtgatttgggaagaattcggggttacatgggccggttaatggcccaataacgtacagacattgggagaggagccgcgcgagaaggctattgcgcggtcagtcgcgcgcccccctttccccacgcgcggactggacacgtgtcgcgcgcggagagagggcggcggacgcgccaggcggcagagcgagttttccgttttttttcgtgtttttcgtttctgttcggtttgctttttttttttttagtttttacggtactgttcagtttggttttccttttttttcgttttctcttctgttttctttcggttttttttaaagatgtatgaatacaaagtttgtatttgtatgtatatcaagctagtttatattcgtatgtatgtaaagtttgtatacgcgtatacaaagattatatacgcgtatgcaaactttgtatacgtgttgtaatttcttttttatatattttttaatacatatatatatataaagtttgtatacatcgtatacaaagtttatatatatcctacataaactttgtatatattgtatataaactttgtatatgtgtaatattttttatgcattaaaaatatattccaaaatatatacatacacgtatatacatatgtatatacatgtgtatatgtaatatatacataagtatagtattagtaggtacatataagagactagaggggggacgactgaaccgcgcgccccgcgcggtcaaagttatagttgggcttgggccggtggtatcaacgagtcgatcccctcacctcgatcgtgtcgcccgccgcttgatcgatcgcgcggtgcaagagcgttttttatgctcctctgtgacgacgacgggcgcagcgcggtagcgtcatgcacgcctacgcagctagtacgcttttgtcctggccctccctgcgcgcgtgcgtggtcatggagttagatagatgtagtatatcacagtatatgtcacttttttttttccatgtcactatggcgcagcccgcaatgtggaggtgtccatactccatcgtccttgcttggccgtttgccggtgccaccaccgcgcgcagccaaactttctgatgtgaggtattggttgccgcgttgtcctctgtctctacacggacacaatgtacaagcagagtcgagtcgactgtgcgattacacagacaaacggactgcgtgttcgatctagccatcgtactaacaaaaagttataacttgtgtttttttgttccaaaaaaaaagttacattttcgtcatgatttctatcataattttttttcgtagtgcttagaatagtttcccgatgtgggatactgcagcacaccctgaaacggtaatgccgttgatgtgctgaggcttttgttcgcaaaagatttctcgtttttatttttcacatataccaggcctaaaatttaggttaattggatccataccattataaatgtgataaatcagaaaaatgtcactacctttcatgaaatcgggtagatgccattgtaattttttaaaattacaaccatgccacaacttcacgatttccgtcctccctgtcacatttttcgtcgtctccatcttcatcttcttgtcgtcttcgtctcgacagacaaaccagcgccggaggaggagggcacggcggcggatggggaaggggtggggcaggacaggaggagagctcctcggcgaggatggcggagagcgagacgtgcattccaccgctcatcggtgcgggggtgttcttgtcgtcttcgtctcaacggacaaactggcggcgagcgacgagaggacagggagaaggcgaggcggcgctggcgagcggtgaaaggatggggagaaggtgaggcggccatggcatcttcttccgccatcgtcgatgagctcttccaccagatctgcgcccctccacgaccatgctcgccggcgacggccacacctgctcccgtgcccctccacaacctccctgcgaccatcctcgccgacagccgcctcgtcctctcgccgctcgccaacgcctcctcgtcctcgccgctcgccctctccccgtcctctcgtctcctcgcgcttgtcggcgccgcctcgccttctccccgtgccaacatgagagaggaggacgaaaatagtgatgggagtggcatggttctaattttaaaagttttcattgacacccagctaataacgcgaatagtagttttatttttctgatttgtcacatttgcaatggcatgtatccaattaatcctaaaaattatgcacgtaattcattcactctctacgaataccacgaatggatttctgataatgtgacgtgtacatatctgctcatgaacatgatagcttgccgcaaacataattgttcatggagcgcatgcttgagaacgaccccattcttcaattatttcaacaacacgccaataattattcgcacaatcttgaaaaatggtatactacaaccacacgatcatcctgactgatcagctagagagctagaaggagaacttgaaggccatgtcgtgcctgtacacctggccgggcctgaccgtcatggaggggaactccgggtggttcacggcgtccacgtacccctgcgtctccaggcagaacccgccgtactgctggtacaccttgccgcccttgcccttgatgttgttcagccagttgccggtgtacagctgcatggccggctggttcgcccacagctccagcgcgcggcccgacgcgccgtcccgcgccgcggccaccttccgcatgccctcgccgtcgatcacgtagttgatgtcgtacccggcgatgcgcccgcccatcacctgccggatgcgcgcgccgatcggggtggggtgccggaagtcgtagggcgtgccggcgacgggcgcgacgacgcccgacgacgggaggagctcctcgtccagcggggtgtaccgcgacgccgacagctgcagcgtgtgccccagcacgtcgccgcggccctgcccgccgaggttccagtacgtgtgctgcaggaagttcaccggcgtcgccttgttcagcgccgtcgcgttcatgcgcagcgccagcacgtacgggctcgacagctggtacgtcacgtacgcgtccaggtccccggggaaacctgatcgatagccattcacaaattaatttacgactccaaatttcataaaagagaaactcgatctttcatctggaatttcgttgcacaccttgctctccgtcgaagctgcggtagtacaaggtgatgtacggcgagtcgccgccgccgacgtactccttcaccgtccatatgactttgctgaaccctctgtgtccacctgaatgtgagttcagtgaatttaataatctgttggccaggctgatctgaggtctgaaggcatgcgtccatgcaccaatgcataccgtgaatcgcgttcctgccgtcgttgatgtacgtgtgatacaccttcccgtcgagaacgaaccgccccctggctatcctctgcccgacccgtccggtaaccggcccgaagtaattagtgtcgttctggttggcatgagcaagaagatcattacagataaaaacaacttgaattattttgccatattttcgacagtgataacgcaaatgttaatgtctattgattcagaccgttcttcggtatggtaaacaaaagctgcttgtgtgtttgaatgatattccagatgatgagaagaaaatggataagggtagaacggaacagtgatttggagatgcggaccatcgttttctggcaagctcaaggtttttagataagcattctgaaatttttgctggctggctgaacctctgaagattagctatttattttttgcttagactcgattctattgaagggatgatactctgaccacgtcatagttggactaagtgacagtgtgaaacatatggaaaatgacaataataaaagggatttacatcagctttgcatgttgacagatgacaagggaagagtactgccaaggcgatccccccggtcaaacgattgttttcagaggaaattacgtcatatggtatttgttgttttgcctgtgctgatgagcattgtttatcttctagtagtaacttggtcacttgcagacaaagaatcataatttattgcatactgtttgatacggagtatgtttgtcagggtttgttccaatcgtatttcatttgtgatttaaaattttctaaagagtaaatttcacaaaactacatatactatgatcaaactatcacaaaactatatatttaactcggtgtatcacaaaactacacattcaacaccaaatttatcacaaaacaacatatttaaaatgaactattataaaactacatgttaagtaactaaattattataaaactacagttttagaactaatttagtcacagaacaataatatttatagctccagcataataatggtgctagggatttaaactctaaaagctgtagtttcgtgacaacttcaatattaaatatgtagttttgtgatacttaaccttaaatctatagttttgtgataaatatggtgctaaatctgtagttttgtggtataacgccttaaatctatagttttacgatagtttaatcaaaatatttgtagttttgtgaaaattactcttttcaaaattccaccatctttttgtcagttatacatcctttttacacctttctcatcactgtatctggaataagttccaaatgagtgcagggcaagcaatttcttgatcagacaagtacttttatcttgtgtatagtgtacaggggaaaaaaaaggaaatttaaagaatataagattcattcatccattcattaatagctgaggccttaactgtcgagaacaagtttgggtttcaatggactatgagaagaaggcaaaagaagaagctgaatgatattgccatttcctgcccaaaacattaaattttggaaggggtttggtgttcttaccacgtactcagcaatggtgtctaggccaagcacaacatcagccaaattccctgcagaaacacaagcactgcaaattcagaccaacacacgcaagtacacaaacgccataaagaaaaaaagctcaacagaggggacatgacggtacctttggaatcagggaggacgaccgacatcatggttgctccccagttggtgatcttcacggagaagtcccccttcctgagcacgtactcgccgaccgtcttcctcgcaccggcgccgccggcgagcgcggaggccaccaccaccaccacaaagcacaggaacgcgagagacaaccgagctccagccattgtgagcaaagcgattcgtcttgggcaactcacaggacgagaggagagggatgcatgcaactcattctcgatggtctcctgatatagatgtagatataggcggataccggccgcgatctcggacgagtttgttcgaggcgggaccggaccagcctggttacggacagacacctgcgctgcgcgcgtgctagcgtgtgatctttttgattgatctgatcctttcatccgtttgtgtcctcaagtcgcagcgaaacggagccaggtacacggtccgcttgcattggtcgcaggttgtgcatgctcgatcggccggaatccggtggtccgcccgcgagcgagtgggatgacaatttgtcattggggaagttggcaagtgtgctagtacgtgcgtggccactcttgaaactgtgcacagctcttcaaaaagaaaggaaaaaaagaaactgaaacgggccaatgataagattttgaacttgtcagttgtcacccacgtgcgccgtaggatgcctgccgccgccgcatcatgcaaaactatctcccacaagtcagaactcagaaccatcctttggacgtgttcttaataaacggtttgaaggacttgctacaagcagctgaaattttggaaaatgtcaattgatttttggacggataggatggctttaagattcgtgccaaatctctccaaatctacctttctctcttctttctcgtgccgccgccaccacattcctcttcccctttctcattgtctctcattctcttgttccctatggcatgtccacatgtgtattgatttaccttatgtttttgtgatatgtttccactttgtacacatgttgtgttgatcgttgtgttaggcttcatgttattttcattttttcctgctatgaggtgcttgtgagagcgactcacaacgacctggaagttccgagtggctgtcttggcttggttgagaaagctgctaggaagtttcgccctattaaatttaaccgttgcgatcggagaattttaagaaacacctattcgaccactcccgccaagtgacatctatgggctttcaacgctcgcctcaatagatctaacgcccgtcaacatactgtccatgcagttttggtgacacctcgtcgcccgcctttgtgttccgtccacaatcaggttcccctccaccccggccatccctctaaaaccgcccttacccccccccacccccacccccgcattgcctcgaactttgaaaacctagtacgtcggttctctgctggagttcaaaggtcaccaccatcgaggctcgccatcactgttgctggtaaatccatcttttacctcccattcctcttctcccacctcccccggtctaaaaggtggaagacgataggcatgccattgcatcttaatccacaaaaaatcaacgattgtctgaaatttggggaaattttagtgcatagatgaatagcaaatgtgcagtttgaatagttaataattgaagccttccaggatgctagtaaattatagctcaataacgttcttttttctaaacaacatggtaaaataaaaccatgcaaaaggtcgaaagaaaggaaaataagtgcataatcaacctcattattgattcatccgaacacaggacgtaagtccacgacttctataaatagaaatactacaaaacggtatattgttccaaacaaaatagctgacgttattatgatgttagcatggtatagtacttatgaaatatcatgcctggttgttgacagaaaacacgtggcctgggagatctgcttaactccagtgcaggtcaaagctcgccttcgggtgtgttagcatgccagttgatttgatcatgtaatcaacaagaaataaaagcaaagaaatcgcggttaaatctataaatgatagccgatcggccagatgccgatgacatatcatttatctttgagccgatgtcatctgtgtatcgatcggcagtcgtgaataagtaagaaagaactaaatctactcgatcggctgtagatattaacgatatatactccttatatcgatatatatttaaatcaagtgattgggatagatcggtcgccatgccgagacagtataaatcacttagattgaaacatatatcaataacaagactatatatctttatagcatagccgatcaaatagatctagcatgtatcggctaatactccgatacttccctatatcaggatattaaagcaggtataatatatcgaacagaggcctaacatgcttagatatagcaatatcttgatataaagggcagatttaacatattaatgaagcatatagaacaaatatagttaaattagatacgatcggctgaaactccgatactattctaatcggcaactagaaggtaggctagagatcgatattctaagcacgacttaatatatcaaactcaactgatacatcattaagtatgaaaagaagaacgacatctagacaatcaagccgctagaagtttcatagaatggtggatatcttatataatctagatcaacgtcaaaatctaacctaatcagttgccctctgctaacagatgttagccgataataggttagatggtgatattgctagagattatgtaagatatatgataactcgacgaattacataaataagattagagtatcataaagatggaagcactaatcctaagaacacaatccgtcataacaagttttacctcttgttgaagatcgaaaccgatgcagctcaacccgaaagcaagaactcgtcgaaacaaaactaaagcaaaagggtggcgatgcgccgaaattgtattgaacgtgtgtgttgtaaattacatagggctcggggtctatttatacccgagaattacaagacatgcccataccggacacgactgttatctctaacaaactctaagataccataagtctttgcggcaaacttttgccctaaacatatctctaaggaaattacataaaacatcctaattaatagatacaattgccttctcaggactctatccatgcgtggcaaccatcttgaagcacatcttctcaacccgatgttgtacaccaagtcgtattgttggaatcggctgtatcggcttatctagcccgactcagacccagccgatactaatcatagccgatccagactccagccgattcttgctctgtttccgaactcgatctccgcctctgactttgctttgatccaatcttctttcctgacacagatgttaccaaatttggttgttaacactggtatctacggttccaaatctggtacctacgtgagatcgagcatttgtttggatggttagcgacgccggtgggcacattgcccacgagcgttcgaaccccaagttcgacgctcgtgctcacccgggttttttccccctcttttcccgggactgactttggttggtcccggttaggtataatggtacacacgcgcgtgcgcattcagtggttgcatatttcccgtgcactgaggcctagtgccttcaatctcaatcctagtatgtgttagggacgcgcacacgtgtgtatgcgtgtgttgtggtgtgtgttcgtgtgtgtcctgatttgtaccctcccaaaaaaaaatctggtacctacgttaccatgctaaaacatcgatgtcattatgatatgtaagtatcaaagtctgatatctataagtattgtgtctggtataacggttcatatctgataccaataataccatatctgttatctacgataccatactaacattgtgttgaagtcagcacacataacctattacgttggaatggtaagtagctagccctcttccgtaaaactttgggtatgagagaagtggctctcgtatggaaaaacttttataagtccgcaactaacccaccacattatggtgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggccttacgatcaccgacgggaa

SEQ ID NO: 61074 - DNA, 3646 bp, Oryza sativa
aagcggccgaaagaggtctcccattcttcaagaccctccggggcgcaggaaagttcagttggacaccagaatgccaagcagcgttcgacgacctaaaacaatacttgcaaagcccaccagccctcataagcccgaatccaggaagcgaactgctgctgtacttagcagcctcaccagcggcagtaagcgccgcccttgttcaagaaacagagttcggccagaaaccagtttattttgtctccgaagcgctgcaagaggcgaagacaagatacatcgagatggaaaagcttgcttacaccttggtgatggcttcgcacaagctcaagcactacttccaggcccataaaataatggtgccttcacagtaccctttgggcgaaatactacgaggcaaggaaatctttgggaggcttagtaaatgggcagcagaactatccccgtttgatttgcatttcgttgcgcgcactgctgtcaagtctcaagtgctagccgactttgtagccgaatggaccccagtgtcaacctctgaacccgagcccgtcgagcagccctggataatgtgctccgacggttcatggtcgcacaagggagcaggcgtcgcggcaattctcatttcgccgaacggtgtaccagttcggtacgccgcaaggttgcagtttaacacaaccaacaacgcagcagaatacgaagccattcttctaggcctaagaaaggcgaaagcactgggagttcggcgcttgctaattcgaaccgattctaagttggtagcaagccatgttgacaagtcctttgaggcgaaagaagaaggaatgaaaaagtatttggaggctgtccgaaccatggaaaagtacttcaccggcataacagtcgaacacttgcccagaggccagaatcaggaagcagacgctctggcgaaatctgccgctagtggcggaccgcatttgccgggcatatttttcgaggtactgcacacaccaagcgtgtctgtggacagtctggtcttaacaattgaccaggtaaaactgggagaagacccaaatgactggcgaaccccgtttgttaaatatatcgaaactggctggcttccggatgatgaagcagaagcaaagcgcttgcaaatcagagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtgggtcgaagccgaactccttggtgcaattacttcggcagcagtacagaagttcgtgtggaaaaacattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaacctacaacaaaaaggttcgaccgacagatctcttgcccggtcagctcgtcctaagaaaaaaggcgaacccagtggctgtcggcaagcttgaatcgaaatgggaaggcccgtacctcatcaagcacaaatcaaggacggggtcttttcggctggcaacattggaaggcgaggggctcgaccactcctggaatgctgcctccctcaagcgcttttatgtctagaataggtggcacccaaatcgccaacttgtaaaaatgtatatagtcatgtaagccattcggcactatgtacgcctcccggcaaaaaaaaaaggaaaaaaaaagaggaaaatgaaaaaagaaaaaaaaactggatgtagggttattatccgccatggaggcccgaaccagtataaaacctctgtgtcctctaccttcttttttttattgtgtgattgataacttgtggaaaaaccccaaggcaaacgcctgatcagcgaaaaagccaggggggcgaaacgaatcgcccgaagcatcgctcgccgaacgttgaaaccacaacagcttgtttcggaaataactaaccgaacgccattacattcgatcagcatgaaagtaaaagcgtctatcgaaaacggaagacgaaagctggaaaagtcgaagcctatttcgctaatgtatgcaaaggggccgacatgttccgacccaacgaaagcacgcgaagtgacaatgcgagaatagcgaaaaggaagtaaagcacacttttattgattcaaaaaaaaaagggaggtatcgaggattacaactcaaacagtgcaatatagatcacaaataaattacatcttcgccctcgtgtcccctttctcccctgtcggctaaagaatgatcgggcgaacaaggttcgtcgtcgctaatatcatacaccactctaaggggagaagggggcgaaacgcaaattatgccataacggcgccgaaagatcgcttcctgccgatcggtcttctgatgattccgccaaaagcgaagccatgtcgtccaaacgtcttgaatgaacaagatcataatcctccagggttcgctcagggtgactccgaagccacccagcaaccttgaaaaccttatagctgtgtccatttatcagcatttcacgatacacaggccgaaacgggcatcgcatcttcggcaaatcttttaaagccacaaatttctcgttttggtttcgccaacttccagacgggggtcgaatacacagttttcggcgaataccctggcagataatgcagaaatggcaaaaaaccaatcgaatagtgagaagtaggcgaaagcataacaaggaccaacagtaaagggcgaaaggtaggtctgttatacatattttaaatgcccaacgacaacttagtctcggttacaataaaaaggttagcggcagcctgccgaatatacaacggttcgccacccctggcgaaccccaaaaaaaaactatgaaaatctaaagaaagggcggagggcctcacacctctgggtgatcctgggcatcacctccacccccttcggcctccacgtactcttcttcgcgaagctccgccgcctcagccttcgccagctgctccaaaaggcgcgcctta

SEQ ID NO: 61075 - DNA, 5441 bp, Oryza sativa
cccgtggtaaaggccgcggacacgcgcgcacagcagtcgccgtacgcggtggcacagtccgaaaccgaaccaccagcctgctaggtccattcggagaagtcaaaggcagaggcatcttcggaagggacacctcgcactttcgcgcccatatcggtaagagcaaggcgaagcgtttggcaagctgttcgcgcggactcggtagttttcaccatctcccgtgaaaaccgccgcgactccgcagcagcgcttgcctcggccttgcagacttcctgccgaagagcctccatcttcgactcggtaaggttgtagtaatccacaagcacggcggagtgggccttttctttttgcagttcggccttcaagcgttcgacttcggccctagcttcattccctttttccagttccaactggagccgcttgttttcggctttcgtctccttcagggtgttagccaggacctccatctcaagatttttgcggcctatttcgtcatccttcgcccgaagacggcttttgaacccgtcaaggcgggctcgcacggttcgctctgttgaacagtgagccgcaaggatctgggcgcaaaacaagagcggcgaagagagcaagtgtcagcaaaagcaaagataagaacagagaaaaaggaggggaaagacgtacccgaaccacaagactttttatagcggagcacccctcattgaactcattaagttcggtgaacaggctcggggtgccggcaggcatgattagattgctcaccccttccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgaaagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgttcaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctcccttttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagcacagtaaaaagcccattaagggaaagcccaatactgttcacttcggcccggaaaaagtaatgatattttatttgcaggaacagtacgggtttcggcaggagcatcgatcgaaagggggcgccacataccataccacatggtttgcacggtctcggccgaagctccgctctcacccttgcccgcgaggggcttgttggcggatggcatgagtcccttcgaccgaatctgccgaaacccatggcgaaaaccacgagccaaggatgatgcgaggcgaagggtcgcacgagtgcacgccgaagaaggacgacttcgccatgccgaagaaggacaacttcgccaggaccggttcgccccggcatccagcccagagaaggacagcttcgccaggtccagttcgcccccgcgagggccaaagtagccttctcggcccaccaagcatagaggccatagggccggcgatcgcccgatggcccatcaagggcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacacagttaatagcggctaaattgtaaatgagagtaaatagctagactcttctcaaacaactatgggcatcatcttttcacttatgcttatcaggcaaaatttgaattttcaatattaaatttggagctgattttgagatttttttcatcgaagtttatttttcagcctttgcttttagatcgctaagaatacgtatataaaagttttattgataaattatttttcgtttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaatagaggaatccgagcagcaatccagccaacgaactcgtcaaggcaagagcaccttttacggcgccatggccgacgccgagatccctctgcgcggagagggacgggagcgtgagccgctgcgcgcgagtgatgaaattttcgatctgagatcagggggggaaacggagagagactcacgagggtgcggagagcgcgtggcttcgctggcctagtccccgccgccgccgccgatcgccgcgcctgcgcgccgcgtgccgagagcctccggtcgaggagagatgcgagtgcgcggaggaacatgggcctcgaaatctcgatcgatcggaggagacgcctcgatttctagggttttgacggacttcgctgtgggaggagtgggaagtgcggatgcgcaacgggtcgaacggatttccgacaaaatccgatcaaattttgtcaaatcagatatttaaaatccagtttgattttcccgtcggtttttttgtaaacacctgagaagggtcgcatggcccgtgcgcacgcgcaaaattgggccagtatgggcttctacctttccttctagcgcgcgccggtgcatcttggacatccacgtcttgtgctctgccgtgccggcgacggcggcggcggcgctgccaccgtgaaccgcgatggcgggcacggcgatgaagaactccttcgcgccaacatggccgcatggctaacgaccttgtcatgagaaacaccggtctcgacctgatgatcctgttttattgtgaatatatacgccactagactattagtaaaaatgcataatttttacaggcaaaacttgacatttattagtacacatacatcaactatattatctcatattagttcttagcgtacacatgttactttggattttggagaaagatgccaagtagctttcgaatttctgtttaacaatgtccggaatgtttaaacgcgtacagttttgaaggcaaatactatgtgggaataataatatcgaacgaagcacatcccagaacatataaatcaattcttgccagtcttcagtacaataggaacagtagcagcagcctactccatatttcagaattcagacagatcctagtttctgataccgcatattgacaggaaaacatttacctctaatcacctagcaagtactatagagaaaaatgaacagaaacaaaacttgatattggacaacttttgtagacagtggctctaatcatagtagtcttcatctgtcagaagaaaaagagaatgctttcattagtaatcttaacaaaaccaccagtagtccattttaggaagagagaaggatagatctgatatgaatagaagttcaaatttaaacttacgtgcttcctcctcttggttccagtcatcatcgtcgtcatcaaactcgatattctacaggaagttaaggtattagagtgctaaagagatgataaattacaattccaaaaaaaaaaaaaaatgattcatatgtgttccaacatgt

SEQ ID NO: 61076 - DNA, 9092 bp, Oryza sativa
tagtgtagctgccgtagaagatcagatgcttccattattcctgacagttgaacagaaaagaagagcctattctctgaaccaggtatactaaattctgtaattgctgaaatttttaaaaggactatacccctacttttactttgctctcctagtagtataaaataatacatctaatgtcattgttggatccattttgcagatttttgtattcttcacttgtcctgctctctctggatagggacctgccaacttttgatcaagtgatgttgtatcctgtgtatgaaacggagacaacccgtgatggtgcttaatccaactatttacgcctcactattcatctcagctctcgagatgataacagtgccttaaaaaagaacaggcctgttacctgtacatgcatgttccagtgttcttgcatagtgtggatgatttcttcagttgccacatttctgcgaacttggaactggttggcgaagtatagtaatatttcagcaaacttgcattatggagtagtaaaaaaaatgcgtttttagctttcaggagcagaaaatttgctaggatttcaaagctacactctggagttctgtatatcattgtgatgaccaccgcatatacaaatacatacagacagtgtctgaatcagtccaagatcaatactaaatgagactgttggtgcatacaggaccacttttgtctaatggagaagtatacccctacaagtatcctgtctacatgggcaaagtcagtagcaatttattggtgcaccgggccgtgtatcaatctggcagtacctttcgttgtgggtcctgcaaattttcagctgaaaatgcagtataacagtactatggtgtcgacattgtctcgcaaacagcatctcagttaagtcgaagattagctcgcaatgatcaaattaagatgtatgtgtcagtatcacaaacaccccagcatctctcaacattcagtaaatacttacatgttcagatctagcatacagtacattgggatgagaaatttaacgtgctccccattttgtattgcagtgtgcatgaaaattgacattgggctctgagacttttttggatttggaagcatataaacgggaatggatttgggatcggaacagagagaataacttctcggatccagcgactcacatgggacagaaaacagtggagtgagttttgcacataataccagctataatgaatgcttgattcctagttcaataaaccgaagtagtacatgtatgtacacatggttgtaagctccacaaaataggcaaatgaattaagaaaaccatgtgtgcctattggcagtaaacaacgccaaaaatgttgtgtgcgctttggtgattagtagataagcaggaatcactcggtcgtgagctcgttgattgtttaggactagtggtgtactttaattaattgttctccaaccaagaatcaaccaagttgatcggtttttaaaatccatggacgatcaaaacagaatgcaatacagtattcagcttgcgtaggacatacacacaccagaaaacgctcgacgatcgatttgcctcgagacttgaacttgttacatcatcagcacacatgcatggattagctagcactctagctcgttgctacctcagtcccaaaataagtgcaccgtggatatccgtgcccaacgtttgaccgttcgtcttatttaaaaaaaaatatgaaaaatttgaaaatatgtagtcacacataaagtattattcatgttttatcatctaatagcaataaaaatactaatcataaaaaaaattcaaataagacgaacggtcaaacgttaaacgtgaatagtgtaaaactgcacttatttgggacggagggagtagtttattaccctgatgtcctccgacgagctaaatttaccagcagtaactgacattgacgggctaatcctagctagttaatcactctattaaacatcagaggctctagtatgtttgtggttggaatgtaattagagcagatgacagggcagaaaggacaacagatctaggggttaattaggacgcattgcatgcgttaatgactaatactagtacaagtagatcagaataggtctaaatgtgtaataatcgagccgcgtcgagccgagcgaggttaagtagactgaaagtaaccagatggtagggcgaatctcatatcatctaatctcaggtggtcctgcacaggatgatgtctgcagaggaacaaacaaaaagtctgcctgggtcgctttcccttaattcccgcttaattttggatctactatcttcattctccgtaacacacatttggatctacgttcaccagggtgtcacttcatgtgttttgttttgttcggttgcgtcgtaaacaacttgtctaaatacctcagcctcgatctacgtctctggaaagtagaaacgccaatctagctgaaggccgtcgttgtgatgggccagacagcccatattcggtctatgcaaaaccccgcgcggttgattccttggaccgaagctggctataatgcagctcagtaagtctatttcttcttcctccactactgctaatgatcgaatcgcctcccttaaccacgaaacagagtataacgccttgtccattttgaaaagcagtgcaaaccgactacttctgtggttttaaaagcagcttttgttaatgtagcaagttgactgcggtttcctctacatgggttgactcactaagttgacgtgctcagtgaaactactttccaaaccaccgaatgagttacaccgtgtttagatctaaagttttttttttcaaactttcaacttttccatttcatcaaaatttttctacacacataaacttcaaacttttccatcacatcattccaattttaaccaaacttctaattttgacgtgaactaaatacagccttagtgtgcatagcttttcgaatttaaggaggcattatatacggtttttcggttgagggaggagatttttgattaaaagaaagagataagggagataaaatagacttattattaacgcaacacattagcctagcccacgtttcctcaaaagccttaaccgattcggccggcctgcgtacgtgcggtgcgggccgtgcgcacgcgcgctcacgcgtcacgcggcccgcagcgtgggatgcggagacggcaacgcgaggtgctcgcgtcgggaacttgggctagtaggagggcggcgcggtttctcctgggctggaaggcaacaagcggctgcagagtttgggcctacttctagttctagtccgctgctgctttcgacgtcgtttatcagcgacgattccatcttggactctctcatcgatgatcgggtcatcgcacacgttttgtgttgttcgtttcggccaaagccgtgccgtgccaccctagaaacagcggtggccggattgagtttgattcagcgattagttgttttgttcccgtgcatagacttatccggccggcgccgtggagtttgtttcagcagttgtttcgtccttgcagcgtcgaagagcactaccgtacgtcgtagtcgccgtccaacgtacgtaatgcagtagcagatagcgactacgtactgcacgggcgatggagtgaccaaagcacaccggtgcaacttggctcgacgatcgacaacgctggcgacgagttgaggacccgcataaatgcaccgatcgaagcatgcacttgctgattctgctgtcgatcgatcgatcgatgcgtgtcgaagggtgaaacgcatgtgcaacgacctagctggtcaccggctctcgatccatcgatcgccggaacgtaaatcgaccaatagtcaaattttcaccaacacacaaaagaattacacgtcaatatttagaaaaaaagagttataattagcagaccgtttatgtcaggtgaaggaagaaaatgcaaaataatcgatgaatagtcaagaaatcgagaaaccccaagggtctttcggctagctctataagatgatgggctagacaatattcgcgtctttttatagtcaaagaaatcgtatgcatgggagatgatgtgctagctttgcatgcccgtgcaacttgctgtgctgcaggatcatatatagtcaagaaattggttgaaacagcgaataatttcagtcggctgcctatcctattagacagtcccgatacatagggcaacttgcaataacaaaattaagcaagatcctgccgcgtactgtgtgctgtgtgcaaaccaatccaaaactgttgatgcattaactaagtgctactcgatcgtcatttctcgcagagttgctcgatcgatttctcccatcgtcttctgaggatcgaattagagagggagggtacgtacgtaatgttgtaatgagctaacgcaatggacaactcatatgctagctcgcgatataatgccacaccccggcaaatctgcaaatgctgatcagatcagtcgtcatctacaccgaagaaaaacggtggcaagcgcgattattgtgcatgtggatgtggatgctgcatgccgctacagtggctggctgcagcgctgggtcgacgcccggacaccggacgattgcggtggcgttccagtccttatgcagatgaacagcgcgcgtaaaaccgcatgtctgcacacttggtcggacgggccggaccccgggcgaatgtcgccaaccacgtcgatcggtcggttgatatgtagccatttcgtatgatttttcattggtgcaaagtttcgtcagagatggagccccatatatataattacgtcaaaggttgttgacaggatcggatcagcatacgtacacaaattaaagtactcatccgaacttgcaggattaagtttcagaaaattgagtaactacatgcatcaaattaagctagctagtactagatctgaatggttcacatatctctcgatcgtgccatcagtagctaggtagaggtatcgtgagggttgcaagggctacaagctgatgagcagataatgaagaaatataatggaatgcatggtcgagtggaccgcagagcatcgacacatttcaggatatggccactggaccatgagctcgaacagtgcactacctgatctccatgcatgaatgagacgagatcggaagggacaacgaggtttgcaattgcagggaatagtctcgcttgttcaaaattgagctcgaaaattaatccactcattaactagttttacttatgttaggccgctgcggttatctctgaatttttctatccttgtttcccatttaatcctggaccactgttcactgtacgatgatgcgaaaaaaaggtccatgttccttgaacaatggctatttatgttgtaacctaattctgacttaaaatgcacgtctaactgaatgaatggagaactagtgcagatctaatataatctgccataagtgggaactaattaatccttggggtctcggttaaacgatgaattcattgcaccgacaactcctgttattttccccaaagtaaggagcttttgttaaatcagtttcagactttcaggcgcatgcatagcatatgtactatcatagcagccgttttggactttggaatttcataattatgttgtgtaattccacgtgaaatccctgtggattaattttatagtagatcgtccaatatgatttgcattctggattgggcatgtagtatggcatggtcaccctcaacttgtacaagatcgagccagttaaaaccttatatgtctgaaaagaaaaacattttatgtcctttgcaggaaacctgtgttacatcaagatctgcctaatttaattagttcaaagccaggatgccatcattagagtatgccaacagtcactactatataaatgatttttctgcagtaaatccatcccctataggttgtagacataccgtgattggtcacgtctgtaaaaatcaatctctattttcgcgaatggctccgcatataaaaatctattttcgcaaacgagcttcttaaggggccacatataaaaatattccatctcctcaatagaatgtttttcttctctttcttcatatcctctccttttctctctctttcttcctctcctctgagtggttgggaggcggatccggccttgagagggtaggatccgccaccctagggagcggttgcggcaacggtggatggtgagggcggcggatctggtgacaacaccctcgagagggtcggatccgtcgccctagggagcggctgtagtgacggcggattcggcgacgccgtcccgagagggccggatccgccgccctagcgagcggttgggggcttggcctcaaacgggcttggcctcacttctcctcctccacaatcgggtgggaggtgtggtcgcggcgagcgcgaggctcctcctccaccaccaccgccaagcgagaggcgcggcgccgtcgaatctggcgtcctctttccctcccgtgtggatccggccgttggtccgtgtcacgcctcgaactagtcccgaccgggactagcccgtgacgctccaaattaacttgttaatcgataccagtcccaggaatcagtgctggtatcccaggaagacagaatatcacagcaacagaggtctctttattatagagtaggagtacagtcatgttgggctgcggacagatcccgagctcacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaattggggggggttatttatatagagcaagggtgagtacaggagtactcagcaagccatgggaaataagtgtttaatgcaggcttcaaagaaaggctgttgtttttgcaattgattttatttgaactcttttctgaaacaactaagtgagtgcttctcaaacgacacggatgagacagtgcgtctcgtccggtcggagtatgtgcaatgtttcagtcttttgaattgataaagattggcacccggccaacagctttcaaacggccacccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggatacactttacccacacgacattactaacctggatcatccagcccgtgcagaacggccacgtctagagaccttaaggcttttatgtcaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcatacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtctgaaggcgaccgtcgatacccgtgcagagagcacgattaccgaggcgcaactaggtgggtacaagggaacatggtataacaattacaatggaagggtcaaatgcaacaaattaggtaggtctgccaatctgccttgcagacgggacaagcagattaagtgcgatcctatcaatgcataatattttttaagcaacataattaagttcaaatataggctcaagatgttcaaaggtggcttgcctcgctcgagatcttgagcttgatcctcgaaatcctcgcactgcgggtcttcgagctccgaaactacacgcgaaacaggacaactcagcaaacggcgaaaataaagccctattactgacctctaagtgtgccattaggtagatctcgagatctgaggaattttggaagttgaatggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaggatggggcggctcggccgagcttaatgggccggccggcccaagaaggcggcccaaggcgcgcgcgcgggcggggaggggagagagagagccggtgggccgggtccatcccgcgtggtcccgggtgggacccgcttgtcggcgactcggctcaccgtgagcgaggtgcacgcgggcatgctagggtttggggagggaggcgtggcgcatgcgcgcggttcgcggaggacgcggtgcggcgggcccacgcgcagcctcacggctcaccgcggaccatgcacacgggggggaaacggagggagcggctggccgggtcagccgatccggtcgcggccgaggtggcgccaacgtggcgcctacgtggcagccacgcgggccggcgggaggtagacgacgatgtcggccggaacggacggcggacggcggtggcgattggcggagcgaaccacggcgatacaggcgaaagcgagcacgccggggggttgcacgggacgaggggagacgagccaacggctcggattcgccggagggagctcgacggcggcggattgcggcggcggcaaccggcggagagaaaagggggaaacggcgatgaggtcacgagggccgattcccgacggtgagagcatctacgtggctacgggaatccgttgctagcgtcggattgggcggagctacgccgagcgaggccggctacgagcgggtgctatggagcacgggcggcgacggcggcgagcacacaacgagcggcggcaacggtcggggcggcgccggctagctacggggaggcta

SEQ ID NO: 61077 - DNA, 65521 bp, Oryza sativa
  unsure (1)..(65521): unsure at all n locations
ccgtatggtttcgcttttgcatgctactccctccgtttcataatgtaaatcattctaacatttttcacgttcatatcgatattaatgaatctaaaaatatatatctatctagatttattaacatcattataaatgtataaaatgttaaaatgacttacattgtgaaacggaggaagtagtatatttcctgtaattcactgtaactattcttcggaaccttgctatacgtacgactactccattcaaccggtgtccgactgaaatggcacaacaccataccacgtaacggcgtaaggcttcgtatgatgttctgcatgttaccgacgccgtgtacttcgcagtcgttggaaagttggacgctcaggtcgcgtgtgtagcattttcattttctttgttactggtagatttggtcctgcagctcattttattaatattttttaggcaactaaaaagtcataataccttattaagtcacctagcacactagtagctaggagagttaacttctgccccattatcacatgaagctcttaagtcctactgttagcgcggacaatgttgttatggtttctaccgctataaaatcgaattaatttgcaagcatatataattcatagctatccctagaaattcatcttgcttgaatcaattcatattgttcctactagtttccatgattgctacaggagaggagattatacgggagagaagacggtggcacaactcataacacaagtgaggcagcttgggtcctaaaaaatgttgagagattttaaaagttaagatggctaccatgataatctagagataaccgcgtggttttatccgcgtggttttataaaccctgttagaaacttcagagccattatgataggtgtggatactgaggcagctcaatttgttatgctaaaagcaagctcatgaaccgagtcggaaaaccttagcgagctaaaagcctgattcaactcgactcgcaagttggcttgttaggtttattaatatatctattattattctttttttgccgagaaagaccgaatgaggccatccgagtatattaataataaataaagttacaaacaaaacacgataaaaactatcgaggtcggaagtgcaccaaggtacatgaccagatagccacgtgctaaccacacaaacacaaccaaccgaaggtggaatctagcaccgaaataacccctgctaagtgtgaccgaacgcggtcaggcttacgacaacaccaccaaaacgagactctaaaaacaatgctcccacgaaggtcacaacatcaaggatgtcaccatcatccatctaagaagatgtggttttcacctagagaaacatcaagggagaggggtatcataatttcaaatctataattttatcatatgcataaacataaataatagatattaactaataaagaattcattatatacaaaatagtctagatgtaattaaatgatcaagcactatttaagaatttcgagcagctcgctagattaaggttagttatttttctcaacttcaaactttaattttatcgttttccgttagtatgcttttcaaactgttaaatgatatgttatttaaaaaaaaatctatataaaagttattttaaaaaatcaaataaatatatttttcaagtttataattattaatacttaattaattatgtgctaataagttttctcgttttgcgtgagttaaaaatctctctctaaaaaggagatataatgcaaccaagtatagtttgacttgacgtattaagacttcgacttcaaattcgaggtgaaccaaatcagattagaatcctctacagttgaagtcacgtgactttcttactctaatgatctatgggctcacatgtcggtgataaagacatcgtgcatttaactgaagagtatcttaatctaatcagccccgttcgttagtccaacaaaagttggataaacttttgaatactcgtggcacgtttttcaaactaataaacggtgtgtttcgtgtaaaaactttctatataaaagctgctctaaaatataagattaaattatttttcaagtttctaataatcaaaacttaattaatcacacgttagtgccacctcattttacgtgaaacacttaatatttattttcatcttcaggagattcaaacaccaccacatgagtttcgtatttttgttcacatgtcacaagtttgcactcgctcgaacgtttcgacggtataaacaggggttaattggatcaatgccactgtaaatgtgacaaatcagaaaaatgcaactactatttatgttatcggccaggtaccactgaaaatttttaaaattagaaccatgccactcccgttactatttccgtcgttctctctcacgtcgtcatcctcctctctcacgatggcacggcgagggcaaggcgtcatcctccgaggacgaggcggttgccggcgaggacgtcgcgagcgcggggagcaggtgcggccgcggttgccgctggcgagtacggtcacgggaggtcgcggaggtcgcgggcgccgccggcgaggacgggagcggggagcaggccggacggcgaggcagtcgtcgtccccgagaagctccggtcgccgccgatccagctcctcctccatgacgagatccgagcagcaccaaatcctgtcgacggaccagtcgaggactgggctgtcttgggcatgggacagcactggactccccgtatggtcgagcaaggtgaacttgcaccgcgcgttcatgggaccatcaattctatcttgaagaatgagcaagaaggacatgctccatggtgagccagaagctgctatggtattggtaggtgatacgccagaggggagcgggcgtccgccgccgaggacggtcgcggggaggtcgcagaggttggggagcgggcgcggccgtcgccggcgaggacgggagctggcgcggctgcggccacggccggcgaggacggtcgcggggagcgggcatggccgccgccaacgacggcgcggacgcagccgctgtcgccgccgaggacggtcttggaggcgggtgcgggcgctccttccccatccgtcgccgtgctgcactcctctggcagaagagctcgtcctctcgccgctccttccccatctcgacgcctctcgccgctccttccccatccgccgccgtgctgctctcctccggcgccatgttgcccaaccgccgttgagaccaagatgaaaggtgaagacagagacggcaaaaattatgacagagaggacggaaatagtgacggagtggtatggttctaattttagaaaattacaatggcattaactcgatttcataaataggagtgacatttttttatttgccatatttgtaatggcatgatccaattaaccctataaacagagggccgacgaattggggtaaaagtgggaatggggtaacggagatcggaacggacgcctttcaccctttccggctttccccactggttctacaggcatccgcgcggattcaaatcaaatccctcgtcgttacccattccagccttcccctctcaccttccccaatctccctgcggtagaaccctagaggaaccttctagaacccccgagccccccccccccccgcggcccccggcgaagccagcgagatgattctccggactccaccgcagcggaagcggcgggcggactccgacgtcgacgccgccgccgccaccgccaccacccggagccccgtttccgaccgccgcctcgtgctctacgaccggcccaccgccctcgtacccgctggcgtccccggggagcccatggatgacatggtctgcacgtaccactgccgtcagatggtgagatcgcttcgcccctatcttctactgctattgttgtcttagcccaatggtcggtggaagcatagcgtgtctagtaatttcggtgttactccagcctcgagctcccatttagctccaggtagtctcatatttgatatgcttagctcagttgattccacgcatgccacatcaaaaatgtagacaattatcgattgattgatcaatttgtaaggaaatagatggcgtggagcgaataattgtgtgtggctgttgcagtaagcgttattacatgccagtgtaccatattgatatatacatactggtgtgttcttttttcttgtatgtaattctcgtaggtgaaatcagaatttatggtggcattggacactgcagagaagcaagttcaggagtatcgagccacacttgatgatatggaggaacgattatccaagagtggtatgctgttcttttttcgcatgtgtaccttcttaagttcgatttgctatatccgttggtcaagatacatttatgtatcacttgaagcatgcacggagtttgggcctaccttcttcctagttgtgtttagtttgatttgccgggcgcagaaagtaggaaggacacgtagtattgaatcagattcactgctctaagcaatctactgttagaaataggtgttagcttattacattcgaagcaattgcatgcacatacttaaaggtaatcaataaacatttttttactgcttcagaggatgagagggcaacatgccaggacaaactgaattatgtcgagcaagaattggcagcaacaaaaggtcgggaaagtgcaatgcaagagcgattattaaaggaggtgggtgactttcaggaacgctactgtgatcaaatcaagaagataggggaacttgaggtatgcaaatctcctttggcacatgacctccatcccgtcacatagctggtgacttgcctttaatgtacaccccccatttcttttggttagttccttctgcaccactgaatatttgcaaaaggcctcattaactccctaataaagtgggtctggacgtacacacccactgggacattggcttgacacataagtgatgaggcaaacattcagctcctttttttaatcgtatatctgctcatctattggcatgactaatgaagatcttggtgctgcagacgcagctgaaaaaagagattgattctcgaattgctgctgaatcatcgtcagcatccgcaaaggagtcagtcaaggagttggaggggaatttgcagcgtttatctgaaaattcagaaagggagaagaaagcccttaagaagaagctttcatacttgcaagacgacacaaaattatccatttctaaactaaatgcggaggtctgtattgttgaactcttgtgcataatgatttattactagatattggcttatctgtttgaaaatgtctgatgatagcttgaaagaatgagactcagggcgctaaactctgaggacgaagcaaagttgctgaatgaacagttggaggacttaaaaaagcaactagatgaggtcagcttatctctaatttgcatgcttgtcagctcatattttaatttgcatgcttatttttgtcaagcaatatttctgatctttccctgctaagaataggctatctcattagatcatctttctcatctattttactatttgtttgatatttttgttcaacatctatattgatttaatttgtttctggtccttgccagagtgttcgtgaaaataatgagatggagcacaggctattgaattgcagttctttatcttatgaacgtactccatcagacgatcagaagttgataaagcttttgcaagaggagctccggaattatgtgagcattataaatttgatatctcccagataggttcatagctgattctatctgactggttatttttcttgcttctttcatgcacttgtacaaactacaaaatgcttctttggatacacgtggctaaacagcgaaataccagctattgatgactggcagaatcttatgtaactaatcagtgtcttgccgatataagccttacatcgttattaccattacctgcttagtattattagatagcatagggccttcccattcatagtgcagggtaataacactgacagaatgtgtcatattaaagttctgcccacccacccccccctcgccccccgataccgcaacattattagcagtgactagttttttttcctcgagaacagcacttgctagtaattactgatgcaaaatttatgttttagttccaagggagttgtttttctatggccagctaccataaatgtagaatgttcaagctgtattgaaagctctaatcttcgcacaagtgcgctaggctgcttgttcttatattcttcttcttggattctagatacaatgctttcctgtagctgtcttaaaattggatattgtacaagtgctgcttaacttcgttcatcaagggaccctttctccatgcaatgcacttagttacccccttcccctccattcttcagctttaggcatatctgaagttttatttcttacctgtcattatattaggttgtctgaaatgaactattgtccaaaatgaatgcatttttacctgtatggttctgtgcatttaggaaaaagaagttgatgaagctagaaggttgaagtcttcccacacaaatgttgagttacttaaagaaaaaatattggaggaacaggggtgcagggagagagcagaaatggaattatctaagctgcaggaaattgaagctaaagcacagaagttggagcttgaattagcatcatgcacagcattgctcagcaacatacctgatgtatcttcttttggtgatatacctcaaaagatcgcagatttgcagaagtgcgtgtccattgttacaatttcaatttcatttgtctgctataggcgagcgctatcaattatctgtgcttctttctttctttatgtaaggtttatatggttattttgatttttaacaggcaagcattgacaaatttaaataaagttggtgaggtaacatcacagttgaaagaattaaaggttgcattggaatttgctgatcttagcaagcaacgggcagaaggtgaagcaacccttgccaaagagagggctgaaagtgctactagggagatcaagcggcttgaacttctggtactgttgtttattgctatttttataattactactgtgatgctagtttctactccccccctcagtgcaatgcaattctgtagatccacttgtggcaccatagcaagttcataatctgttcatgcaacgataactcttcctctgtacattctgtaattacattgataacttgttctttcataccccatgatttcatgctgtcattccatttgctgtttgttttctgaacagcttgctgccatcagtgaagaaagggatagattaagaaaggaccatgctgtgtcgaaatctagggatggagatgatgcatcatccaaggtttgtgatttttttaataaaattgacagttttgtgcctttatcattcttaatggaatgcacaatatttcttgtgaggtgacaatccagaatatggaatcggatctatctcgaatggaaaaggtagtaacagaactggagagcactatacgtgaccagagagaactaattagtcaacagcacactgagctcaatttgatgaatgaaaaattgagcattgaatcaagaaaagcaaaatcattggagcgagatggagatcaactacgctcacaggtggctttacttgagtcaaaggtaagggttaagatgaactattgaaatggtatctacatatgctcattctgttgtttagagtagtttcatttcgaaaaggcacccttacatctcatgtttatcatggtcccattttcttcatattgcttatatctgtctggaacatcataagtttggattaattgttccagtccgggcaacctttatttatttgtttatttgtaagcaaactatcaagaatttggctccatttatagagtgtactgagaaatgaagctttattccttttagtaaggtagcatgtctatctatcttctctcatgagctggtgtgaggctgtgaggtactggacagggatgcttctcctgcttctgtgagaaagcatgattgggaccattattttttttcagcttcaaatgaagcttggctgaatgtttttgtgcttaatttctgttgtgtttgttgtatgttgagagttaccgtttgctgctggtgcagtgatatattgttggagtctcaagtgaatgaatcttcttttttcaatagagttgtttttcacagttgtcagaaatgccactgtaaacaatactaacttagctgttgattaaaaccatgtttgtaccttgaatgttcttgttatgtttgacagctgggccatggagattactctgcctctagcacaaaagtactgcgtatggtaaatactcttgcagtggacaatgaagcaaagcagactatagaggcattgcaagctgaattgaagaaaacgaaagagaggctacaagcagttgaagaactaaaaggacaagctggtgagtggttttattcatcttttcgtccttgtgacagtgtccacattttttgttggaaccgtgtgatagagttactacctaaaggattgtaggctgtagcattcattaatcagttgtcacctactcagtttttttaattattcaacaatatctgataactcttttttttctagtcattgctccatagtctagcaagatgtgagaatcctcagatcttcaacgcttcatcaaactttaaatagaatatttattttactgcagatgttggaactgtggttgatgtgaatattgctgaaaagctagcacagcttaaaaatcaaattgcaaccctagagaaacgtgaagaaaggtacccactttgttatctgtatgttataagcttctgttcatactgatttgttagaaaatgaccttacagtttgtttgaaacagatataaggcagtatttgcagagaggatctcagttttccgaaaggcttgctgctcgctctttggttataaggtattattaatatgacacaacccatattacacagtggatcaaccctatctatctattactgctatttgtgcattctccacctctttttttttagagatgagggattcatgttagcatcttgcgaatcttacatagtgaatctgtatgcattagtatgccaagtcagtgttttgggatttcatccaatgtgaacctcttgaacccaaattaaaattgactctcgatcctggtgtttgaagctaaggatgaaagagtacatcagtatttgtgttgtggagtgtggacatggttagtttgatacttctcaatcatgctgtcttttggtttgaaaattttgattgccttcgattgttgcattggtcatgcctatttcagataaccgtgctcatcattttctagcttcaacatttcgtttgattttttctcatgcctttatgtttgatgtcaatactatttgacgtaaccttttcaattttatggttttagatagtgatgaatgatcagcaacagtcaaatgggatccctgtaacacgttttattctgcattctgtttacgcccaaagtgatgatgagaagcttgagtttgactacgaatctggaagcaccaatattgtggtaggattattaccttgctgaaattatcattcctataatttaacagggcattatttgatgttattaatgtatatacaggtcaatgactacacttctcaacatgaaattgctcagcaggtattcagcgtattggttgcatttgactgtatttcttttttctgatgcatggatgaaataactaaaaagtaatgttacagatgtgtataggaggaaagtgtggaaacatcgttatttattcttgtctaatatgactatttatttatgtcctctagttttgcatctaggttgtatgctgcacaaatgaatagtctggttggtgtcttagtgaattgcgttaggatgcaatagataaatcccagtggctagataggtgtacatttacttaacacatcacatttcatttaaggcatatctcttggggtgctcaggaaccagcaaccaagatgtttctaatgagaatgctgtacacattttctagacatcagattgtttgaagttggaacaaacatttgatctggacacccataccatgatggtcttacaacagcaaattacagaactgtttttaaatcttgtgttgggccacttggttttactgcttctgatgatgcaactatacattttcaggtagatattttcatacgaaagatgaattctatcccggccttcacagctaacctgacaatggaatccttcaacaaaagaagtatctgttgaagataaaagttcagtgagaattcatattgttggattttgtgagtatgctttcttcgagtcaccgaagattggaaaatgtatttcattttggaaacactctgggctcatgtctttccgatgcattatcacagcttctcgtagtaactggagatgtccaaattgttatgttgtggcagccctggaccgtggtcgagcaagctcctagatatagcaaggttccccccaccctttttcatatatactaaggtgcaattgatataccttgtggttttttatatgttttaacgatttgttcaaatgtcaaaagctgaggagcacggcgtgttactaattggacatgagtagagagttgatgccgggctgtcacatactcacatggattcacctctgttatgatttttgacaaagtatatatgaatgcgagcgttacttgtactgtggcctggactgaagcatgagcttttgtaaactgtagcgaactatcatatgtaactgagccatgtgaattgttaattaccgcaaaccagaattggttttcttaacatgctatcatcataacgtaatgcacgcaacgcgtagatcccagccgaaagcagttaacttaactttaccccgttcccctgcattttctgggctacaccgatccattcccctgcattttcggggctacaccgatccatgattggtacatagtacgccggtgaatccgacgtacaatcagcacacgtaaattcgttgtcatgcatggatgaactctcccaggtcaggtcccatgtctcacacgctcagcatgaggcgcctcacacgaaatggccgccccaaaccgaaccgaaccccgcgcggtgcaggcgcaggtggccgcggctggcagataaccagcgcgtttcgctcgcgcgccggcacataaatcgcgtcggcctccggctgcccgagagccgtacgtactacagaaatacaagtgctaacttagcttattagcggataatccccccagcgagcgagcgagcgaggctgctgctgcgaaatgatggtttgtgatttatcctgtcaattggttaagttgttgtgtttagttatttttgggtgaaataccgtatggatcagtggctaaagtgaatttcttgtagacactgtcgacgtcggagcggcagccgcagccggagaagaagccgccacggacgaggccgccgctgccaggcaaggccgtggccgcgctgtgcgtggcgagctttgtcgtgggcttgctgctcagcggccgggtggtggtgccgttgctacctccgggctcgtcgtcgccggcgagcaactacaagacgtccttctctactggctgcgagaacaaacgcgctgtaagttgcatatacacagagtccaaactgatctctaatttcaaacggttgcatgcatgacaactgagcttgcacgtacacaccctacttttttttttttttggaatccccaattgacaccctatatattttttgtgtcctggtcggctgatccaactctggaaaatctctcagaagctaggcgagagcaatccaacggacatcatgaacgaggtgtccaggactcaccacgcaatccagtaagcattttccttcgatcaaagcgaatcataacgtacgtatctcatgcgagcccaatggtgatcgaactgtgcgagctccctccggcctataggtccctggacaaggcggtgtcttctctggagatggagctcgccgtggagcgcgctcggagcagcgccgccgtcggcgccggcacggccgtctcatccctgggcccacagaaggccttcgtcgtgatcggcatcaacaccgccttcagcagcaagaagcgccgcgactccctccgcgacacctgggtccctagaggtcacaaaaacttacaacaatttttcagtgattcccaaaatgcattttttttattttaaaaaaagagattaggaggagaaacgtcactcaaaatatttttttaagaaaaaattatgagctgctgaggattaaatacggaatctcgaaattgaaataatacatcctctcatcactgcactatcaggtgcatctcccaaaatgttttgttttggggaaccagttccaagtatcgatgtgtatggttgtgcaggggataagctgaggaggctggagaaggagaaaggggatcgtgatccggttcgtgatcgggcggagcggctcggcggcggcgggcgacgggccgctggaccgcgcggtggacgcggaggacgccgagaacaaggacttcctgcggctggatcacgtggagggctaccacgagctgtcctccaagaccagggtctacttcaccaccgccgtcgccacctgggacgccgacttctacgtcaaggtcgacgacgacgtccacgtcaacctcggtaatgcaccatgcaaacacaaattaatacaccattattcatgctcgaataaataataatctcgatcttgttcgtgaatgaatgaacaaattttcgttgcagggatgctgacgagcaggctggccaagtacaggacacgaccgagggtgtacgtcggctgcatgaagtccggacctgttctgtcgcagaagtgagcaaatggagattaaaatcttgtgttttgtttgttggtagcctgatgcatggatgaatttgtcggtgttttgttgttgttcgttgttgcaggggagtgaagtaccacgagccggagtactggaagttcggggacgaggggaacaagtacttccgccacgccaccggccaaatctacgccgtttccaaggatctcgccgcctacatctccatcaaccagtacgtacgcttgatcctagcttgtgtgcttctgaaattgtgacgtgatatgctctgaatttttcttcttctaggccgatcctgcacaggttcgcaaacgaggacgtctccctcggcgcgtggctgatcgggctcgaggtcgagcacgtcgacgaccgcagcatgtgctgcgccacgccgccaggtcaatctcagctatcgattcttttcatgatcatcttcctagctagtggtactactccagatcagaatttttcagggttttttgttttgttttgaactttctttcgcatttttcactggcagattgcgagtggaagaagcgagctgggaacgtgtgcgtggcgtcgttcgattggtcgtgcagtggggtctgcaagtcagtggacaggatgaagcacatccacagggcctgcggcgaaggccagggagcagtctggagcgtcgctacgtgatgatcacatcatcagctttaatcgtagcattaatctttggttttatgatggtgcaaagcagctagcgggcgacgaggggactagtttaactgaatgatcgattgtttcagatgattaggaaacgagccacgtagaatggatgaacgtgcatgatggtggaaaatggaaatgcatgggtggtaactgtaaaagtgtaaaggctttagcatccaatttccagggggagttgggtcatgccatatgcttcacttattaatcacagctctttctgcatttttaagggctccttcagaacgcaagtttttttttatgattagttgaattcttatagtcaccctttatatagttcgtttacctttcaaaaagtgcagccgtgagatgtaatttctactctcaaactaaaaaaaggctgaaggatgcagaaggaactttcacatgaatcaaaatatattggtttttaactataaatctataatgaccgaataattataaggttagcttttaacaatatcaactaaaacagtcaactccctccatcccaaaattgctggtcatcccagaattgtagtggtaaattagcttaaggtgaaaattaccacgatgccccacattattactagttgcatgttgtcatttcaattaggggattaccacaaaaggcactagccacacaaggaatattttttaagtatagagttaactaaggacatgttcaatgcgtacccctggaccatgtccctgctcacgccgtcggtgcttgtcgtcaagccgtctcctagcagagggccacgaccccaatacaggggacgcggctctatgagctcctcggttgggggaccgggcgaggagtcgcactgggtcggccgtggctaggggaggagcctgtggacatcgctttctccccccatttttccccttctaccctcgccagccgccgaagagagagagagagacagagagtaccgccggcgccggcgaggtggaaggcgacgagtcaccgttctccccggcaacaacatcggcgcctgcccgccactgtctcctcgttgcggcgcggacggcaccgctccaacccgatctagccgcggagggccagatccacccacgacagcgccggatctgccgctccggccggtgacggtgcgagacggggaggtcagcgacggtgcaaggcagggaagatggcaatggcgcgacgggcagcgacgtgggaaagagagggagagagaggcggcgacggccgacaagtagcacgagagagaggggcaaatatgaaagagagtgagagatagagtgagagagacggatggaggtaggggtaggaggggaaaaaagtctatgtggcttcttgggttgggatacccgttgcgggctggagtatctccatcaagtggcatcaaattttaaagaacccattaggggtatcctccattggaagatgagttccccagagaatacccttagttagtgagagcactctagaggtggcttcggttgtatatgccctaagtagtgtcactagtacaagcgttactactccaatgccaaaacaaagcatggaaggacaaacgctaagaggtaaagcgttaagcaatctgggacggagggatcggagtaacatttaacctcctcctcaacaaacggttgtacttgtctagctaccaaccacatgagatatcttaaaatcttagtacatagggctttgttcgactgcaattaatttcattgttgcgcaaccaacacaaatagtgttgtgtctgcagctgcatgcagcggctgtatcggccagtcgaacaggccctatattacctttggatgtgcatccaactgttactactcatcttctccaatcagcaaagctattgcaggggggagtctagtacgtgaacgttcgtgggaggtgaatctggcgatccgttttgataggttagcctttcttcgtactaaatcacgtgcctaatcatgatttgcatatattttatcgtttttgttataatcaaatctgtgaatgcttcgtcctttttttttctctaagtttgtttagattggactcttttttttaagaaaatattcactaaaatttctaattgcagatataatttatatatagaaagtttttatatataaagtctatatatatataaagagtttaaatacataaaaatttatatacataaagtctctatatataaaccttttatatgaaaaatctatatatatataaaagggtatcagaaagtctacctgtgaaaagttttcaaaaaatagttaacataaaagtttccgttaataagagtaagaaaatctgaaaaacaatcggcttgaaaaaaagaaaaagaaaaaccagttctcgtaaaagaggaaagagagaaaataaaaagaaaacttaatcacgtaaaagtgtaaacagataaacaaatacgcgtgtgaagaaatatcgatcccccacctgttcgcgagatcggctatccgcgaacgttcgccaactagctctttcggtttttctccaactagttgtcatccaattgccgaataggatttgacgattatccgttttatcaccttacatgtaaaatcatctatggaatggctaaatgtacttaacaaatagcgaaactatatatttataattcctctgtttggttttgactttgagttgtcttacgatcaggggtggatctaagaagaactgatatgagggtatgaacaaaatataaaaaactatatccctatcttataatgaatgtatgatagaaaattttagtgataacttaatgggggctccaatggatacaagggacctacggatccgtcactgcttatgatcaccaatatatttgaataatctatttaacatcaaaggtgtacgattaggttcataatctaaaatacattactagtatcttacattcaaatctattcgcattcacattgtcgatgagtgatcctctctagcgggagatcgtgagacccccctttcgtgagttcggctgggggaagaagctcgcctctagaaatcgcgtatccgtccccaaggctcctagctagctcgcacacaaccaaattatacaggtttgggccgctatgaagcgtaataccctactcctgtgtataggatttagactgagagttacaagggttcctaaactcgggagaacactcttacttccctcatccacaagctcagattttctgagagtcgtcccctttctcggtgggcaaggtcctccttttatacctcaaggggacaccacatgcaccgcctctacctactcttctttcgggtggggacccaccctatcttgactggaactcgacccgtgccttcgcctggaagctaaaccacagcttgtccttgagcggggcccagcgccgtccctcgcctgacacgggggacagccctgtcattccctcattaatagatgaagacttgtggtggccaccgtccgaatgaccctccgatgggacgggtcatacatacctccactccgccggaagcagatgcgacgtgggagcattgttgtccgtccagtcacacgtgaccggcgtcaggccggtcacagaccggtcattcttgaccatcgcgcgtcagtttagcacgccgcacgtctgccccactgcattaaatgcgacagagggcagttggggcgctgcgcgcattaaaggaagttcagtctaggccccttcctcgctgctccccccgccaaacggcggctgggtgagggcctcggggcaaagcagtgcaagggcccgaggggcatgacgtggcaccccgaggccccgaccccccgtccgctcctgcggttcgcggaatgcggggacaggaccaggctgtagggacacgtgacaggatgggaaggtagattcccctcagttcgcatacccccgggcccatatctccgacagtagcccccggcaccacatcggacattggcctcctgaggtcggtctgacgtggtgcctcacgacttccaccaggtatatcggaattgtttcactaagtggatcaaaaatatttcactcgtttaaattgggtgttgtttcaccttatataaaaacatgtttcaacaaatagcgaaagaatgtttcagttcactgcaacattagatctatacatagcgaaacattgtgagtacactaggtgaaacatttttcggtggaacaaaaaataaaccaaattcccttaatagggggtttccaaaatatgtgggtttttttttgcaatggaatgtttcgttcactgcaacattagatctatacataacgaaacatttttcggtggaacagaaaataaactaaattcccttaatagaggattttcaaaatatgtaggttttttttgttgcaatagaatgtttagattatttcagttcactgcaacataagatctatacatagtgaaacattgcaagtacacttggtgaaacatcttttgtgaaaaaatgggatagataagtggatgggtccagataaggagaggtgagcgcacgtatggggggagggggagcgaccgatttttcccacctcccccggtcgcccgattataatccatttcctattaatatctacgtttatactgtatttctcgtaaaaaaatcattgggcagccagccgtccatagaagagggacaacgaacactacctaaaattgctagccgtctgattgagaatcagggggcaagatcggcatgacaagagagacagcgacccatcatcattagcacgcaattaatggttagatgatccgaacccggagttccagacgctgctgtcgtgtccttccaaccttgaggcatggccccaccaccacgtcactagtgacgacgacccaccccctttccttcctccctttaccagttttgcaatttcctccctcccctaagaacgaatacaataacagactataacctagctataaacacattctaaataaataaaaaaatagatagaagagccagtaagatcgctgcagcacatattacaagatacatagatgtatgataggtgggaccaaatattaattgtgtactactccctctattccataatataatacacaaccacttttcttaaatgttccataatataatacatgcatgcaagcatgcaattaactatgacatcttttttcattaaattatcttttttaaatcatccactctcatattatctaattctattggatacatgcattatatttatgaggatgatctaaactacaagatgataatcattatttcttgttctttaggttaagggtggttgtgccttatattttataatagagaaagtatatgtttctaggtacctatgatatgaattggctattagattaattaaatataatttgaagccaatagttgtttatactattaaacttgctctaaacccggtccagaaaagacggcatgaaatccctatcctgacggatcattatccccgggctgacggccacgtgtccctccaaatttaggcgggcgaggtggagggagaggagaggaggcgaagcggccggaaggaaaggaaagccgaaagtttttgttgctctcgattcgattgactggacgcccggctacggcctcccgcggtccccgcctcgcgttttggggagggcagtttcgcccatccgcgtgccccttgcttggttgtgtttccgtgtttccgtatttgcccctcagcgtccgtttgattcctctatgctctgctgctctgctctgatctgctgggatctgccgttctgctctgctttgccgcagccagagcagggttagtactggagtggagtggcgtgcagtgtgctactgtactgacagccagtgctatgagtaccattcattttcgtgccgtttcgttcctattcataatttaaatatatactataatgtatattcctaatactccatcctttctaaaataactcaacctagatggggtataatgaatctggattaccctttatccagatttgttgtaataggatgtgccagatctatttaaaatctcttatattataggacggatggagtactagatatgtaaaacatgtttgaaagagtttaaaactatgagaatatactggttgataattagattttgagaatctaaagaagttaagttttcccggttctggcttgtaatttatttcctaggttatacaactatatatttttagaatttgggtcacaccttgaattgttaatggagttgaagactatgtggaaatttatagtagctgctaaaaactttcccaaacaggtccgcgatactaatctcatggcttcggctttcaaattctaatactatggtatgtcacattttgtattatatttttttttactaaggtagagtttgataattgtgctactccctatactagggatataatacctctatctcacaatataacaatctaaattatgacgagaaactatataatataacgaatatgtactccctccgtcctataatataagggattttgaatttttggttgcactgtttgaccactcatcttattcaaaaaatttatgcaaatataaaaaacaaaaaatgtgcttaaattactttggataataaagtaagtcacaaataaaataaataataattctagctttttttaataagacgaatggtcaaacagtacaagtaaaaatcaaaatcgcttatattataggacggagggagtatattatattatactaaagagtagtatagtagtgagaaaaaaaaaagagtagtattggcttggggtgttgccacgtcatcacctggtggcccaacatagcattatctaaccggatctactactgtactggtggaatagttcaaaccgaggggaggggcattccgggaatttcggcgacacgaggacacgccgatttccccgcggaccctctcctccgaaaaccaggggcctgaaatgaccatcgtacccccaagcctttattccctcccatttctcccgctcactttccggaaagtaccccctcggcccgtcgaacccaacccaacccaaccacccacccaacaacgcttaaccctggttagcgctctgccacgaccctgacgagcccatcccgccgcgagccacctacacccgttccaccatacgccggaggctgaccggtgggcccggaattcattgcagagcgctggtgttcaaggacccggcgtacggggccaggcttcccctcgaaggaatcgaccccatcaccttcctcctctttatctcgtagccgccgccgccgcaaaccctaacccgagttccgatctggttcgacgacgacgacggcggcggcgagggaggaaggcagatctgaggagatccgacggcgggggagaagggggagatggtggtgaacagccggccgctgaagagggcgaggacgcgggtggaggccagggacttcgctgggttcccgccggcgggggacggcggggctgccgggacgttccgggaggcggtgagggggttcctcgcgaggtacgcgcggctgctgcctctcccctctatcttctcgccggcggccgccgcggcaccgccgcatctgttgacgtggagggtgtcgctgcgggtcggcgaggagggggacgaggagggcggcggcggcgccgtggagctcaacgtcgttgaggaggatgtgctccgatcgcgatctgtgtattgtgaccagtgcagagtcgtgggtgagtagctttcctctccttttatttttctttgtcttttctttttgggttttcttggaaaaacatttcccccgatggaaaatattattttattattttgcctttatttttttgtgtgatgattgctggataatgtctttcttatagagtattactttagttttttttagcgagttcggaatgcaacttttcttcgaaaaatgttacagaataaatgttgtgaatttttttttgggaaataacggggtgaaaggggcaaatgacgccgtgtctgtttccaacagcaatttctcttgaatcttctcgcccccttctgtgactgttagcctatgcaagtattgttggcctgttgcttttgatgtacaatttccacatttgattgctgtcacaatccttttgcaaaagagaagaaaaaaattcaatcctacagaagcagtgatgtaatcttgcgcgatgccatttgtttggttgcaggatggagtggtcacccggtctgtgggaagcggtaccatttcatcatcgagaacgacaacaaccaggtgtgcggcaagcgccacagctgctgcctccgctgcgggactcccacagtcgctggagaatcaaggtgggaagaacaagcaccgttagtttcagagaagataaatatagtcaactgtaacaccacgattggtttcgggcggaaggatgataatgtgcctagtttatttcatatcgtggtgtagttgtcgagttgttcttatcgtgcctagatgcaaagattaaacttgtgagagatttggtgatcgaatgatgctgccctatgctaattgtggttcgtgctaactttggatgcaatgttttccagatgcctcctatgcaactttgatatggatggcgaggagctggaggagtgcgggtacatgcatctggacgacaacacccacctgctgcacgctgtggtgcatgcaaatggttatggccaccttctgagggtaaatggccgtgaaggtggctcaagatgtctcacgggccgtgacataatgagtttctgggatcgcttgtgcaaggtgctacatgtgaggtataaattgatcgatatgttttggttcatgtgtcgttcctacaaaaagagggttattcagcatgccataaccctgaaaatttcactaacctcactgcaggaaagtaactgtcatggacatatccaagaagcatggaatggaatacaggcttctgcatgccatcacaagtggccatccttggtatggtgaatggggatacaagtttggcgctggtagctttgcactaacctcagatacttaccaagaggcagtggatacgctttccggtatacaactcgcgttgtacttctcacatcgccagcccattcggacccctctgcagaacacgattgctctgtactgggcactctctgatcgccagcttgtgactgttcgggacctcttccggttcataatgcacctgcttcatcaagcacgcaagaagaacgagacatcaaaacccacaactgatgaacacaaagaagttgcatctaatgtgctctgcaagtggacaaaggaagatattgatcgggcagaaactgcaatgctcaaggtcctacgggttgttcagcctggacagtgggtatcatggcgtgcacttcggggagctgcatcgaaggctgttgattcacaggagctacttgactattctcttcgaggactgggtggaaaactgatggacgatggccatttcatagctgtccgctgcaatgctgagacgagtgcaattgaatacaggtgagccctatgttcagaatgttgctcctatttggctaactttgttataaactatcatgaccctcctcctatatctgctgacaagcaggctggaagataactccaaccagtcagttgatgcggctgcgtttgggccttctgttgatcatcttctgcacgatctgaagttcctctataacgctttgctgaacccagaaaccatgttggcttcacagccagaggttataggtgcatcatcacacagtgcagcagcaaagattctcgactgcaagcagttcatcaaacattacgatcagcacaccccacgggctcctttgaacccattcctactttctgtgaggtgttccattgaacttcttgatcacccaaaagactacactgcaccaccggtggaactagtgcttttaccagcaagtgctacccttgctgaactgaaaatacaggctacaagggcctttcaagaaacatacctcatgttccaaagctaccaggttgaacagctccctgacttcccaaattttagtgacacaaccctcgtgaagcatgtgcttggctcaagccagctcgtgagggtaagaggaaggtgcactggggataaccgaagaattgtgcaattcaggatggaaagggggttggagaactggacggtcgactgcacctgtggagccaaggacgatgatggcgagaggatgcttgcatgtgatgtttgtggagtttggcaacacaccaggtgttcagggattagtgattttgatgatgtccctgagaagttcatctgcaggaagtgtgctagtccacgcagagaaangggtcgtgtgggtgnaggtgcaatgtggggtagcagaatgaatgtgagcgctgcaggnaggtgcnaagnattagatagantcatctgttgncggtgcaggcaattttgggcgcatggcacntgttgnatgactgtacataatgtgtgaaatgtaaatactganggaagagtggggagtagcacctgaggcctgtgtgaaccttcatggaatcttgtctttctgaccagtgatatgatgttaatctatcctccttggaagcaatcctttctcagaattgttcagcacgctcaattctgcatgcacaatcaagtatttttgccaagcttttaagttagaaatataacacaagtcaacaaaacgtacgtaatgatggatcaatatgagaatatatgtcagtgacaaaactaggcttctgggcgttacatttcctctagaatattgctatcaggatatatgcaaatgcagaaatggctaacagtaagcagatgaacaagcagcatcgcaaaaaagggataggaatgatctattatcacttgaagattatactaaacgagtagagcttccgaacgcacctgcaatacaaaaatgaggaaggcttagtagcacatgtttgttagggtagtttgctaaagacttactgcaaaattttcataacatgattgttaggcagttaactggtcaaaactggcttgcaaattttctttacccattcaagtgcagcataaagagggtgggatgaaagatgacaatcttgaaatgaataataagatatctaacgaacactcattaaattcttccaggcttccatgtcgtggctttacactatgaaaggcagccatatagtagaaagtggtgtcctgcaattttaacacagaagttccgttgatcagatcaactagatgcagcataagggagggcaggatacatcgagcatgaaacatttaataagagtcatgaaaggtgaacccttttccaggtaacaattgggatgttaaattcgagaaaactacttatggtgaacaagagcaacctttagtagttcgaaattcaacagagccagtgatgttagtcctagttcaaggcatccgatgtacacattttttttgtgttagaaatatggattcgcagcaccagtctgcaatgtttgcaaacctaatgctggtttgtataacttattccagtaagctggtaagtgatggacatatctaaaacatatttcagttagcactaccgtaattacccatgcacccatgcgttcgatactaaagaattgctgagctagttagtggcacgaaaaacaaagcatgtgattagcacataattaatcaagtcttaactatcataacttgaaaaataaatttatcttgttttttcaaaaattatatatatatatatatatatatatatatatatataattttttgcacgaaacagataatttggcacttcaggtagtgtgcccatgataactgatgaagtagcctagcctgtatgctagaaagaacgcaacctaaaatgtctaaaagcataggatgttacaattctgcaagagtaaggtgactttgtgattcattctttctcagtgttaggtccttactgcataaaacagtgatattatgcatatactacagcactttgcacactcctagtcctatatcttaaacataaagaaaagtagagctaacgagtgtagggagcagtgtacataagaataggccaaaaggcattcaggcctaaaccctattgaaccaagaatgtgtaatcaatcacactcagaattgtcaccagctatttatctaaaattatcacccaaacatgatagaatatgttcacattgagttacggatagatcattgaccgctaatttcaccagttatccattaggttgagcaaggtaacagaataatggcacagatgcataatatgatgttacaaggagtatatgacattttatacatggaactttcaaaagcgactatcacttatttgcagtttatgaggcttaataaaagcaaggatctttgataaccagttaggattataaactaagttgattaacctgtattgggaatttggcatgccaattttcacttcagcattgtccatcaaattcctaggaaggatttatgaactctacttagcacaactagcattttagttaaacagagagtcaatgggttaaatacagaagtttttcagtgttaggtctttatccctaggtatgatctatgactccacttgtttactaccagacacttctataattatcatgatcacacaattgctcttcacccgttgagccatgaatgaaaaaccttagacaaggttagattgccaaataagaccatattaactacatcaagcattgagagatttttaaaccaatgaataccaaactcaaaccctgtgaattaacacttgatcaaactactaccacattattcaataagatgtggtctgacatagcaatacaaggatctcaaaactaccaaaacaagcaggttcaccaaaaaatgaatacagattacctgaacagagctgctgcctgctggccttacacctaacaagtaacgagaatatgaggcatcacctttccagcacctatcttagcacataagacacgaaagtagaaaggtttagatcctaagaaaatatgaaccatgtaaaataaatgtaatcacgatttaagtatacagactagtataagaacttctaatccagccaaagtataaactgtataatcatcaatcaagtatgcaataccgatccaacaagcatcaaatcccatagtttgatcagaaaaacaaaattttgaactctaggccaaaatgtgctgctaaataacgctcatttgattaattgaagcaccataaattcaatacgcagaaatcagagggaacccagaggtagactgccaaactgagtgcagtataaacaaattcagctctgacgactaatcgcaaaatggaccgaggtaccaagcaaaaaatctagccacaacgaagcaccagtaacgtaaaaatcacgtaagcatcagagaatttgaaagatcagacgttctagccacgccgccaatcggaatcccagcgaacggagccagccaaatgcatgatatcagcacaaaccaaaacagaaacaatcgcgcattggatccgaacaaatcatggaaccctcgacttacttactatgccctagccacaggacgcaaatagagaggggaaaacatgggttacgcttaaaccagttcatgaggtcaatacataagtcgtagcgcaaatccaaaccgcgaacaaaccctaacacggatcgaaacgaagcattaagcgcgaataagatgaattcccaatccgcagcgcaaagtccaatcgcagcgaacacaggggagacacccaaatttccacaagcgcacaaccctataacaactaaaaaaaagcgacaaatcgaagtcaaatcaaacgcgaattcgcaaccccatcaccgaaaaatgctagagggggagggcggctacgctcaagcatagcacgactcaaatgatcgaacaaacgaagcgcgccgagcaaacccaaaattccgaccccaatcgagcatcccagcccaaaaatcccaaaccctaagcagcaccatctccaccgcatcaacaaccagaaacgcgaaagcacagaacccctaacccaccaatcagagcacataatcaccaaacgaaccaaaaacctaaccaccgacctggccgcaatgttgcgagctcgaagcaggcagctgaacaaaccaaaaaaaatcccccccaccgccacgggctccgcatcgcgcgccccccagcagcttcatcggatcgagcgaggcgtgggaggcacgccccctccgcgaggcggaaagcacccgggaggatggcgtcgctcatccgcctctcctcgcggtggagataccagcagctcgaggaggggggaaggagcggtgcgaagagagaggagagaagagagggggagaagggggcgaaggaaagggggtcgcgcggtcgcggcgaaccgaaccgcggtttggcgactcggatgcaagccgcgggcacgcacaccggtaggtattgtggttagggttctcgcgtggcggccgtgtggctgcgccgtggggcccgcaggtatctctctcttcttctctttttttttttgcccttttaccgcgcccttttcggtgccctggactggtcagcgccgactcgcgtcagagtccgtcccgggttgcgcaacgcaaaaaggccaggctttgtgtgactcgtcaacgcgagcggctacgatttcacatttcgctagctgaaacacggggcgttatcttcccacatttgggtggtcgttacgcatcgttgtaaaggaatggagttttgcctcttccgtagcctgcacagtgcatgtacgcatggcaaacgcaatgcgtagttgctataacttggtagcgtgttttattcgtgcatgcatgcgaagaacggaacaagtcaataataatggctttccacccggccgggggcaaagaactgaataaccatctggttcgattcatcgtgtgtactgtactgcatccaagcgtcaggagagttcttcagccttaccgtgaagtgtagtaactcatctcaattctcaacagcattactactgtactagtatctctccacagatgagtccatcttatcctgaacttctgcaatcttgggctcttctgttctgctctttgcaaacgacgattttttgccatggggaagaagggagcggccaaggagccgcgcgcacgggcgtgctgttttcagggaccatggcgcgagaatgaggacatgtgccggtggggaattctcctcactctgcaatctgcatccacccttgctgaaaagtggaaaaaaaaaaggcatcacctttttgccgcttatatatctcatcagtgcccggtgaatcacaagcttgtcatagaaaattagaaatatagtacaaatttgcaattcgtgctctctaggtctcgttaagcttgtatagcacctagatcgagtaactgagtagtaggttctccaggtacagggaaagatggcaaattgcctgcttcgtgatggtcgctctcgaccacggcgttctttctctctggtctcatttgcaatcttgtctacccaacaaatagcttagatgtgatgtttacttttgctttaacttttggaaatgctgagtgcatgtatagtagctagtgcagtacttatgataatggtgtctgttttgacatgtcgccactgttattgctttcagaagcagtgtcgttttcatcacgtgtcaggttcaagagcggagcccccacccactggaatcaattgtgagctgataattttccttcagcgactgtcctttgtaggagtaagatcagagaacagccaccagctactgcagggcctgggtcacgttcaaaagcgctaggtgccaactagctagcttagaacaggtgacgcggtgaagaatcaaaagtgatgaagcggaaacatcactataagcaagtcagatccaaaattgctcggtgctcactcatgcagtattgctgtcaatacgatgtttctttgtttcttcctcctcctttctctcctttcccttgctatgaacacaagcaatacgttttatcttgagttcacctgcgttccaatttgcacccccacacttgtctttcttgcctatgctaacgtgttggaatcgtaatgtcatatcttgcggaattataatacttctgtagaacaagtgttgatgaggcatggcctttaactgagtgcatatacatggttagcaaacaggtctgattatttcatgtttcgatcttaattgttcaacacagatgtactacctctgtcccaaaataagtacagccatagatatccgtgtttaacgttttaaccgtccatcttatttgaaatttttatgattttttttttaaaaatagtcacacgtaaagtaatactcatgttttatcatggaataacaataaaaatactaatcataattttttttaaataagacgaacggtcaaacgttagatatgaaccgtgctaaaactgtatttattttgggactggtggagtactaaatcaccgtgccaatcacgaaactacctttgtttgtctgcaaaaggacatgatatgggcttacacgagtttacatgctgtaattattttcctgtcgaactggcgaattgcaatttaataacgagcatttaacaggtctggaaccactgcacatctcatcaagagagagcagagtgtatatatatatacatggaacgcaaaccgtcagtgccagctcttgctctcctcgtcctcttctccttcgctaggggcctagggctgatcttgacgccgacttgctgagcggccgactccggcgaggcaaccctgccaaggtcaccgacactcgtccgagctttcatttcatttgccggtaggtgacaaccatcactctgttcgggccagagagcctcgcgttcgacggcggccgcagtgggcccgtacacccagcgtctccgacgagtcgtattatcctcaagtggggcggcgtcgtcgccggctggaccacctccgcttacagcggcaactaccggtgtacgtgcttccgctccaatacgtgcgtacgaacagacaggtcannnnnnnnnnnnnnnnnnnnnnntgaactccgtgctggtcctccaagaacccagtatgcaacttgtaacggagagcatgtgcaggaggcctctggcccttcggtcccatttgaaatccggcgacctctacatcgccgattcgtatgccgttcatgctcgtcaatggcgtcgtcgacggtcgacatcgaccaggtcactaccgcgatgtctacttcacaaacagcagcagcacacggagtatctaatttgatttgattcgtagggttgtatgtcagttagtcgtcgaaagtaacgcgtacgtgcattgaacacgagcgatcacgacggggcggctactgaagtttcgaatgggacttggaggctgtacagagcaacggagacacggagtatgtctcttgttaattttatcactgtaaaatgtgtggcatgactaagggtgagtttgaggaggaggagattgagaagatacgcaaaacgaggtgagccattagcgcatgattaattgagtattaactattttaaatttgaaaaatagattaatatgaatttttaaagcaacattcctatagaaaatttttgcaaaaaatacatcgtttagtagtttaggaagcgtacgcgcggaaatcgaaacaaactcactcactttctttagctgccgaacgcagcctaaatgtttacataagaaaacctctcacgcttgacctgaggaatgaaaatgatcatatcattcctcgcaccattttactgtgcagttaattcaagagtggaaaaccatggaagagttaggccaatgttggctactccagtttgaaattagttgacgttttagctcttgaagcattgtgtgatatttcttgacgttttagcttttttgttgcatcttggacctgcttgcccatgcatgcatgcagccggccattactactcccattatttccaacgtcatgcatgctttgccttctcgtttcctgttcaaccattgctctcccacgcgctgagtaatttccttcttctatgcctgcttgttggctctttgccttctactcgcctccttgtactacattcgccattttcgccatggagcaggtcatggcttcatgttcaagttcatgttaaacagatggagtatgtagggagttggagcgtcaaactagctagtattgcacagcataaatagatggagatggcaaaggggattctgctgcaaaccagcgccaaaatttgagttattggcggcaaacgcacttggcaaaatttttgttagcagcgcgcgagtgaaaaatctttcccggcgactgcgcgcatgaacgcctgaaaaaaagtgcatgcatgccaacagtcacgcgtccacagtgccatgcaaaaaaatgtggccaccaagaatcgaactcaggactggtagcttcacttttgcatgagatggccactcaaaccaagagcaggttatgatttggtatgcctcaaaaccatatttattaggggtaaaacaggaagtaggcatactaattaatcactcattggtatgtgtaatcctgtctaaaacgtcaacaagtatgggctaaataagctttagtcactcctatccttacaagtgaggccttctttgtttgccaaggcccatcctaacgggacaggaaatttgggctaaaattgacccatttgtaaagatgggccaggatttctgccttcagaaaaaggaataaggttaccggaggtccctcaacttaacaacgagattttttgagatcccttaactacaaaatcataaatgtgtacccctaaactttctcaaaccgttcaccggaggtccctcggcagtatttttgcccggttttgctgacgtggcatcctagtcagcaaaaaaaaattaaaaaattgcgtggggcccacatgtcagctgcacatcttttttttttctcttttgttcttctcctcttctctcttctctcttcagcgagtgcggcagtcacaggcggagcggcgtgatggggttctcctccgtggaggtgacgagcacggccgcggctgtgacggcaggttcccagacccggagccagcgcgttcagccggagcagcggctgctacaccgacgccgcattctccggcgcgcgctcctcgccaccgcccagatgctgctgctgcgcctgcgtcgttgttgggctcaccgtcagcttctccttgatcgctcccgtcaataaaaatgtggacatcattattgattgctaggagcactacgtgcttgcagacggcgaacgacacgacggcgccggcgaagcccgccggggccgggccgcagctgaagctgctggtggacaagcgctcgcgtcgcgtgctttacgcgaaggcgcgcaaggacgcggtggacttcctcatcggcctcctccgcgttcgtctcgttcgtcgaggccgacgccgacatctcgctggaggagttcggtgactcgctgtgcccgccgatcccttgcaccggcgaactcttgaccctgccggatagcaacttcgccgtcgtcaccgaccggccactactctacgtgcaggtacgtacgtcgtcataaaacttgaataaactttgcaaattttgcaccatttgtattgtacgtgatttacgtgttcatgatgccatgcatgtaggtgacgaggctgaggtgtggcggcttcgtgttcagcacccagatctgccacaacctcgtcgacgcggcggggatcacgcaattcttgcaggccgtcggtgagctcgtggaaggcgcggagcgtccggccggtgtgagtgagggagcccctcgacacgcgccacccaccgtgtccggcgtacgaccaccccgagtacgagccggtgtccgatgaggccagcgacaagctccgtccaggcgatgagctcgttcaccgcaggttcctctccggccccgacgacgtcgccgcgttgcgcgaccagctccccacgcgcctcagccccggtgctcgcgtttccttctcctcgagtccccgggcccagaccgccgcctacagccgccgacgccgcccttccgcttgctccggccgcgggccgccgcccgctgccgctcgcctgccgcttgccaccgctgcagtcgcgctctcccactgaccgccgcccctccacctgctccagccgcgctcgcccgctacttgccgcgtcggcgtcggcaaccgctggctccgggtctgggaaccttctgtcgccactgcggccgtgctcgtcgcctccacggaggagaaccccgtcacgccgctccgtctgtggctgccacgcttgctgaagagagaatcagagaagagagtacagaaggagaagaaaagaaaagggaaaaaaagtgcagctgacatgtgggccccacgtaattttttattttttttctgactaggatgccacgtcagcaaaaccaagcaaaaatactgccaagagaccttcggtgaatggtttgagagagtttagggggtacacatttctggttttctagttaagggaccttagaaaatctcgctgttcagttgagggacctccggtgaccctattcctcagaaaaatgcttaattttggggaaacatgttttgatcaaggtttagcatcttaaatagcctacctaaattaggctctccaaacatctccacctcttcgatctctgctattataaaaactagcatggtggcccgcgcagattgcgcggctagcataattatattttctctcatataatagcatatatgttttctcattatattattaaaatatattacaatgacaacataattttaaattttgcaataactttacgaaactactaatgtgtaatattcatattgtattttatatacgtgttagttattaattatttttaatatcaaattttagttatttataaattatatatattcctatatggactctagactcgtcttttaatatttctttttttaattctgaacttttattatttctaattgtatttctatgtggactctaaactcatctttcaatattctttaatttttaatttcaaatttcagttacttctaaattgtattcctatattgactttaaactcttctttcttcttcctatgtttttcttaatttcgaattttagttatttgtaaattgtatttttatacggactctaaactctacttttaattttatcacgtttattctgaattttagttagtttcaaattcctatatggactctataatctacttctaatattcattattttttaatttcaaatttctatttttttcgtaattgtatttctatatggactctacttctaatatttcttatttttaattctgaatttcaactatttctaaattgtatttctatatggagtctagtctcatcttctaatgtttcttatattttaattccgaatttcagctattgctaaattgtatttctatatgtactctgcttttttctttttctccaattaatgtgagaatttcttgatcatgagagcgaacgcggaggctcctttttattccaaattttagttagtttttaaattcctatatggactctatactctacttctaatattccttatttttttaattccgaatttctatttttttcttaattgtatttctatatggactctatactctacttctaatattccctgtttttaattccgaatttctattatttcctaattgtatttctacatgtactctatactctacttctaatattccttatttttaattccgaatttcagttatttcctaattgtatttctatatggactctagtctcctcttctaatattccttattttttaattgcgaattccagctatttcataattgtatttctatatggactctagtctcctcttctaatattccttattttttaattccgaatttcagatatttcctaattgtatttctatatggactctatactctacttctaatattccttatttttaattacaactttaagttatttcctaattgtatttctatatggactctagtctcctcttctaaattctttattttttaattccgaattttaactatttctaaattgtatttctatatggactctagtctcctcttctaatattcattattttttaattctgaatttcagctatttctaaatgtatttctatatggactctgctttttctttttctccgattaatgtgagaatttctaggccatgagagcgaacgtggaggctcctttttctattcctttaataatataataatagattgaagatgtttccgctaatactttggtatgttgttcgtatttgagtctgtttttaagtccgtttactattggaaatatataaagagtcgtatacgaaattattttagaaacttgcatattaacttgggacgagagatggactcctaattgcttcaaaatccatgccagaccataagaaaacaacatacagggtatggccatcatccccataaaagttccaaattagatattgtcgagggaagatcctcgatagcggggaatcatgagaccccctatcgtgagttcggccgggggcagaggctcgcttcttggaaatcactcgctcgtccctaagattaccggcaagctcgcacgccgtcggattatacaggttcgggccgttatggagcgtaacaccctactcctgtgtttgggattatggatgagttttacagaggtttcttcactccagagagcgcactcgctttctttcttctggagttcaggttttctgggagtcgtccccttatctcagtgggcagggtcctccttttatagctcaaggggataccacatgcgccgcctctacctaccctccataggagggggatcccactccacttttttctgggcttcaaactgtgccttctcccggaagctaagcaacaaccggttctcgagtggaacccggtgccgccccccgcctgacacgggggacagccctgtcattccctcataaatgagtgatgacttgcgacagcccttcctcgagtgacgctcggatgtgacgggtcataccaacccccacttcgccgggtacaggggcgacgtgaggacatgattgccctatccatcggatgtgacggtaacaggccggtcacacactggtcacatccgatggacaggagtcagctaggcgcgctgcacgtctgccctaaccgcattaaatgcggtgagggacagttggggcgtcgcacatttatggctgttcagcctgtgctcccctctcgctctctccctccgccgcgtggcagccgggtgagggtctcagggcgaagccgcgggagagcccgagggggtgacgccatgccccgaggcgccccccccccccgccgctttcatgactcgcgtgacgcgtgagtggggccaacttgcagagtcacgtggccggagggaaggtaattcccctctacttcacatacccccgggcccatatctccgacagatatcaatactatcaaaaataaaattcccatatacttgttagacaaaaaatctaacaataatatgattaaaatagcattcacctgttgcaacgtacaggtattttttctagttaatataaaaagtcacactgattgcttactccgacaacctctctatttaaccttctttaaaataacaacgggacccgtatgtcagcccctgctcctcctcttatttctctcttccttcctctctgttgcccaacaaacgaacatcatgaggagccgatgcggaggcagcacggggaggggccgaaggcgggacggcggtggaaataggcgatgggagtcctcttgcacagactgcagcacgacaagccactcaatgtcgtggatgacgtcattggggcgcactatcgtagtcgatgaaggcgggtggcactggagagtgcaagatagacggacagcaccacaggtgaagcgggaggcactggggaggggccgatggggaaagtggatgggtggcaggatccgcttagttagcaatgatggctcgggaggtggtgttagcaacgacggtggtgctaggtagaggcgacaaccgcaggagcagcgggacaaggtgttatagtgtcatggtgacgaaaaacaagcaacgatgatcttgtctttggatagtggcgacacttacctcggacagacaacaatgcatcgacggatggtggccttccagacgacgcagaaatggtgatggtgcacaaccatgggcaccgacgcttgtggggagtgcatggatgggagagagatgggggaaaccggcgcaagcccattttcggcaagccaacttgactgtcaagtttggcgagcagactagtttggttagctggatggcttggcaagtcagttggataggttgttggatcacaattttttcgctagaattgtgaaattttagcttgaagagttatttggagtggctctttgagtatctctaatagtcctaattttgactcttaataatgtttgattggagccataaaaattattaagccacatgcatgttgtaaagtccaatggaacccatcaaagatctagctagctcacgtgaggcaaatacacaggcaacaccgtcccatgttcttgtcaacgaaatcaagtcttatttactccaaacgatgaacatgacaaaacagaaagaccaaaaaggggaagcaagaactacaagtacaactttgatctcaacgtgtcaatcagaacccaagaagcttcttgcacgccttgaagatccgccctttcttcttcgtgatcttctccttctttcccgtcgcatgatcctgctcttccctccgtttttgctccccatcctggaacgccgcctgctcctgatgctcgccagccgcgtcgtcgccgtccatgtcgtcgtggatcctccagtacccatccgcgaagctggacggctgcctcctcatggagaacgccctccgcaccacggcctgcaggccaccgccgttgccaccggccgtcgacctgctcctctccacgggcctgaacctctgggaggctgacgagaagttcctcaccagcgtcgccgccccgacggccacgccttcccatttggtctcggcctccacggcgccgctggccaccggaggcgacgaggtgaggttgcagtatccattcaccatctctccaccctcctgtgtacaccaactcaccaagtgatgtgttgctgtgcgctagctagctagctagctgctgatatgggaggatttgggcgtggttcgtggagttgttcgccgcgggggccgggggtgtcacgtttggattttgcaagcgtgctgcgtgtgagaagtggagttgatgaggctggatgcgatcgagatggtgcgtgcgcgcgcggtggcgtcgggagcggcagtagtggaagacctgacgcaggggagcgtggtgaggcgagggagtaggaatcaagccgatcgatcaccgactgtttctgtctgcgagtggcggaaaacggtggccgtgacgagatcacgcgatcaaaccacggaacgcgaaatcatgagccgttgagtggtgggtgggtgggacagtgggacagtggaattgaagcgtccagttttgactgccacgccgcacggcaagcacggtttggctccaggaaaatgtgggttgtggaaatggatttgtagtcacgagagaacgggacgaaattccgtgcaggaaattatcggcccaacacaaatcgcatggaatgtttgcatcggtccatttgtccatgcatatatgttggggaagcagcgaagccttctaggcccgtgtacctgtggttgttccaagtacatgtcaagttatgtagcactactaactggtatagtattcgtacttctggctaatggcatgtatgtttaaatcttgcccatattttatttcggagttactaaaaatatggcgccacatgctatagtcgatttttttagccacttacacagtagttacacctcatttacaccccacttacatatgtaattagtatataattttcgaatttacatatgtaattttagtacttacatatgtaattttgagacttacattgtaaatacactaaaattacatatataatttagggacttacaatgtaaatacatgccgactattttttgatgaaaaatatagcgccataaatatagctatacccttttattttggattttccaggactaatccggcaatgctacgtatcaggccacagatgcgctgagtaattcatgtttcagtccatgtattcagatgttttattagttgaatcgaaatattgcaatgaatttttggtggtgtttcgtttattttcttcaatgtatttggatctgttgatgtttcaatacattttgaaaccgatgtttcatatgttgtagtaaaatgtttcaagagtgtttcggttctgtttcaccatttcaatagttgaaaacattcttttattaggtactgaaacattttggtaaaacaacaccctatatgttagaaaaatatcatactccgatttgtagtcgcataaggattaatcccgtgctttgtttagaatgtgggagttacccctattgttttggaaatttaattattattttcgtaaattcactgttcttttaaacagaagtgagctttgctgcttaactttattcaattatactagccataccattaaaaaaattttggagcacacattgtgaatctcaagcctcttggaccatgcatccagctttgattgactacaactcagtgttgacatgggaggtgacaccgggcgcaaatttctcatctgaattccagccatgtccgacgggcagggcacaccgaaccgttcttcctcctctttgccgctgccaaccggtagacagttatggcttcatcgctctcaacctcaagtcctcaaccccaagcggacgagtcacatggcgtgcttgtgatgcagcgtctttccttttcatggcggcagctttcgcatgcagagagcggcaaactcgaaggaggcagttgggccgtcccctcaaagatccacttgattgtgtactgcacgaattcaccggtgatgagaccattgcctgctatggcgatcgaaaaactacacgatctcgacacacctgcgagtgccatgcattgcaagcatacgacgcgtacgagcaagaaccacgggcatgcaaggcgagctactaccagcgacaaacgaggacaagacaagacgcccatatctatatccaacaactcttgtcactctcccctgcgtttattatttacagcgtctccgctatacagcaattcaatcagcaacaggattcgatccatcgatcgatcggtcggttggttggtttgacagcgtgtgtctctaacatgttgttccactgcaacattgtacgcgagatctcgatcatggcggcatgtaggagtggtggacgtcgtggtcgtgcggcggccagtgcaccccttccctcgggcacggcgccggcggaagcggcgccggctgcgccaggtacgtcgggtaccgttgccccggcatcaacaccgacaggtccgccgcctgcagcaccgtctccacctgcaacaatttcagagcagcaaacacctcaacattggatcatttcgctctgtgtaagtggttggcgacgtactacgtaccatgggagggctccggagcttgccggcgggagagacaccgtggcggcggcgcgcggggcggagcgccgcgctggcgaggggcgggaagacgtggggcttgatgaggtgctcgaagatggccatgaggaggaacatggagacgaggatggcggtggccgcgaacccgaacgagatggcgtccatcgacgtgccgaaggtcctgagcgacgtcgacgcctcgccgcccgcgtccgccgttgcggcgacgaccggcggctgcggaggcgccggcgacgggtcccctggccacggcctcgaccttccgctcattgcttgcctgcctcggccgcttcttggcctcttgcaggttgcaaccagcacgtctcctccctgcacgccatgtatatatgcatgtgttcgtcgtcaagaaactgtgtcgaattcaagggctacaattcaacgttgacttcttttgaactgtaatctatctacttcatgcatgacagatggatgactcatgaggaatcaagaatcacatgagaacaggttggtgagctgtgtactacacttgcacaccggtacacacacagcaactttatttcagcatcttcactagtaggaaagctgaaaagcaaatgcaaaagggaggagaaacaacaggagaggaggaacagaagaaaaacagttccaaaacagctcatttagaggcatcgaacatgcacattgcaggcaaaagaggatacacaacacaccttcagagttcagattagcaccggcaccctgcaaattgtcctccctgaattgaatgcagaaactagcaaccgtcttgatgtgcctctcctgatggaatcatggcttcatgggacctattgccgaatgccaagaacgggagaacacacaggaggatatctcagcttggctgcctctacttaaagacagtccccgaatcaaaagtgagatctcagctgatttggtggtggcaatgtggagagaggagaagaaaactacaggaaaaagcttggagtaacaaaaaggagtgctgcaagaaaggctgccacacttggcactcctatagaaataaactaggagatggatgatgataggggagtcttcaacagttgatgggaatggaaggctgcaagattggtacaaaaaataatcttggaatcatgtttgggcacatcaaaagagtggctccccactcccatgcaagcacactcacacagtaatagcagcccacatgatcctccaaagagcgtttagtgcagtgctgtgaagtgtagggaatgattcaaagaggctatgttagccaaggccaagccaaagggaaaagcaaaagaaatgggcaaatgcaaggagggaaaaagcagcgctcgtggaaaggagggaagttttgtgtggcctttgtgcagggaccaatcaacctctgatgggcatcatgctgcaatgtcagttaactggctgctcacaagaagtttactcttttctagtacaacaccctcacatgcgatgtgatgtagtatgtgtgcttgctctcgattatcaggattagcaatgcaagcttaattacgctgttaagcatgtgtataaaagaaaaagactgaaactgcaactctcttttgcttgcaagggagtattcttctgtttgttgtgacggggaagaagaaagatgcttatgtcatggctaagcgagtgactgtagaggatgcgagacccctactgccggacggctgtggatcatctgtgcccacacgatgtaagatatttgtacgaacacgacatgccgttgcctgtccatatatgctcgtctgtctaaaatatatgtgctgatcgacagtgtggtgataaagagatatagcgtgagacaagccattttgttcccttttgtacgcttcattgtgtacagataactgattgagaaatggtttgtttgtttcagaaaaaaaaagggtgagcttctcttcacacactaaagaagaaaaaaaaatcatgatttacagtcaattgtaataataccctagtactatggcacaaagtcatcctgaaagtgtttgtcacgtcgattcagtataaattcagtagcatcggcttgtcacaagtggcagaaaagattgagaatccaatccagcaacatgctaataacaatgtctgtggaggaaatgaggaatgattaacctacaaaaaattgtatagcagctgtagaaagtactactacactactactagccattaagttacagttcccatggtgaacactaggacagtaggagtaagaaatgtaagatactgatccccagttcacattccaatggattgattatgcgtgcagtaaaatccttcttaggtgctactaagatccacttaggaaactacagagttaactaatcttccaaaagttgcgtgtcagcgtcagtatactgtctagttttagctcttttcttctttctgttactgatagtctggaacagcaaaactgcatgtgcattcttgtttctgaatttctgaccagatgatgttcagacttcagagacagaggacttaatttttttacttcgttaatactaacatagttactactagcagtaaaaatcagttaactgttaactgatgattacactaatgaatatattaactcctttctcaggtagtcctcaacgcgtcatgtatggaatatgaattatctttgtccctgactccatccccaaatcatcttgtctccttgccttgagcaagcatcaatctaagctaaagagaaggctattaaaatcactaatgcttgcttccaaagtaagtgcttggtacctgtgagttgggagccaactaataaagtgtcaggtccattacttaattctgagcatcatcgcagtggctggcaaggaggagagcatcaacaagggccatggatagttattagctgcactttttttttcatctccagaacatataattctgtgcatttgacaaactataattcacttccattcttggcatgcatagaacccacatgagtgttagagaggcaaagacatatttaggaatgagagaaagggagccaaattatgaaaaggaaatcttaatttgaacttcttgctcctgctttaagttgcagcattgccccaacagaagctatcatccaaaggaaaacaaagcgaaaaggcatgaagtagtagtagaaagcacaacacaagccgagaaaactaatcacctagctatgggtattattctggagtagaaaaggcttaatgataatgcgaatgagatgcatgaaagattagtgaggtgataggaaaagcttagaccggatgaaaccagctcaaatagagaatggggaataccttgaaaggttaacaagactgcgtcaaagataatcgtaatgctggacgatccgtactgctgtatactgttagataattgcatcgctatttggcgagatctatcattgtaaagcgtacatcgaaggaggagcagatgatgatagctaggcaacctaaaaaggggaaatgaggaaaaggccttttcccgagctgaagaccacatgcttgatgcttgtggaggggctcacatgtcctcctcttcctcggctcacagtcacagaggaagaagaacaaaggagatgaaataggctgtgagctggtgtgatccggctcagataagaacatcggcaccaaggccatgttggaaatataaaacgagatcggaatctcagtaaaggaaaagaaaatttgcagagaaatgtaaaggagcaacctcatacttgtcgattgctagagctgaaatcttgaaccaatgttttgagtatttaagcatcaataatgtgagttaaagtatacgaactgatcgcatggagataatttcgtttgattttcttgcaattcttttcgcagtatatcttctcgtggtagagtatgaaaagttacaaaagaaaaggcttacattttgtgatggagggaaacagaaagtacaaaggtggcagtgacactgtccatggagagtagagcacttcttcctgggagtggattctaatccctcgaaagaatatcctctcgtatatctttttctttcaaattcgatgtaaatagttgtgaaaaattctaaaaaaaattagcaatgtagagtataatgatacctactaatccaccaaaattcaagttcaaattcgatctacacatcgagaaacaaaaaagacaaatttagatataaatagtacgctactatttatacactgaatttgtttttttatatctcgacttgtgagttgagtttggacttaagattttgtggagttgtatatatgagttgtatgaatgttgtcaatttttttcaaaatttttcataaccgtttagatgatttttaaggaaacgaggaaacatcttgagggattagaatagtttccttctttttttagaaaaagatctctttctttttccagagaagtgcagttcttaactacggatgctgaaatagtaggatacgcgagaacatcagtgtgaactgggccgtcagtttgttatacggaatatctgggccgtgcgtaatcaagtataggagatctcagctcgttttgaaaaaagtacaccaaaggtccctcaacttgtcatcgaggtacagaattatccctcagccgtaaaaccagacgtaatatctctcaacttacaaaaccgttcactttttgaccccggttttatccaacgtggtggttgagttagcgtggaatacacgtagaccccatatgctaggtgtccacgtcagcccccctctctctcactcatcttttctcctctctgcaaggcgacgcacgggtggggaggtcaccggggcgaggcgggagaggagatccggcagtcggcgatgcggcggtggcggctgcgacactggagaagggaggcagctcatggcggcggccgacgacgatgcgggagaagggagagcgtcaccgcgcgtgcgacctcggggtcggaccatcaaagaggcccgggaggtggcggcggcggcgacacggtagaaggggaggacgttgccacacgggtgagctcgaggacgaagatcccagtcgcagcgaggtgagcgacctcaaccgcatcgcgcccgccgtcgacgacccacgcaagcacgcactcgtcttagcagtcctcgagcttcgccacccagctgccgcccacgactcccgcgcacggttgcttcctgctcgcgccgttcccactttgatgttgcctccccggaggagccaagcctcagatggggatggcgatggcgaggtggctcgagggcaccacgacgatgagcaacggggacggggagagcgaggacgctaccgtcgtcgtgtcgcccgtcgccatgggaggaggccctctcctctcttcccccacctcatccccgctgccgccggaggagccaggcctcgggatgaggatgctggcgctgccacggcgacgagcagcggggacggggagtgagacgggagagcgaggacgctatcgttgccgcgtcacccgtcgccatgggaggaggtcctcttgctcctgtgtcgtcatcgtcgccgctgagtcgcccgttgtcggtcgccggccgttggtagccgcctcggctcgccaagcctccttcctacccaccggctagcctgccccagatgaggataaaattgggagaggaggaaaggagagaagaggggaaagggaaagaaggggatgacgtggtcacattgacatgtggggcccatgtgggtcccacgttgactcggatgccacatcggataaaaccggggtcaaaactgcctgaggacccaaagtgatccggtttcgtaagttgagaaacatatatctggttttgcggttgggggatgattttgtaattcgatgccaagatgagggacctctggtgtacattttgcgcttgttttctaaggcagcccaaagcacgccagcccatcatgactccatcgtccaagaggaggccgcaaagttcacggcccatatactgaccgggcgaagcggagggggcctctgttacgactttaggccggtctagcacgcgcacggtgcaccgtatgccgcggctccgctccgttcgccgtgcgcgtgcgcggtgcctctgccggtcaaatctgccacggcgccaacccacgcgcgcggccgaggcgaagcggacggaagaacgcaggcgcaggcgtgcgtttccgcaggatttgcttccgtcgcgtgatccatcttggccgccgtggcacgcgtggtggcgatcgacatggagaggaaaaaacgtacagccccgcgccgcgcgacagcgtgatccaatcggtggcctgcgccctgcgccaccggtcaaccaaaggccaggcgcgcaccaccgattcacgtaccgatcccgactcggcggtactgttttttcctgcgcctttatgtcagtctcagcgcctttgttttacgccaatgcgaaacacgagcgcctgacgatgttactgttgaccactaggcactaaccatcatcgtcgtcgtcctcgtctatgctattcctgtgaaagatcaatgccatagaaatcaacatctgtatgtctcataaaacatgctcctagggttaaaactgcgtgccacgagtgacggacgaagaaaccaaacgtgcgagtacggacaagagaagttgcattaatctgactttgggaacacgggaggatcatgaaagaaacgtaagaggccagcctgcgtgcgacgggagaagtccacctctgtctactggctaacaggacagtaatctggttggtgtaccgtactaacagctagcctgattttacgttttgtcatggcgaaggccggatcgatgcagccttcaccgggcgaaatttcgcggggagatggacagctcgttcggacattgtcagcaaaaagtccagtggatcgccgagcggattgctcgatcgatcgcgcgatgctgcatatccgtggtggactggtggtctgatggagtagccgctgggacgccggcgttttccgtgatttgctttcttcgcctctctcacctatcacgcaccgaggcccgcatgcactacgctccggcggcatgggcggccgatgagtcggcgacgtgcactgcagaggccggcccattataccttttccgaagcagagacgttgctggctaacgcacctttgttcttcggtaggtcgtcggtttccacatccgcgtgtctcctgataatgtggtagtgactgttgaattagacacgttttgctatacatacatgctccctggctaaggcatgggctataaccctacaactgttgtgtacactgtcctaagtgcgctcgaaggtttggtcaggccatcgaactgatggcacactagtactgtaggtggtgcatgttggagaagaacaaatcatttggtgccaataaatcattcacatggaattgtttttggaaagaatttggcatggaattttgggccgtccatcgatgaccacgagcaataatttatgcattgggcggcttgagatggagatcagacgttaacttgtttcaatcacgagttcgtgatagcttgccgccccaaaacacccggttttgtctggaagcacgcttgcagataagcgcatatatggtctaaccgcagctcgttttgaccccctaatttatagtggtaaacagctacaggttgcatcatgttacggccatatgtgatagtagtatatcaaaggaaagttactttactactcacgttttgttgttttggtgcaggttgtccgttggattttgcaggttacgtaggcttgtaaccaagcttcgtagtaaagatattatgcgtccataacccatggcgtcatgcctgaatattacgcattactcaaaaagtgttatccgttactactaaagtgctcactgaatcatctcgagtatgacctgtgaagaagcacctcaatggaacattgaacatatcccatacgctgttgaggcgctgactacaactaatcatcctgccagtaacatccctgggcgtccatctcacagatagaaatgcagaatcttgagtgttgagacctctactacacctagatacctagccattcaggcaattgttaaccacgagttctcaattatcaaggaaacagcaacattgttccagcccttcagcaactactcatgcagttgcacgatcgtagtggctgcattgactagtgatagtccaaacctactggcaccaaaagacactgtctcctcaagttgcaggccaaaagaggctaaacgctagtatcttatcatgtccttgacaagaacatgagaccgaattccctggtcattcaagtggatcataagccagaattgtcactgcgtgagtgtaataatgcaggacaggtccccaaatgtatgaataaacgcattctggccaatcagaaagatcaagaatgagtgtcccttgacaatgtagcttcaggttatttgtacttggagatggacagattccactgttcatcaacagcttgaataattattaaacaaataattccattactgtctgcctcacacggtcacaccagggacaggtcaaagctcacatgcaaaaagcagcatctgctcgagcagggacatccagtgcagcaataattaaggtttgatcttaacaacagatcagcactaaatcgttgcactattccgggctaaaggtgatgtaatggcagttaacttcagtgatcctatgcctatatttttgaactgtacaatgcagagacaaagccaactggtacttttcaatcagacagcgcacttccctgcttgtgccgtagtctgctcctgtgactggaattatgctgcatatcagttcacggggctaatgttgtgccaagaaaaagaagaacatctcaatctaatcagtcatgtgtgtacaaaactgtattatttcttcttgtacaaaaatactagtatgccgacgtgttcgagccactccgtagttgataggaatactttacgtgccacgcgtacatcatgaggaagaacacatatgacaaatgaatcggcgagagagttgctcctgtggctgggagccaggggcggagaccggccaggcagctttcggttttgtgctcttgctatctgaacttgtagcgttgtccatgtagggcacgggggtgaatcagcagatctttgaccccaatttctgtttgaatatttgtcatgccgctcttgtccccttgcatgcatgcctgtcgagacgttatgattgctgcggtgtttttttttctgaacctgagttacttgcgggcagcggtgaacgaaacagagacggaattctacccatcacaggttcagaaaacaggagccttcttctcctttcgttttacaggtgaggattccaaactctatgcatggtacacactgcacaagaggctactactccagcccatttttctgaaaaaagaaaagaaaaggaggctactactcccagcagctggtagtgcatgtacgttagcacattccacggcgaggggatgcgcgagagttgcgaaatatctcaccaccggatcggcagatgtacgcgggcaaagtatctcgaattctcgatatctaaagaaaagtataggagaaaaaacgggagaggattgcagcaacaacggtaggccggtagcggcagcgggcggtaggccggtagcggcagcgggcggtatctcctctcggtgtgttctagtagaatcaggacacgcgcgcgcgtgtgatggtgcgcgcacgcgggcgcgggcgcgggccggtccgcgagagagcaagcgggccgcgcactcccgtcgtcccattgcgtattcgcggcgcggtcgctttcgccgcggcgggcaagtggcgtggcgcgccgccctgcgcgatccacaggatgcgaagattccgccgagggggctcgcacgcccgcgtacgtacgttcgcgcgtgcggatcccgagacgcgacgaattgggtcgagattgtgcccggcgcatcggacggcgcgggaggtgggggctcctcgaggcgggcgcgcgcgtcaaacagaacaagaggcgccggcatctcgtgcccgcgtggcctcttcctccctccgcctcccgccgcaccactacttgccccccatatccatccataataaaagtacgcacctcgcgtccgcggccgcgcggctatatatcagtaccgcgcctacgcactcctctcctctctctcctgtgtgctagcggaggcggagcactacacggttaattctgcggttgctgctgctacctgcgaccttctagcaggtgcgtttcctcctcgctttgcctatatatatatccacttacatttctcggcttgatccatggattagtctgtcgatctcttccatgccatcgatctcgctggttaagattgcgctctagtgcttagcttgttgcagagccttgactttctttctctgctaagaactgaataacttgactctgagtaagagcttgcatatatagctcttagtatattcttcagattttgtcattgatgttatgcgacttgtgcatttctttgactgatatcatgtagtaatcactaaacttcatgcctgactctaggttgtgagttgtgagacagcgagagttagtcggtgtagtttcatcaggaagggccgcttagacagtgagaactgagaactgagaaatacagcagtaggaaataaatacccgttctactctggtgtcagtcctagatataatttaccactgtgtttcatgcatgatccgattcttagttttctcgacaagaggtggtaaccacatgtaaatattgttgtttagcatagctcttgtgatcaaagaggatggaaaattcctggtagggtcagtaagggaaggaatcagcattgcgttcccattgttcatatatctgacaaatgataatgatgtcttggtgtccattgctactggacaaaatagtacaggttagctgagtcagaagggttcatgcagaaagtgtagaacttattgcagataaaaccctttgcaaatcatgtacagcagtagagcttcatactgtcaccggcttactgcgcagtccccaacgtttgatcatgtggtccataaggatcaatcgttcaaactgcatcagaattcagaacctaagcatgaagaaatactacctcgatctaccactagacagccatatatgacattgacaacggcaataaggaccgttgctttagaccaaaatagaatcagcagtgcatccacttcctggatgggttaaatgctgatacgaagtatgaacagacataacctaatcttaattaactgacaggctgaaaaaggtatcgggtatattcaatgaatctggtaaaatatctggctgatttattgcgttagtatcaagtgattagtactatgagatttggtattgctactcaagattctttgtttcttttttcatgaaagaggtcttgagaaaattcgtagtgtaagcatttgttttgctgaagagaacaaccaaaaccataagcccaggcaaaagtgtgttcatttaactcagtaaactagtctttcctgatccgaagtttggagcaaactttaatttttctaatacacttttgttttaaagagagaacaaaaaagctgatatttgctaaaggaacaagtatctaattactcttttattacttggtccccatgattattcagtaactggctttcagtataatgatacaacttttggtcttttcacacttcactttccttcaatcctattcaactatcactgcactgggagctaactacacatagacatagctttcattctttttctgaagtttaaataatgtttacttttctgaaaatttcaacgtattgatatcatcatcaaatccagtatgacatgccccaaactaacgtaagattcatacttttcaggtacacagtgctaacaagtaacaacacaatgttgcctcagcaacttcagatatatttgtgcttcatccttctgtctctgaagttcggaatatctgcatctctacctcttgaaacagatgctctcttggacataaagagtcatctggaggatccacaaaattacctaggcaattgggatgagtctcattcaccatgccaattttatggcgttacatgtgaccaaacttctggtggtgtcattggaatatcactctccaacgcctcactatcaggaactatatcgtcgtcgttttctcttctttcccaactacgtacgctggagcttggtgcaaactccatctcaggcactattcctgctgcactagctaactgcacaaatctgcaggttcttaacctgtcaacaaacagtttgacagggcaattacctgatctttcaacatttatcaatctacaagttcttgacctgtcaacaaacaatttttctggaccattcccagcatgggttggcaaattatcaggcctaactgaactaggtctaggagagaacaacttcaatgaaggtgatgttcctgaaagtattggaaagctgaagaacctgacatggctattcttggggcaatgcaaccttagaggagaattaccagtttcaatatttgatctggtctcacttgggaccctagacttctcacgcaatcagattattggtgtgtttccaatagcaatatccaacctgcgtaacctatggaagatcgagctctatcaaaacaatctgactggtgaaattcctcctgaacttgcacatttgacattgttatctgaatttgatgtgtcccagaatcagctaagtggtattctgcccaaagagatagcaaacctgaagaagctgaagatctttcatatttaccgaaacaacttctctggtgtgcttcctgaaggattaggggacttggagtttcttgagtcattttcaacctatgaaaatcaattctcaggaaagttccctgcaaaccttggccgattctcaccactcaatgcaattgacatatctgagaattatttttctggtgaatttccaaggttcctgtgccaaaacaacaaattgcagttcttgttggctttggacaacaacttctcaggtgaattccccagctcctactcttcttgcaaaacacttcagaggtttagaataagtcaaaatcagttcactgggagaattcacagtggcatatggggattgcctaatgctgtgatcatcgatgttgccaacaataaatttgttggcggcatatcctctgatataggcatttcggcttctctgaaccaactgtatgttcataataacgtcttctctggtgaacttccaatggagttggggaagctttccctgcttcagaagcttgttgctttcaacaatagattctctggccaaatccctgcacagattggaagtttgaagcagctgtcattcctgcacctggaacaaaatgctctggaaggatcgataccacctgatattggtatgtgcaacagcctagttgatctgaaccttgcagacaattctttgactggcaccattccagacacactagcatctctattcactctgaattcactcaacctatctcacaacatgatctctggtgaaatccctgaaggattgcaatatctgaagcttagttatgttgatttctcccacaacaatttatctggaccagtccctccagctctcctgatgatagctggagatgatgcattctctgaaaacgacggcctttgtattgctggagtttcagaaggttggaggcaaaatgccaccaatttaagatactgcccgtggaacgacaaccatcagaacttctcgcagagaaggctatttgtcgtgctgataatagtgacatctctggtggttctcctatctgggttggcatgcctgagatatgaaaattacaagcttgagcagttccacagcaagggagacatcgagagcggcgacgacagtgactcaaagtgggttcttgagtccttccacccccctgagcttgatcctgaggagatttgcaacttggatgtggacaatctgattggctgtggaggcactggcaaagtttataggcttgaattgagcaaagggaggggtgttgtggccgtgaagcaactatggaagcgtgatgatgcaaaggtcatgagaactgagatcaacacacttgggaaaatacgccaccggaacatcctgaaactccatgcattcttgaccggtggggaatcaaactttctggtgtatgagtatgtggtaaatggcaatctctacgatgcaatccgccgtgagttcaaggctgggcagccggagctggactgggagaagcggtaccggattgcggttggaaccgcaaagggcatcatgtatcttcaccatgattgctccccggccataatccaccgtgacataaaatccaccaatatactgctggatgaggagtatgaagcgaagcttgcggatttcggcatcgccaaattggtggaaggttcaccactcagctgcttcgctggtacccatggctacatggctcctggtaagatatgaacaattctgctcttgtatgttaaatgtttatggtagtagttagtattgcacatgaattccttaggaaaaaaaacaaaatgcgtaatacctcttcttccagcccttacccattcctctcaaccatctcgcggatgaattcgccatgccgctgctctcttgctcggccgccgccgccgcggcgccaccttgcgagcaggtcgaccgccgtcggcggctgtgacgcgcatcggccactccacccccttcttccccgacaggcgcccccccccccttctaccaccgccgcggtgctcgagctcccacctccctcccattccctccccgcctgccgccagcaacctccccttcaaccaccgcccgccgcggccgtcgtagtcgaccgctactggccgcgccatccgccgccgccatcctccagtgcctccgatgcggacgaatttcttggcgattagccgattacatgcggtgaatgagtgggagtcccaccgggaatggtcaggctcatatgaagatggtatctttagaaataactgaaaataatttattaataaacgtttaactatatttttcatggttttaaaccgatgctgaaaaatatactactgcaacgataaacaaaaacactgaaatcaaacttaaaattaagtttcagaattcaatttttggttgggctaataaactaacaagcaacgagggtagaattgctactaggtattctggaaaaaaagagagagaaagaattgctactagtcatggacaatgttattaaaaaaaatattcatacatttttatatgaaagcaaatggcatccatcataattcttcaaaaggtgtaattctgacatgcatattatgcgtagttctgtagatttgacaatctaacatcagctcgtctcaaaatgcagagcttgcttattctctcaaggtgacagagaagagtgatgtttacagctttggcattgtgctgttagagctgcttactggacgcagcccttcagaccaacagtttgacggtgaactggacattgtctcctgggtttcatcccatttggccaaccagaatcctgcagctgttcttgatccaaaggttagcagccatgcatcagaggacatgacaaaggtcttgaacattgccatcctttgcactgttcaactgccttctgaacggccaaccatgagagaagtcgtgaaaatgctcatcgacatcgactctatctcagcaaacgggaaggcaaagaacaagaatgataagaagtaagaacagatgccccgtttctttgtaagaaactgctgccagaaagatcaaaaggcacccagtagcaacagtctgggtgctgccgtgctgccaattaggaccttaattagaatgcctgactagtgaatagtaactagtaggctggtaataaactgaggttttagcagcctctgaaaagcttgcacatatgtacaagctaccctgtacaaatttcagtcatgtactctgaagtttctgtaaaaatgatatgcgaagaattatgatgtaccagtaccacactgcaatgccagtagaatatgaccataccgttaaaaatggaaatgtgctgattttttttttagacaggaacaggaaatactaaaaggcaaaggccgttgtacaggttattccaatactactacatattccaacctctttctgctatgttccaagttccgacctgtttaatcagataggaacaacctaatgtgtcaatatagctgatccagcaaagttcagagttccaaatctttcaggaaccggccggatatccgagaaaattgatacacagagacacagaatcagagtccagaatcctacattgttgtacaactcgtagctgttttctgtttgtcactgttctacaatatactgcagcactgcttttagctgacagttttgaaaggggttgcaaccttcaggctatcaacaatgtcagtgacagagccaatgcccactgccaccgagatcatcaagcacaccatgctcaggccttgcaggagataccacctccctcccctggtgatcttctcctgcgcaatgtgcatgctgatggggaagtaaacagtcagtggccagaagctgaaggcgccgaggagccccagcaccgcgttgaagaacggtatcatcatcgccaccaccgtcgtcgcgatgactacgacggtccggaggacgagcttgtacggcgccacggtcaccgatcctcgctggatcagcggcacgtttacggtgtactcgctgttgatgaacttggcctccggccaccgggaggagatccatctctccattgtcgcaaatatgggctgtgcataaacctgcattcagaaatgcacccggtttaagaataatttcacggtgatctctactaataatattttactaccggggctcagttacgaacttatgatgtactgacctgatatgctccgatgagatggaggatgaggcacatgttggcaatgtcgacgagccagaagggccccataccggacgccgtcaggatgttgcccggagcatctgaaccgaacgcggcgtacccggcgcagccaacggagatgtagaagatggtggtggctccaatcccgtacatcgctgccttcttcatggtcttgttctccggtggtgacggtttcagtgtgtcctacaaaagcaaaacagacggaaaaaagcgcattagcgttaagaacgtactagtaccacattgctactcgcactaaaaaaatattggcacgaacaaaaagaaaatcctgttcgtgtatgttggttcagaggtagtatctgaatattgtgggtgacgaatcatcatcgatcgtgcatgcaaacctggatctcaattagcacttctgcaaaggtgtaggcgaaggcgatgttccccagtgcgagcagtacgttccagagcttcttgctggaggacgccgcggtggcgccctggatcctgccgctgaggtggccgccgtgcgacacccactccgccacggacaggccgaggccgatgaaggagtaggcgaacgacatgacggcggcgacgacggacagccaggtgatgtgctccaggcccgggaactgggacagcaccacctgcacgatgctgaacgccagcatgagcaccgtcgccgacgtgttgtcgcaccgcgcggcggcgccggcgccgttccgatggatgcaatccgacctcctgatcgcgcttcgcaacacaacggaaagaaaaagaaaaacagacgaaatttagtagcctgaccgatggcgaaaagttcagttcggagggaagttggagtgatctgttcggttactcacaccatgcttatggttgcggtgattgtgtagccgaccatggtgccccacaggttgacgtactgcgcgattccgcacatgaacacctctctaggacctgaaaatatttttggcattgcgttcagtttaaccaacaagatggagatgagagaaaaaaaatgtgagtgtacttactgaggtatgatctgacggcgtccatgtatgtgcggttcctggtgccggtgacggggtgcggcgcgcggtaggcgttggcgagcagagtggaggtgtagtaggtgacgcaggcgaagccggcgagggcgagcggcccggccacccaacccagctgcgccacgctccacgccagcgccagcacgccggagccgatcaccgccgtaacaatgtgcgccgtcgccgtccataccgtccctgcaaaaacaaacccagttaaccggaaccgccgccggcgcaagccaaccaaaacaattctcaattcttaatcccagcccaactcccatggcctgtttagttggagggagttggcgatggggaatgtgagtttatgatatatgggagtttaagtatgtagtttggttgaaagatttgggaatttgagtgggtttgggatagggaattaaaaggtcgaattcccactaatctcttacctaggggaggcatgttaattcgtgagacttgaagagaattcgatatgaaaccacaatagatgaggactaaaaatgtaactctcatgaccaatcccaccatcaactccctctttaaaactcccattcctcttctctcgccaaacaggccgccaaggtgtcccaagaaaacaaatagtcgatcacccatgcggcacgcacgcccgcacgcacgccgtaccagtcaaagaaaaaccccaaaaaccgggggaagaaatcactaaatcaggaacaagaacgaacacgcacctgtccgctcgtgctcgccgctctcgacgtcttccggtgcggcgttcttgttcatgttgtcggcgagccccgcaggtgtcccgtgagggagagtgggcgaggagggatgcggccgagtcctgaaaccgtgaacgaatctggacggtattaggccgtatatataagggaggcagctgaaagtgggctttaatcagggctcctgatagggccggcacttggaccagtagagagcgccggttcggctcttccggactccattgggcagagtccggatgcaatgcgtttgacgagcaaggacctcatcgtttgcccaaaatttgaatttgattttgattttaatgatatctaagttttactcacatatcaaataagctgtaagcaaattgttaaaatgaacttgtgattggtataaattgatgtgcaattcgttttgataaaagaaaaactgattttttttaaaaaaaaaaaactaggcagacttagctggtgttatattaagtagagtgaaaaatatttacatgttcactaacggcgaaacaaacagagaaaaatgaaaaaaagctgggcgatgctatgacaattaacgttctcgtgatatctttactggcttgtttaattcgtgcacgattttggatgacgggctcccaatacgcttcatcatgcataataaatttgtacttgatgcatgcatactccctccaccagttccatattaattgatgttttagataaagtcgaggtcaaatttttataactttaaccatcaataacttttaaaaatatttagtttaaagtaactagaacaacatgtatagatttatctttcaaagcactataagtaaacatacatttatttattatatatattataatagaaaaatatggtcaaagatatattttgtagaccgtattattatccaaaacgtcaattaaaatgaaaccggagggagtactccattttgcttattttctctcatgggggttctgtcaataagaccgtgatattttctttttaaatttttatttagacaatcattttgtaagctcaaatgttatggttacgtatatcctaaaagtagaggttgaggatgcaatcatctttttttatcttaaaaaatgtctgggttataataccgctcagacatgcccctgctacctgattcagctcgaacctacaaagatcctactatggtataggaataaaatgaaaggaaaaaaatatttactcggggttgagtcccaataatcaaggaatttaggaacacatgaattactcaattgagttaattttacgcctcatgagagaaaatagtacatgtttgtttagtaatttttttaccaccttttctgtccgtagcccgcgtagcgacccaaatcgttagccccggtacaaagtacaagtgattgtaaactttcatgttattaaataaaaagatgaatgttaaaggacatgtagtatagtgattgcaatgacctaagtagtactcaagattctgtgttcaaatctttataggaacgaattttagattgggctatttccataatgaaactatacttcgaaatcaaaaaggtaaaccatgcatcgatttctgcattattttttttcgattacacaccaatacacacgtgcacacctgcaaatatattcctaatacacactcaaaagatacgaagactaacggtaaatctcaaaccttgtcaattaaattcctactaaaaacataaccgtgtatgtaaagcatttagagtggatatcatgatttaaaccctaactaataagtaaaatcatatagtaataaccatgactttaccatcataccacaaatacttcttaggtttccacgatccaagcattccttgttatagtcaatcaagtacgcaaaatttatctccacggttgttgtcattgttaggttgtagtgttaaataggaggaattaagatgtataatcaattatctggagtgatgtcctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacaagtttcaccaggatgaaactctttccttctctctcatccccatttcatgcaaataatcattttttattcagtcttacccctattaaatgtgcatgacacaccagtgaaacccccattgtgactggccttagtactacatgtagggtgacgtcctcagtactcctctccgagaacaaattaaaaactactttgctgccggttttgtcaaccaagttgaataataataatcttctcaaaactgaaaccattgttatatgaacccaaatgattgttacttcctccgtttcacaatataagtcattctagcatttcttacatttatatagttgttaatgaatccaaacatatagtatgtgtagattcattaacaactatatgtatatgggaaatgttagaatgatttacattatgaaacggatgtagtatatgagatcaaatagcatgttgttgacaccaaaaagtcttgaccggcatccacacacacacagggtcatgcagaaccagtgaaccacacacacagaaaccagatgagatgagtgcagtagtgtagcgcaacagaaaaaggcaaaggcaaaggcaatgcatatacatacgttttcgcagctgcgtcatcgtcattcggttggagagacgtatcagagtagatggatggatcatggatccgtctcatggacatccactcggacagcaactttgggttgggaccttgctttctgcttcgccgtcatctgctacgactgccctcggcccttacatccaaaactgaccacgcaaacttgcaacaaatgccgcccgcgatagccgatcgataggtttgccggacatgtgcgcgtgtgtggtatcatggtgcgcgctcgatcgacgcagtgcgcagctgcggacacacacgtaccaatttcccggtcagaatgtcagctcgcagcagggtagtgataagtactgaagagactaaaggctggcgacgtatatatgtccacgtggggagaatgagatcgatcgagatggcatgccaggctgagtgcccgacaccgggccggtggttgccggccgagatgctagcttttttccaggattgtgaggaaaatgcgtcgcgctgatcagtttcggtttctctgcttgctacattgcaatagtagaaaggcagtgcgccagtgccggtcacgggccgctggtgaatcgtgatggttcgctggatggtttgacatgtaattccatatatgtatgctaagatgtcaggttcttgaaactgttggtaggcctatgtggatagagggaggtgaagcttgattgtgatatttgtttttttacggacagaataaatgagcactgccacattccatctatctgtccagaataaatcatcattccatctatctgtccagaaaaagatagatgctccattattcagttgcactctttgcaattgctttaaagagatcaatcagtttgaggttctctctccactaaaatgaatcatttaccagtaaatgccagtgaggaagttggtttgtataatacagttacaatatcatgttattccaaagaatatcatgatgcttgtaaaacttgtgtagattcttgagcaagagagtattgttttatgcatataaattgatctctcgaatacctctatttgactgtggcatacagactttatctcagacaataagagggtgtgttttgcttcccatatcggatcccactaagatgttcggttaatatcctcataggagagagattaaggatattttttttcacacctattatggtgtggaattattccccatcaattctctccaatcccttttaacgctcttcaaaccgaataaagcctaaaagagaatgtcttgtgtatttttcgattcgctgcaccactcttacggttagtttcaagggtagaaagttgagagtgcaaaaagtatcgacttaaccaaattgagtctattcccataaaaaatatgcttcctatgtttcatattataagtcttttgattttttctctagtcaaacctttttaagtttggccaaatttatgaaaaaaatagtaatatttaaaatatcaaattagtttcattaaataatatattttgatattgtatttgttttatgttgaaaatactactatatttttctataaatttggtcaaacttaaagaagtttgactagaaaataatcaaacgatttatatgttataaaagttagtcgatatagcggaacgacgactagcattctcgatcgcttcagtcattgatcacccatgacacgccagatgatgacacatgaatacacaatatttgttaacgaagttcagccgaagcctacatccccgaggctctaattatgggcgtccccaaccaacataacacctacccggtacgagtccatggccacgccgccatcgtctccttgcgtgtctacgctatattgtagtcgctatagttacattgtggcacctcctctctatttaagagagttgtcgatcgggttatagagtccgactctaactccacctccatcacctattacaactccaaatctaactgtaaccaaatagaactggtatattcaaccactagtacagatccttctatgtgtgacgggctctaacatgcctggaaatagcgggccgtcacaagaaagtcatctcaatcgggctaaaaaagtgcccgattaagatatggtcgcacagacatattagatggacataaaacttaagcccgtcacagatgacacctatcagtgacgggccgtagtttagacccgattgagataatattccatatctcaaacgggcttgaagttggggcccgtcacagatgaccatcattcgtgacgagcaccaactttaggcccgattgagataacattccatatctcaaacgggccttaagttaaggcccgtcacaaatgaccatcatccgtgacgtacactaacttaaggcccgtcaccgatgagtattttttctatttttcatatgaaatgtttatatttgtaagttgaactatagcaaaataattaacttgcagtataataattcattttacgagtcaaaataattttacgggtagtaaataatatcaaatggaaaagtcatcaacaacaaaattgtataactcatcaagatctataacttttattttggtcatttttctatataacattttttgaacagtttgaatttgaatttgaaaatatgacaacttcaaacaacattttcaaatactaaatgatttcaactgaaaaagttatcaacaacaaagttgaaaaactcatcaagaactataacttttattttggtcatttttctatataacatttttttgaaccgtttgaatttgaatttaaaaatatgataacttcaaacaacattttcaaatactaaatgatttcaactgaaaaagttatcaacaacaaagttgaataactcatcaagatctaaaacttttattttgttcatttcttcatctgacaaaatgttagtaaaattgttcataaattttacatatatgtgtatagtttataaaaccagataagagatat

SEQ ID NO: 61078 - DNA, 14540 bp, Oryza sativa
  unsure (1)..(14540): unsure at all n locations
agtacaaaaaaccatattaacatggtgaaaaagagaaacaaacaaaacttgcaaaaacacggaattgctttcttgttggtgcttagtgcatccatattagtatcatagtccacagcctcagaccgaaaagcagtaacatgtctaaaatgcatagatgttatcaaaaattgattttagatagatgagctgatgaaaatttgaaaaactgaaagattagggatgatgctcttgccttgtgcttctcttcaagcttctcaaaaacttcaaatgcctgatcatctgtcaaaaaaggtcagatccaagtaaggatcgacacatatatggatgaacaacatgtagcagtagcattgataattcagattttattgctgctaacagacatgacaacagaatcgtacaaccccgcaagcaatgcagtttgctaaagttcatgacagaagcaaaagggacatcattctttatgaaacaaacctgagcttctatcccaacgcagcttcttactgcttggctgtcctcgcttagaacctgaaaagaaacaaaatgtcaagagagtattctgctgcaacaacatagcagataaattttatatgtacagaaatacaaaaaaaaaaatcaagattaccttgcactagttccacagggaaatttgcaggagttagtataagatatgacgcaagagcttcacgtttggaatgtgtcttacgtttcctatcagaatacctttcaatctctttatcatcattctctgatgggatatcaacacacaaaaaaaacttatcagaaatagctctacaaaagcaagcacaaatctctacaaatgcaaggaatgaagcaaaaccagaggatgcttgattgcttggaaggaaaaaaaagaggctgaaatgttcattaatttgtaaaaatgtttcaatggagatatagatagggctaatacaaaagaagagtaggtactaaaatgatgaatttctggttaaattgagctcgcagggaagcaaggcccaaaagaatattatgatttatggattctaggccccatatcaacaccaagctgaatgcaagagaaagttctctgtgcatgtcgaagtcaaaattatgtagtccatcaaagttcaacaatatataggaaaccataacaggttccactcagtaaaacagacagtcagtccaaataagccagagctccagtaaaacacttcagtacccaattctttgacccaccacctcaaaataaacatgaattacttcttgtaacatgtgttaactatctgacctatgctacatatatagtcgatttgtattaatcgagaagcaagatatcctaatgggcaggaagaagaactaaaaaatgtcacaataagttgagccatagtagtacttttcttggggacatcctcctccaggtggtagcaagaagtcttccagaaatcctcaaatttcaaggtggactgtatcaaagccttctcctccatggtcgccctggcgcacgtcatctccggcagggtgatgtcctgaatataccgacgcccaaatccggtgaatcgccccaaaaaaaaatcacaccacgagcatggcgaaaatcgcattcagcagcaacaacgagaggagagggaaagaatgggtgcagggaagtgtggggatggcggaacggggaatgaagtggagagaaaagaaggttcaccgggaaatcctcgtggggggtgtgcttggccgggtggtcgaagccgtacccttcctccccgcctcccccggcctctcccgcggccccgggacgccatctggaggggggacggatgtcgatcgaggcggcgaacctctccgcgcggcagaagcgcggccggagaagagaacagcggcgcggcgcgaggggaagtgcggcgtcggcggcggtaccgcgcggcgtggtggtcccgggctggctgtgttagggtaggcggttgggctttttatgggcctcatggtgactattgggctttgcgagctaccaggttgcacgtcagttcggctgtagatggaataagttcgagcatgtttattttgagggactgtctgaaaatcattcgacagatttttagtagaaaatcagtcggattttcaagccaccacgacgtgcggttcaaatgaaaacatatccacgtacgtcagtcaccggacggtaatcacgtcaatgatgcttaaagaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgatgccaaaaaaaccttaccaaattttggctatggcatagttactaaaattttggcagggtttcttatatagttaccaaaatttgatagcaaactaaatatagccactttttgtaactttaccaaaatttagtaaggttaaaaatagcatcaaagtgaacacgcccttcattttaggtccctcaacttgccagcgaaattgatttttatatccttagaccgaaatatcagatacaacgggtcattaactgttaaaaccgtgtaatgtaggtccgacagaagtatgacatgtggttttgtccgacgtaaaaatttgacccgaattaataatgttgagtcagtgtgagcctcacatgtcaatgcctcttcacctatatctctttgttcagttgtgactgagaagcatggcggccggcgacgggtggtgaagaggacagtcgctcacgggaaaagatagctcgatggaggaaggacaccgacggtggccatcgatgacggcgatggcaaggcagactagaagagaggcaagatccgggagcatgacatcgtcctcccctcacccctcgctcccctcgcccgttcttcccccacagccgcacgggacgggagccggcctcgccgcccaccggaggcagcgtcctgtctcgagttcgctcagaagccgcttgtcctcctcctctctccacgaccccatccgcgaacgccgcctctaccgcccacatcaactcctccacccacatcgccgcagaggtgggtggtgatggtggctgttgcagagaggcgcaaagaaggctctgtagtggtgagcccttgccggaaccaggatagccacgcagacttggaatagggagacctctagtaatgttgaacccgagagcctatcggcggtggcgcgcggcgcaaattggtagcggggaagagccagtggaggaagaaatcggggcgacgaataccgaagtcaacgggtggaggtcccctccgcttgccggccatcggccatggcttgagccccacccttcctcatccccttactcctcgtctcctccttgctcacgccttttgccgcagtggctgcattcgtcggcctcgagtccttcctggcggcggtgactacccgcgacccctctgctggcaataacaccttcggcgccctccccaccccggtcctccgtcagttctcggcctcttcaccttcttcagatgatgagctttgcagccccacgagaacaggagaacaattcagattcacttcaaatggatagcatcaatttgaacaataaaggtgaacgcagtatttctgatatttgatttacttaagtcttttctaactcatgaatgatatgtataatctgtactgattagtttagaaactcaccaaaattttgatccgatttagttgatcaatttgcaaaatccaataagaaatgggatgagaaatttgattagttcgcagcaaaaaaagaatcatgagctaagtttaaaatcaaatactagcagtacgagatctaaattggaacatatagttatatcctgtttaaattcagaactagtttactaatttacatgatttcttatatgtggatacaaggttacaagtcaaattacaatacatttctgataaaaattacagaaaaaaactattgtaatttttggttgaaagcattttacctgaaattacaaattttagcagtgtacattttgtgaaaattagcaatacaatcaaaataaacttgtaatttcaaacaatgtttacagaaagaaaattataagggttgccaccaatcatagttgatagattatttagttgataaatttttggttgaaagcattttaaacacataaggtttagtatatttgaaatttgcaagttgataggtgctaattggcacactctaattagtacactagaatatagcagatcttggtgctaaaaagaaatcaaacagtttttttttttaaaaaaagtacgtttagttgaaatgccacaaaaggtaagatttgtggaaacatttggaagatttaaagttgttggaacaactaaaaaatacagttaagttgttggtaacaatatttgagtacatcttttagttttatcccaacaaatattcgattacaatcgcttaattatttgaacattacatccataaggcgtacagaaaacacaggacacgaacaagggatttggatccggtgcagttggtagtgtgactgcaacttatgcagtccactatcagctgttagatccggatccaagggctaacatgcgtccgggtactgtagataactgtagcaacattgtttagtactgcttttacattcactgtagctaaggatctagtccgttcatcaacaaaatagatggctccttttgcttgcagtagcttaacttgcagtccatatacaaactgcatgcgatcccaattcacgaagaagatatactaacagacttgccgatcgattcgatgagcatatacggttgacttgacttagcctataaccccggtggatcgaacaacgggttactacacattattggaggaaaagaaagttcaaaacggaattgaaacgacaggtgatcgcacacacatacatatatgacccaaacaggcctggtgatcatcgacgtggcaattaatcgaggaccgcttgaaggacgtcgagcaccggcgatgccagcccgccggttgctaggtcaatcgctatcatgaagcttttcttgaggagaaacttgctgacgctagtgctgcggctccgctcaacaacagcagtagtgttccgagcatcactggtagtttggttggcaccgctgctggtgttgccggtgccctggccacggctgctactgttgttctggttggtggtgctgccgctaccctgaccgacaccgcttggcgcgccagagacgcacccgatatgtagccgataagacggagacgtacaagggccacagatgtagtgccacacgggcaaacgttcagggcaagcattgcagtgccctgaagaaggtaccatgttgaggtcgtggtgtgggtgaagcgggctgcggatcgtctgagggagcaacgtgcacagggggtgcacgtcgaacttgcactggatgcagcggtacacgaaatttcctgggggacaatgctccatgcagaggtcacatacccatcctttattctcaggaggcatgcggcagagcgtgagggtgtgccacgggtgggcgaagaaggagatggtctccttgaagtagtcggcgcacgcctcatggatgtcgaagtcgcaggcgttgcagcggtagccgacgaggccggagagcttggcttcgcagatgtcgcagacatggcgcgaggcgctgctgtacggggtcttgagaaggcggtgttgtggatgggcgaagtgtgttatgtgggcatcagttgccatgtctttggctacgctcagaacgcccaatctctctcttggcctagtttttggctacagtactgtgttctactacttagtatttctatagatcgatcagactactccacggttagtgtctgcctgtctggcttcggcgtgcctctaggcgctcagcatacatttataccatcttcacaggctcacagtctactgcagtaattaatgatgtggtgttgtttgactcagtgcccatttctgtatggaaaaaagtccaaattacacccgctaaattattagacgagtgcaaattaacctcctagacacaaaaatcatacatttttcactctcaactattacaccctctaaattattggatgagtgcaaattaacctctagacacgaaaatcatacatttttcactctcaactataaatattttcatgaacgccatattaatattaatattgaatttttttattgaattaaaatccccttaacacaatccaaaatagttttggtcctatattatgacagctcaatcaataattttcataataaatcagtggaacccacctgtaagaagagatggacgggtcctaccaattttttttttaaaaaatattgactagtctatcacataagagcaaaaccaatctaaagtctaggtggtaattcttactcactcactagtttggaggtctaattcaaactttttttcctttccctaatccctagtaccaattgtttcagcgtattatatagtaatatgaccattgacaggtcgttcgtctttatgataaagagcattgcaatagaaaaaatagtcttatatataaacttcttccttataatgatttcaacattttatttaattagtcgcgagttataaaaaaaaaatcaagattcgttcataacgtggcacaatcaacatttttataagaaatttgtatgtaaccaactccactaaaaaaaattaccgcatattctctctctctctctaaacttctgtctttttgagcgggtgtgctgggagcctgggatggccaaactggagcctgcagtttcaagataagcttcgctcgtgtgatctatggtgcatgtttattatgcttttttttacaaacacacgtttactcacccttataaacacacgtataccatatttctacgtgcatatccgaaaaactggaccgacacatatttagattgatgaagttatcannnnnnnnnnnnnnnnnnnnnnnacgtcgcctatcactgaaaaaataaataaccataaatgcgagcatccgtgtcaagtctaggattttgaaatcgggtagattgattctaccaaaggaacctaactaaatgagctatgctcacttcgttaaactggccaattattttttttaacgaaccagcaccagataataccgacatattatatagagtaagagtaaaactatttacaagcatgtttctcttacgcgagttgtgctagttaattagctaggcgaaaacaagctaagggtgtgttctaaaccagggataaaaacaactcattagctgcacataaagcgagaaacgtgatttgtatataatttgagtaataattatttaaaaataaaaaatttatctatcttttttaaaataacctttatacataaattttttgtacgaagtctgtcatttaacattttgaaaaatatgctcatgaaaatcaaggaaatagccaagctgattctaacggggcagtatactacctattgagaatcatctgtgtcatgcatggagatcgtcacactggtcaataaattaacatgcatcaacatacatatagtcatcacattcccataagacaagttgtacattgatcactgtattgttgcaatatccctccacgatcaaattaaggcttactttgggcttggtcgctccaatcaattaagagattgactctgagattgatgatatacaatgttcaattgcgagattagctatcgagactaacgtatatcgatggtgatacttggaaaaagtctatcagtccggcgactataaccacccttctattacatgtgtttacacgttgtttacatcaattcgcttaattttataataactactccgtattaacaatgtgaataagtatgggtagaatataattgcatgaaggaacattaacaaatttatcataatttgtaactaagaatattatcataacaataaataatttagcatacattaccgtgacatttaccacaatctgttgaatttctaaatgttcatttgaagtcatattgtaaatatgttgtaatatgaaaagcccaacccatcttttggttgaacgaaacattgagtgcaatggctacagttatggtttttattcatcttttgtgccgctgctttgtgctccctatgtgcgcaggcgcagccataaccgccttcgctgctgcttgagctccgaccttggctgtgtttagatcgtgtaccaatttttttttaaaatatacagacacacatttgaagtattgaacgtagattaataataaaataaattacagattccgcatgtaaactgtgagacgaatttgaaaagcctaattaatctgtcattagcaaatgtttactgtagcatcatattgtcaaatcatagcgtaattagactcaaaagattcgtcttgcaatttacagtcagactgtgcaattgatttttttcgtccacatttgatgctctatacatgtgtccaaatatttgatgtgatggaaaagttggaagtttgaagaaaaaaattggaatctaaacacggcccttgttgccatctccccggctgttgcatgaccggatgaaccccttatcccctcttatattcaacagtaaacgatatactactaacacatagttaattaaagaggaatatgcaattggtatcgcacatccagtataattttaatcactaactacgatttactttaaaaacctaaccatgactaaagtaccactctagtaagaaaatgggaaattcagttgtgtggtaattgcaatgtgctcaaaatagagctaacatgttaaaagagcagaataaagtcagttcgggaggattattatttctatttctcccttcttctagctactttcttcctgtaagcagaatgaaacaattagtatttgctcctcatttttttatagtcaaactaaaaattgaaatatatcgttgtgttaaaaacaatgaaaatggctggtccaacatgatagaatatattgtgttcctataagctgcaaaaacattaacacatatctaaaaaaatgcagaacaacgcttccaatttgtaaactctaaatactacgatcattattatctgctatgattcaaacatttataatttgatcttccagtttttcagaaggtaattaatttgtcatgtctaacacttcagcaacttcttaatttccaaatacctattattagcaaggagaaagaagaacagggttacctaaaaaggattaaatataatttgaaggacagatctttgcccatctctatatagtaaacagcgtgtgtgcattcatgacaacctaaactttagtactgctatataaattggcgtaaagagattccacactgaggattaaaaataattttaaggacagaggtttgtccatctctaaatacttttaaggcaagtttatgacaattcaaagatcaattaattaatttagaccagttccaatgtcgatctatataattggcaagagatatatatgaatatagtaacacctattgctccaaacaaaaatgtgaaactctgaattaaggatattatatatctcttgcccttgactaaatcataggccacgatcagtgagctagctagtgagccagtgagcgtacacgtcgaatcattttttttttataatgaaacaaattttgacctttattttgaagaagctataaccattatgtcggatcgattagtagtgcacgtatatatgctcacctgtcaaatcttgatttggtaagtaacaaaaacacataaacataaattaatatgtcaattagcaactattcgcaataattaacctattggcttagctaggggacagaaagtggtggagctagaaaatttataaatcctggacaagcctaactaaaacggtaaaatcactaccacttatttaatgtttatatgctcatttcactatcaattgaagacacaacaattttctaacaaaaaaaacagttcaatatgcatgtaaaatttcactatagcttgaaaagcaagatgattttattataaaatagacgattcatatgcatgctagttgagtaggtcacgtcctccattacgagacaggcaaatcaacaacggtgtttaggccctaattgtatgattaatgaaaagtcagcctgctcaacttgtccggaagtcaacgaatcgatggattttaaagtagataaataactccatctcgatgggtcagcatgcgcagcccgggcaactgcccatgttggccaggtagttaattaatctgttgctggacagacaatcatcatgggcaatttggcagttgacaattaacaatgcccactagcattctactcctaattatatagcctacttgtctctcccattgcggattttgctcaaaagtactccctccgtctaaaaaaagccaaaccctgagtttccgtgccaacgtttgactgcccgtcttatttgaaatttttttataattagtattttcattgttgttagatgataaaacatgattaatactttatgcgtgacttatctttttaattttttcttaattttttcaaataagacgaacgatcaaatgttgtacacggaaaccatggtttgtctttttttggatggagggagtatgcatctatgagcaagttcaatagtatagtccaccactagctccaatttatctatagccgatctaatagccaattcatacaatagttgcttactatactattaacatatggtcccacctgtcatacacacattacatcttggagtccgtgctgtagctggctacagatctgtagcccgctgctcttctctctcatcttttatctcattaaaatatgtttataactggctagtagcccgctattgtacgtgctctaaaaagactcttcacagtagcaagctagcatagacatcttgtgtcgttcttctccaatcctaggttatacatacctttggttcgtcttcaaggctcttaattggtcgttggttccgcgcgtctttgagacaaagttaggtaaaatttttcacactttgcatccaaattagtttgtttatatagtaatgtgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccgcgccatcgagctcgtactcccccaccttctccgcgccaaagtcctaagcggggggaggcgctcgagagggttgaaaaacccacagcatcaccagtcgcaggtgatgcaggagagcggcgagacggggagcgtcgcctcctcgtctacggtgacggcagcacgccccagggagcgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccaccaccaggacctccggcgccgccacctccggctctgtgtcatcaaggcgaagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccgcccgcgtcggtccactcctgggaggatttgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcgcgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagat

SEQ ID NO: 61079 - DNA, 2059 bp, Oryza sativa
taaagtttaaatttaacatttacaaagtttgtaacggatcaatttatagaggttgaatttaaacctgcatgttttagtgtgatatgatataacccatattattatcttaccttttcttttaaaaaaatgataattattaagttcatatgtaagaactagctaggattgtcttctggagagatgaaaagtcatcttccctaccaaggtggagtatatggaaagtgatttcatccctcaaggggatatcctcctgtttttggtaagataaattaatatgaaatatatcagtacacaaacacgcaagttaaaattcaacttctgccagttgtaacaaagataacaaatatagatgcgaaagtacgataattattttcggtttaatttgttctttttgttgtaacttatagatgtcgaatttggtcttgtatgtttgtggattcatattaatctatgttgtcaatttttttataactatttaactgatatgaatgacgaagaaatatcccctcaaggaatgaaaatccattcctgaagtatatataattatgtacactgcattgcaggggtggggtttaggagtaaggtagctagggttgcacccctactcttgaatctaaatatacattagaactgtaaaaacttcaaaaagtagagaattaaaggcaaaactatgtcaattacattagttgagccttagacttggaagaatcctggttctgctacacgtactgtatagtagtcacactgctccactcgatctctgtagccggccttaccgtatacgtacgtaggcataagtatgacatgtacagggatgggctctatatctcctgatgcgtcacttgtcatgcatggacacacacatcaccagctagctactgtacgtcactccactctctccatgagtcttctcgatccggtcttctctactgctctcctctacgacgaccttcgtacgtgcaaacattttccattggggcacgctcacctgatacagtccctgcttttatatctgaaccctgtactcttttttttgttcataccatacaccaaaaaccatcatacatcaatttggccggctatctcgtcgtcttctcacctagcaagtcgatcctaacacagagatcgaactagtgagagaattgaatcagtgagagattcagaaatcgagagagagaatcactgagagagctagaggtgtgtacagagagaagctggagaaggggacaacgcgccaattccgatcgatcggcggaggcgtcgcgtatgcgtatacggacgaaagcgagatgcgtgcggtgcgtggacggatgcgtgcgtggtctcggtctccgtctccgtctaccccctcctcgtcgagccgcgcgcgggtgggctagcttggcgccttgcgctacctcctcggagtttattttggccgccaccgcgcgcgactgacgagagaccccggccctcctccggcctaatttcgtctccttcggctgcatcgtcgtcgtcgtccccggccggtcatggccggcctcctcctgccgtaccagctgggccacaccaccgcagcagctgcctagcgaagaactgtgccacacatgtacaagccggccacaagctcgatccatctgctgtgtcgggttacgttaccgccagtaaccgcgcggttaccatggttaccagtcttaccgtgaggtacggtaatataattaccgcggtaacctccttaaatttaaataaatttaaaaaataatttgaacttttgataaattttacatgatttttcacggttaccgcttaccaccggggcatggtaaccccggccccggcggtttgggaaacccactcacaagagagggagagattgatcgatcgatgcatgatccgcatcgagatcgatatagaccagcggctattaataattctggatttctgtcacgcagagataaccaccgtgtatatacgtgctacgtactgtaaaccagtagtactataccaccagtgcactgttcaaggccttgatttgggagcggcacagtgctgaagcatgcagccgcgcctgtacctgtac

SEQ ID NO: 61080 - DNA, 65810 bp, Oryza sativa
  unsure (1)..(65810): unsure at all n locations
ccatactaacattgtgttgaagtcagcacacataacctattacgttggaatggtaagtagctagccctcttccgtaaaactttgggtatgagagaagtggctctcgtatggaaaaacttttataagtccgcaactaacccaccacattatggtgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggcctcacgatcaccgacgggaagttggggtggttcacggcgtcggggaacccctgcgtctccaggcacagcgcgccgtactgcccgtacgccttcccgcccttccccttcacgtcggccgtgaggaagttgccggtgtagaactgcaccccgggctggttcgcccacagctccagcgaccgcccggacttgccgtcccggacgacggccacccgccgcagcgcgtgcgcgtgcgcgtcgacgtcgtcaccgccgtccacggcgtagttggtgtcgaagccgtagatggtggcgcccgtcttgctgaggccgcccgtcaccaggtggacgcgcgcgcccacgggcgtcggcgcgcggaggtcgtagggcgtgccggtgacgggcgcgacctggcccgtcgggatgagctcggcgtccacgggggtgtaccgcgacgcgaacagctgcaccgtgttaccccggatgtcgccgctgcccgtgccaccgaggttccagtacgagtgctgcgccaggttcaccggcgtcgccttgcccgccgccgtcgcgttcatgtgcacgctcagcacgtacgggccggacagctggtacgtcacgtacacgtctagggcgcctgggaatcctgttcgacagaggcataattttgaccgttaggccctgtttggcacagctccagctcctaactccaccttacctagagctggagttatgccaaacggttcggattcatccaaaagaggaacggagcagtgcagatcgctccaaaaaattacactagcgtggtggagcggggaaaacacaactccacagctccactcccagcctgattacagcgctacccattacttttcgcaaaaattataagcagaatgccaccgcccctaccccttcgttccccaccgcaccgagccagactagcgcacatcgcgtttctcctcgaggccgcgaagagagaagggggagggaggactgaggcagcggcggcggtagcagtgaaggcacacggcgcatggtggcggtggtggcggctgcctcctctcgcacagcaagggcgccgggcggaggtctgggcggcgctgggcggaggtcagggcagcgcacggcggttggatttggcgctgagacctcatggcggcggcacttggcggcgggagcggctccccacagcgaggaggcgcacggcaggagctgggcgacgccggtggcatagcagatctggtgcaaggagcaaggtaaccctaaaccctggactagctccctcaaaccctagactctctctcccccaaatttctcccgatctgtgtgtattgcttgattttagtttgtatactttaaccatattctcactatacttagatttctagaaagaattggtcagaaaaatttatatgtatgtggcaaaatatgtatttggtagcattacagttgtttgtcatttgtagataacattgcaactatatttattttttttcgggggtaggaaatgactgtataagaattcaatggtatgattcatatagtgtatgaatgagagttttattttttgggtttctaaaccaggcagtaagtatttcaaaattatgtgttaaattggaaaacaaatgtgccaaaatagttgttctaaatcattttacaatgacattgtgcaggacataccaggctgcaccaaatttattaagactggcttgcaaaatgaagagctacttgagaagatgtttgaagatatccgcaataccggtgctaaccattggtctttggggcaaggcaccataccaacagccatggatgcatttcgtgattacctagccggtcgtattgcaggttgatggacatatatcgtattttgtgttgttttgcggtcttatgctctatctttcgatgataatggtactagttattattactaaatatatgtcatgcaacaactttaatttttactttattttggagtaccaatcatataatgattgattgaatgtgttcccccctccctggcaatgaatggcagtgggtagctagctcgtttcttgttgtcttttaaaaacaaccaagacaaacaagggccgggcagggcagtcagtcccaatcaatcgatggtcaaaatggaaaagaaattaataatcaccgtgctgaaattattaaggaaatgaaaaagaaattaataatcaccgtgctgaacttattaaggaaatgaaaaataaattaatattcaccgtgctgaacttattaaggaaaagtatctattattaatcctaagtcagcaatgaaaaaacacaagggtagtattgtctatctaccctctatcctctctttcaggatttttggagctgagcaagcaagttagccaaacactttcagaccacctacagctcctagtggagctagctcccactggagttggagtttggagttaggagttgagagctgtagctctaccaaacagggccttagtttgactcagtaaatactacggaaatggattaaaggggtttcaacaaaattgcatttcaggtcttttgaagttatcttgtttgatccaatccaaatccaaggtcaagttcattgaattgtcatgtaaaaaagtcaaaagcatattgcatgaaagtgcaaagatagttcctctattttaaaatatagcgatatctaaataagacacgatcttatactgcgaatttggataatatgttcgtgcttgtaaaaattatattgtgtctaatccaatactaaattgttgtattttggaaaggtgaaagtagatgatacttctgctgatttgcattgaccataccttgttctccgtcaaagctatggtagtacagtgtgatgtatggtgcgtcacctccaccaacatgctccttcactgtccatgtaacattgctgaaacccctgtgaccaccttcagaaaaatgagataaaattagcttactgttcgtagagatgaaccatgcaccatggatttcttgcacctcgggaaatttctcaagaataccgtgaagtgtgtttttgccatcatttggatacagatgataagcttttccatcgagcacgaaccgcgccttggcaattctgttggctacccgtccgacgagcgctccaaagtaagtagaagaattctgaacagcagaattcagaaggcaaactgaagtgaggtaatttagcatttaccctttaaggtacttgaatacagtgaactcagagctgtcattttctttgatgggttacccagcttgcaattttttttttgaacggaaagcttgcaaatgaactactatgtaaaaaagattagttagaaacttttttgcccttctgaaagtaggtagactttgtcaaaaactcaattggtctgcataagattttgctcgtgcttgtgctgctctgttcatgtgattggattgtgatttgggatagtattatatgtagagagaagtgaaggttcagaaagaagaacagaacaaagaaaaaaaaagtatttatatggctattgcaaaagtgcgggacaagtaataactaggcaacacaccggcatcacatggtgaggttgtcagctgtctctctctttcgtgagactgatatactatttcttgggtaacaaactaacatggccactggcttaaagaaaactgcatccatctaatccttttgtcgatcatatgtttcttgctatttcttttcctcttctctatgcttatgcaactacgccataatattgaattttcctagacgtggcaacagcatctctatttgtgtcaattgtttttttttatctatcttggacctccatgtttgaaaactgaccccaaactgaaggcgacaacaaaggtctcgtgagagttttttaaaacgttcaaataattgagagcatttttatgggatagtcaatggccaattaagttgatcatccctgcttctcgggtccagaaatgtagcaggtgattaggtgaaattgaaactgggtgatgagcaacagaaaactaatttgagtaaactggatgcagacagaagtgcaaaaaaaaaaaactcaaacacacaaactatcgctatgtaatgctgttctacaatccatatcaaacgacaatgaggacagggaactatcgctatgtaatgaggtttcacaagttgtgtgtagaaacaggtaagtaaacagtgaaaatatgagcatatgcactgccttaaaagaagaacagggacaatgaggtcagcaaatcttacaacatattcagcaatggtgtcatatccaagaacaacatcgtccaatttccctggcagaaaacaagtctccaaagtttcagctcgaaacccccatgaaacgagcagagaaatcacgaggcaaatgaagctctggtgtccttgacggagagagagagaggctcacctctggagtcaggaagcacgacggacatgatgaccgctccccaattggtgaccctgatggagaaatctcccttcctgagctcatagacgccgaccgtcgtcgccttcctctccgccgcatcggcaccgccggcggaggcggcggccactaggcacaccgccgcgagaagaagcagcagcggagctggtctagccatcgcccaacactgctctctctctctctctctctctctctctctctctctctctctctctctctctctctctctctatctatctatctatctgcgagtgaggaagacggagacagaagggacgcgacaagctctgcccgggatggttgctggccttggccggatggacggatatgtaatgtagtcaaaagcgtagtagtagtagcaactagcaacttggggatgcgataagatggtgacaaagttgaagtgttcgtgtgtgctcccaaggcgtctccgagaaaatgtcgcgcgcgagccgagcgcgcggggccagcgcgagcgatttgtccttgactcccgcgcagcgtgcgctagtgtttttgcacagcgatccggggtccagcgatcgattttgtcctggctctcactgcgatgcgatgcgatccgtgcccacgcggccggcgtcttccgcggcgaatggatcgtgcacgatcgatggtacatggacggcgacggcgtggtgcacggcgaatattcgctcgcttgccctgtgatcttagatgatgagctgaatgattgatgagtttgatgactcgctcgctggttcagcatctggatggcttttgtgtcgatgtgccatgtagtatcatgacctcgtgtctacttttgcccacacggcatggtgcacgtgcaactggtacacactttgccaccgtttgatggaatggaatggaagggagaaaaaagtgtagccgtatcgtcctagctgcaaagggaacgcctgggcaccaccaaatgggcatgggggcaatggcctttttgttggagcaacgtggctgtgtagagaaatgcagcggaagcaccgagcaccgtagtgaggagaaaggtgcggaccacaactccacaaaggcaggcccaaacaaatggcacgcggccctggcccatcatcgacaatgcgacagacaaaaaaatacaagcaggcacgcagacccttcaagacttttaactcgccgttcatcatccggacctgcttgacaaggtaggagaacttgaatatcttaaactaacccaaattaatctgtaaaaatccctacatgcaatgcccgctattctcttcttttcgagattaacaaaggtcttaaagagtaaggaaccacaagcaagtaataacacaaacaggtaaaccaatacacaaattttattgccagttcctccgactgactaaactgacatgagaaggtgttcaggacaattgccacggacatgaatgtacaaatgactggactaaagcaaccacggaccatttatctagacaaaggaaaaaaagccaaagaagttcaaatcggcaaaataaattgccttgtttatgtacacaaccaaactaacagaattcggcagccggagaagcaaattcagagcttatccatgtcggcgttcctgaagctgccaccgaggagtgacaagaggccgccaccgtgcacccttccctccggaacggcacagcctccctctctgcccccatgcacggtaggttcggacgacgatgagggcatcatagagcgaggcaccagcacctggggaggtatcatcatcgcctggctcctcaccgtgccgtcgcagtccgacgcggtgctgatgcccgacgacgagtactcgttcgtcatgctgctcgtggcagcgacggtcactatgccgctgaaaaggcctggcgggatcatgcccgcgccgttgttcgccgcgtcgcgctcttgctgcttggccgccaaggtcccatgcgcggcgcacaggccgctcctgccgcgggcgaacttctcgcagcccgttccccaagtgcaccgcttgccgccgccgtgggctttgcagaagtccgtgctcccctgggcgctcttgctgcagttgtcgaccttgcacctcttgccaccaccgtgcttcacgcaacagtccgtgcggccacgggcactcttggtgcagccagccaccgaacagcgcttccctcctccgtgcgccacgcagtactcagtgccaccatggacgctctttgggcagacgccgccaccttcgaacatgcatcgcttcccgccaccgtgtgctttgcacagaggcgtgctcccctcagcacctttgctgcagccgtcaaagatacaccgcttgccaccgccatgccctttgcagtacaatgtgctgccttgagcccccttactgcagtccgggaactggcaccggcggccaccaccatgagaaatgcagagcccggccttaccctcagcgctccggatgcaaccttgcaccgtgcatctcttaccaccaccgtgcttgatgcaccgcccagacttaccccgtgcagctttaggacagccatcatgttcacaacgacgacctccaccgtgagcgatacaataatctgtcttcccttcagcactcttggtgcaaccaagctcctcgcaccgccgaccaccgccatgggccttgcaataggcagtgctgctctctgcacctttatggcacccaggcttatggcatctctgcccacctccatgggcaatacacagccctgatgcgcctctcgcacctttcgagcatcccttgaacctgcacttcttgggatgccggggatgattcctttgttctgatgtggttgttgccgtgacaacgtcggagctcacaccaaatgaagtatctgtcatggcagaaggctcagggctcagctgaaggtgatgttgaacgtgctgagtgttatcattgtcgctgtgcgtcaggtctagtgaatcctgggtttctgcttcgtgggtctcattgacagcagaagaaccggagcgtggagcaaagagtagggatggcatgtagccaccgatgctccttacagaaggagatgctgaggcttcatcaacaacagtaaaagaatgaactgttccatctggtgcttgcaaaggttgaattgtttgagaaacatccatttgaaggccaagcctcaatgtcccaggatcggtgatagtcaaaccctgtccagataacgaaggagcttctttaagcttgtctactccagtgggctgacactctgcagagtaaaaattcggcgttggacccaacccaaggactaacctgcaaccatcatctctagttgtgatgctatcaatgcactgtatattttgattaccatggccataattagccattgcagatcccaggcagtccatgtggggtgtgcttttgccaaggttcaccatgtagctctgagctgagggttccattaacacaaacgggttattcattggaggttgatttgggatatccacaaagctgttatccatcacagcttgacaatatgacaacggggtgagagcaaatgacaactgaatcactgaatagctgaagaacagggaactgatgatctttcaaacacagatcacagaatagacaaaatggaagaatatcagcaggagtgtagtactgaagcaaccaccactgacaaagcctgaggtgtctgcacggtccatgcctgtcttgttttggttgaatttatgatccaatgctacttgacctccacagcactaaacaacatctttgatagttgacatcaagcataggcaggagcctcgaaatgcttactggttgggaggtcctcaactgacaaaagcaaaacaaaatattaaccaaaattcagatgtcaaatatatgtttggcgtgaccttattaaaactattataataccatagacaggtcaccaagccagtaaagcaaaccacaattagtgttgtgcaaagattaaataatcagaagtgaatacattttattccatccattcaagtatacatggcgtgctttattcacacacatgttcaactatatagggtaacacagttttcgaagtgattttgcacatatttgcccatacaaactccttttagcagcacagcattgaacactccattggttcctaagcaactctcattaatcaagtagttgatggcaacttagtcatttgtgctggattcggtctacaagtgaaaaggaaaacacaccatatatactagaactgagagagtacaaggaaactgcaattatgaagtggtttcaagcaagcaaaaatagtagccgagatcaatgcaaaacaaactccaaacatgtttgattggtaaagctacatgttaaattattattaagattatccttttgggggcataaatcatttaataatacctttaggtaaagaagattgaagggtcaaagtgagtaactaacacgacaaaagtctttctccagaaaggaggcaaaaatgtggagtctatttaatttgagcaacagcatgcacaagcaactcccgtagcaagaatttgcacagtagaaatctcaaaatattgacagaacctatctgccctttattatactcgtaataccagccaaccaggtgctacctttgccgccttgagtgaaataaatggtttaaccaaggccaagcagtgtcaataactcaaaatgaggtgatcgataaaccaggaaatcaaccacattgcaatgcgcaatctacaaaggggaatagtatgaagtaatgaaccctcatcagtttacctaatgagtacaataaccaagatcagcagtcataaatacatgttattctccatgaaaaggtaaccaaaagattggatagaaaacaagtaacaaatgtctctgttttttctttcttaaccaaaaacgactgtcatacatttttggtcttctgcatacgactgcaagacctgtgcctcttattacatatctaaataccataacaattcaactttcctaaaatcatccacacattctataacattcccaacagtaaaaaatattggattacactgaacatatcattcctaatacaggtgcatttctgactgactagaagggttcagacttaagcagtatcaatttaaaaatagatgcctaacaagtactgctcaacaaagagcatcccgaatctccctttggaatattgtatcacggattgctgagaagtgcacaagatcactacacgcaaaatttctaatatccaagaattccagtccagaacagttagttcattcttgtcctaatattttttttttctgaacttcgcctgattctctcctagtcctaggtacggagtactattatttagggtctcgtgtactagctaaccaggaagataagtccatatactgcaacaatctatctatgtacttaactagttagattgagagtaaatagtaaaagaaaagaagacagggaagagaaaacaggaagaaatggaagaggacaggattatagcgctaattatctaagaatacagggttaagacttaagagactcagagcctcagaccatcacaattgcagaacatcccaaaacaacaagaactaagtatcccaaaatcaggaaccttctactccatcctgaaccttcacagaaccccacaaaatcctgcaattctcctacgacaacaaactagaataccatggcacagaacagatctgattgtttcctgaaaaaaaaaaacttccaccaaaccgaacatggcacacatgaaattccccaatcgggacaccacgaggggcgacctaaaagggggactgggaccaacaaacccatccccgcaaaacccctgcagccatgacatgcgaagagaaagggaaggcaaggacgtaaacacataatcgcggtgagatggagcaggcttgagtcaccttagcgcgcgagagcggaggaggagagggaggaggggtctcgctacggagcggggcgaggagggcggggagtcgatcgctgcgggcggaggcggaggcggaggcgggggcggaggaggcggtgtgttttgctgcctttctggtggcttccctagtgcgcgagaaggggagaagtactggcctccgtgtggagtatgtatggaatgcgggtgtgcggagcgagggggaaaaatcggtaggagggctcgtcgcgtgtgcaggtggggcgggacaggacgggacgggacggcggggtggggtggatggatgacggcgggattacctggcgagcctggctggctggcaggctccgctcggcggctgcgcgagccagccacgcgaccgaccggcagcgacccagctgtttctttgcccttctttttcttaatgtttttatgtgttgccttgcgttctcttttttcctttttggttttggtttgttttgtatctggccggatatcatgtggtgacgaactaacgataggctttagcctgtgggttggattcatccactcgccatgataaggtgcgtcatcactcatcatttgcatatggattaggatgcgtttgagagttgtttttcgcgtacacgcttccaaactgttaaacggtgtttaaaaaaaattaatagaaaaattactttaaaaatcacattaatctattttcaagtttaaaataattaatacttaattaaatacatactaatagtttacctctttttttatcttcttaatattttttatttctctctttcttaaacaggaatgattacatgggatctcatcatggactaccttttacggaggttgaaatcatcccacatctttgcctcctcctcgtgagtccgtcactgtcctatccttatgccatgcgctcgcgtcccgtgccttgagcagaggcgcgggcatcagttggtaggaaagaatggcaacaatgctagtaggaggtagtggcatcaacatcggtattagcgaatgtgacactagaaggcaacgacataggcaatgaagttggccacagtagtagcaacaggaagccgaggagaaagggagaagacgaaaggaggtgctagcagcatgcggctcgttggtccaccaagtcgaggcaatatgtgtcccctcttgcaccttaatactagataatatatcgaatttgttactccatgggtactgtgggtaccaactggtacctcagaggtaccaaatctgatacttgttgatacctaggatagtactatgtccgataaccgtaggtattagctatgataccacaagtactactcgagaatgatgtgtcgcatgatgtacttaccacaacaccgacgatgagcatgacggcttcactgccacgtagcccgctaatcaaagctccagatccagccgcttcgttgccctccccctctatcaccatcgacaaagcttgggaggaggtgcttgtgctggccttcttgacaacctccctttccccctggttgtccccttccgccatgggagtcagatattgtggatgtcgccatgcctcaagcatgagacagaggagaaggccatggaccgtcgtagtccactgccctcgtcaccgacgtatacttgggtcagatccggcatcaaggaggcctagacctccagatccggcgtttgtcgatggcccagaatgcctccatacctaaccatagattggtggaggaaggagaagagggggagcacgggaggggaacgataggaagagagtggaggagaaaaaagaggccaaggaagatgagagggcaacgcaccgtggtggtgggcgttaagtatccgcacccggatggaacatcgttctatagattatctaaagtgaagggagaacttgcttgtgatttggatttgagaaaattccttgtatgcccctagaaagttacctaatcccttgtatgcctctgaaacttacttgatccctttcatacctttgaaattttgatttgatcccttacacgtctctaccgttaggtttacttcattccactcgttaatttggttgaaaatgtccataatacccttcaagttgtaggagctggaaattgagcgcatgtttggctgtcaacttgataaaagactgtaatattcatgagtgcacactgtgtgttttagagactaaataattagtacatacaatttttaacataaatttggaagaagaaatttaatgtgtttaccttatagcattcagcataaattaaacataaaattggtggaagaaatttaatagtgttttatgagactaaataattatgacatacaatttttaacatgaatttggaagaagaaatttaatgtgtttatcttttgttatagcactcaacagaaatttaacataaatttggaagaagaaatttaatagatctttttggtgatacgagaaataccataaggagcatacaaaattatcaggagcatcaattgacgggaaggaaaaaaaacatctgaagcatccatacaccatcagggatacacaattaacaatttgattaattatggtgcatccatacaccatcagcattaagcaaccacagatccattgatttatacatcatgagcatgacggcgcgagagggtggtgggacgtcgagagctcgtgtatccaggtgccgaggacggaattcgagcactgacgggatgccgaaccgccgctacgacgggatgcgaagccactgccgcgcgcgggatgcagagccgatattgagccaccatcgccgactggatgcaggagccgttgcatgacgggatgtggagcaacgacgatttggagattggaggtgataacctgtggcatttttgtctttcttaaaaaaaactgataagctaacacacgccttcactcgtatatcttacggaaatctaatggtaagggtatgtaaatgattaaatcaaaattttagaggcatacaggggattgagtaactcttcaggacacagaaggaattttctctttgaatctactgacactttgattggctataacaaaagatagaagatacttaatttgttaattatgccagcatagtcggttttgtttttcaaaatatcaatcatttccttatcttcgacctcagtttagctcattggtgccatccaaacaaggaggcaaatgctaaacataaaagatggtgtgccgcgcggccggccggccggggaagggggggacgctagatttggcaacgatgaacatggttcaagtgggaagactcgcataaaagttcaattttagtcttgattgtagcataaacatgataaaggaaatcgaattatggatcgttggttgtcatgcacgatctaaaacattgtagcttggcctaatcgaaaactgtgtgtgttcaatggtagtaaaaggaatagaacagagcagagtaaggaagtgttttacattgatttcgttcataagtggatccaatggcaagcaacatccaaaaccaaaatcgaactgctcatatttttttatgacgtggccactataactttgcgaaaaaaaaagtttacttctttcatacccccttgtcctcttgcacccctataattttttttcatccgaaacttattttttagaactttccatccgaaactctcctgattaatccaacctaaggttccgttcatttctccaataagaattagataaagataaagattttcatctcatattttttaaactgctaaacggtgtgtttttgtgcgaaaactttatatataaaagttactctaaaatatcatattaatctatttttaagttaaaacttaatcaatcatacattaataccatatagttatacgtaaaaaaaaacttaatcttttatcttgagaacctaagtgcatgactcaaatgatctaaatacgacaaacaggctagagcagatctcagatctgcagcggcagtttggagcagtgaccccccatttcatttggccatttcctcccatcgctttcaccgaaaagcagggggccccacgtagagcgacgcatggccaagcgatccgggagagccgtttacgtgcacaagttgcgcccgttttgggccccggccacgttggaccattgcacgctcgcaacatccctcgtggagcccagaacttgtttggtagcacagtgcctacaaatcctggagccgtgggccacccactgttactcctcctgattgctaccacaagccgagccactgaagccagcactgttcatacgcagcctcggctcggctcggctcatcggcgcgattcgctctccaccgtccgtcccgcgaaccgcacccgattcgccgtgtcctccacttgtcgacatcccacaggccgcctcccattctctagtggcgttcacgcgcccgagacgcctcccctaggaaaaaaaagtaatatctccgtcccaaaatataagatgattggacacggttatttaaaaaaaatagatagaagtaagtggtggaagattgtgattggatgaatagtgagggtaggtgagaaaagtagatggtggagggttgtaatgggaagagaatgttgatggagaaattgttatattttaagataaatcctaagggctaacagttgttatattttgggacggagggagtagcaggggacacactcgcttacataaaaaaacaaaagaaaaacactcttacccacgacacgacagcgcccacgctaaccgccatgtgggccccgcaacctttccctgccccacccgtcatccgccccaccagcggaatctcgcctgtacgctcggctctcggggcccacgccccccgcgcgtcccgccggccggccacgcgtcgcgcctccgattcgctcgtcccctctgccaggtgggccccgccgtcctccgcccgttttgggcctgggcccagtactagcgtaacctagagcctttgccaccgcatctgctgtgcgcgacgacgcgagggcggtggcgtctggtggcggcgcgcggcggccgcactgtcgcggtggtgacgccagccgacgcgagggccgcgtgtttctcttctctcgcttggcggtggggaccagcagagagacgcgacgctttttttactaagagcaagtttaatagtatagccaactattagctctaaattatctatagctaatgtaatagccaattcatacaatagttgcttattatactattaatatctggtcctacctgtcatacacacattacgttttagaatccgtgctacagctggctacaaatctgtagcccgctgctttttttctctctatttagctctttaaaatatgtttatagcatgtttatagctgacttataacttactattgtacatgctctaaaggctaaaggacgctgctgacgtctcctcctccgttggcttggctccgtgcgtgtactggcgatcgaccacgagaacgacgacgacgagtttggtgggggctcgtcacgccgagacaatcagattttcttcaccgcctggtgatgtaatcgccttttaattaacttgtgagcgtgcacgtttaaaatcctgaagggaccatgtggattgcgtcaccgctgacaacgaaaggatttactagtggtagaggagtacagacaggagaagcttagctttgatcgtttgtatttaaaaagagagagtagcaaatggcaccaaaacatcaccactagaagccagatttgtaaaaggaaatacacaaatagttttgtttgggcaagagaaccttcgggatccacacggtcgagcctcagcttcagctcctgcggcgtccagatcagaaatgagaaataaattaagcaccgatcgagccaataatcgtttggccgataccaatattgtacagcaaattgggccaatagcattgggtcaaactggtttaactactgatcgaatcccatagattggtgcctgcctaccgtgggctatataatcctgtatgcaaataattggtgcaacctgctatctggtcgctgaagtcgtcactcgtcagttactagtcgtgtcacttcaaaaataaatcagttaggggtatttagatctagggtgtaaagtttcagcgcgtcacatcgggtatcatgtaggatgtcttatggggtgttcggatactaataaaaaaaactaattacagaatccgttagtaaaccgcgggacaaacattaaacctaattaatctatcattagcacatgttcactgtagcaccacattgttaaatcatagagcaattaggcttaaaagatttgtctcacaaattagtcataatctgtgcaattagttattttttaacttatagtatttaatacttcacgcatgtgttaaaacattcgatatgataggatataaaattttaaggtggaatctaaacagcgcctcactttaccgtttcaagcaatgacaaatggcaccatcgtttacatgtcacagattcaccattactgtaacgaggttgcatcaatccctcggtccttcactaagcttgaatcctttatttacatttctgaaaacaaatgaaaatctccgggccaatttgtctccaaaaacgagccagaatatatgaatatactccctctgtttcgttttatttgtcgctatcagtccaaaccgaaaacatcctttttattatttgacgctctagttcatctctacctgctatcctacgcgaaattccatccttacccctcgcgccctctccatcccgcaaggccacaacccagtctccagtagcgctggcgcgcagcatggcgacctcggtctcgcgtgctcggcaggcgtggcgatggcgaacatgaggagcagcagcaggacgtcgtcgtcgtcgccggcggcggcgttgctgcggtggggggcgctgacatctgcgccgcggtgcatggcgtgcggcgggacgaggcgggaggagtgccgcctgtgcacgcggtagtccgactcccggggtgacctccgggtgccgggcgtgcgccagcacgcggcgggcgccctgccggagctgcggcaggtcgggcaccggacgtcacgcccccgtccacgcctcctccgcgccgccacggtgaccgggtcgatcagaagctgtcgctgtcgcctccgcgccgatggattaatcaaacccccaggctctcgatcgccgccatccgccgacatcgaactccgagctgcgaatttattttgttggcaggttcagtgtccatggaagaccaaacagctggccaatgaagcttgctcagttggctaagaagttgcagcagaggatggtgtcagtcagtgctagtggacagaaggcggtcaccgccgatgattgctgctcagcggcggcggtggaggcgggctcgcgaagagacgggagggaggtgagagaaggtgtaggaagaggggaatgagaaaagggagtatgtgcatacgtgtgtgtgctcaccggcggggggaagcaggatgccggcgccgctacctgtgggaaggggaagccgcagcaagggaggtggggaagagcgccgccgtccccgccgtcggccctgccgtggcgctggggattgggatggggcgccgccgccgcaacgtgtggaagaggaacgaatcggggaagaggaagggcaaaagggtaaattcgcgtgaaccttaatttcgccgaagttgtcggaaacgacaaataaaaagaaacggagggagtataatgcagtatgccctgctggaacttttttcatacagggaccataaaattatgtagcaggaccacattgcaaaggaaggtagctacaatgggccatatatgggctaaagatgtatggttgaaatttgggccgagatagaccctcaacgtagtggacttaaaacggcccaattaccaattactcgtgttgctcctgaaagaattgagaggagtgcctctcgtacctacattctgctctgctgctaatattttttatttttgtgctctcttttagattacatgacactgacacgactgaatgggcccatatgccccagcagaaggtaggctaaaggtgattctgtgaaacatgaaacaaactcctactaaagcttacgcagataaatgtgaacagcacgagcactgaagtcacgcccattgctcaaccaccgtagcgacgaaggtgcttttcctgatttctttgtcattgcttatttgcatttgacaatggccgcaaggttttttcatgcttaaaaagcttttaaaaacctttctttggcacaagggctcgagtcatatgtataatctactttacaaagcttaattagcctaacatgatcaccctcattttaacatggaattcgctattgaccgccgaaatgaccgggatagttacttctatagatgacatcttctcttctcttcgctgcttctgcttctgaagtcggtgtagcaccacaggtcggggtagaggtagcaggcagctgcatcgagtcatggatcaccagattgatgccgaaaccgttgccagtgatctcatcagcgcgtctctccgcctctccaggcgcaacctgctctgtcgtactccctgtctcctgtaataagccatttttagttattttcatttatctcggaataagtttattttcaaataatcattgtatcggagttcatgaaagtatggagtggttgtattgggagtagctaaattaaagagtaattgcataataatttgataaaataggggtattttaatctttttattttatatggatatgtgtgggatgtgtgaaaaataaatttattttgggacggagggagtataatgcagctgtgtttcctcttcaacgcctcttctagataaattaaggtcccgtttggtaacttgaaagcctgttaatctgttataaccatgggccaacttcaaagcctgttataactgagaggaatatatatttcaaagataacctaatccgaagattgctagatataccaaagctatggcatcacgcccttttcttgcagattcttgcagcagataagaagagaaaaaaaagaaggtacgccggccagaaagcatcaacggaggaaaatttggtggatgagacggagtgacaagtgagctgtgagcaatacatggaatctctcagggttttttaagtgacggctgagtgtggggttgtgggggtggagatgtgcttaccacgtgaacaaccctatatactttgacccaaggctggcaggcatctttctcgttactgtttttcattgtgggagtagaagcacaacttccttttcactgccaactctagattgcacccaagtggatttatcgcagatgcaagctgttgcaaaagcacaactgctttacttttttccccttctataatttgagcaaataatgcagctatccattttcagatatccttctacattagtgtatggctgtatttagttctttaggtgtaaaaactttgaagtatacggacgcacatttgaagtattaaacgtagaataataacaaaacaaattacagattccgtccgtaaactgcgagacaaatttattaaacctaattattccattattagcaaatgtttactgtagcatcatgttgtcaaatcatgacgtaattaggctcaaaagattcatctcgcaatttatgtgcaaactgtgtaattggtttttttccacatttaatgccccatgcatgtatccaaatatttgatgtgacgtttttggcaaaaaaaaaaactttggaatctaaacacggcatatgtctgataatgtctaaaacgtactaggtaccatgcatgtcctgtgttctaaaagtggaacatttggaaacagttaatatgtggcagtatatacaattgattctttttactctctctagggcatgtacaatggtgtttaataacggtctctcttcgttgtcatgcaagtaaatttggtgacgtggaagaaagagaggaaggaatgagaaacatcgttgctacgtatgacaacggctcagagtcgactcttagcatttattaacataaaatttgttgcatgaaagtgcagaaaaggaaagaagtataataaaaattatttagtatattaatggtttagaaatctcattgtctctactattgtaggaggatagtctctagtgatattaattagtatagagagatcatattagactctatatttgtacatgcctttataggctggcctgctaaattttattaaggttgtgttctaaagaaaggttggcctggactaatcattcatttatcgtaagcatgctttgcaaactattaaacaatgtgtttcatttaaaatctttctatataaaaatttcttttaaaaaaatcaaataaactatttttacgctgatggctcgtctcattttctatgtcaccaactaactatccccaacagacagcagctgtatcgaactcagcctaagacacgaagaatataaagtacaatgtgcagtccctatagtaagttgctaatagaacactgttgtcccctctttgttaggagtacatggtattttggcttatcccttaaaatgaaaagtgatacagtactattctatatattcatggaatatttgtaagcaacagaatcaccaaatgctaagcatttctatataacctttattagggggttatcacaccgaagctagaggattgtacgtagtggtctgtgaagtcgtgtgtgtgataactgatactacctccgtcccatataaattgtatttataggttgtttagtatatactaaggtttgagaagaaatactatgatgctccttattaaatgatgtataggtaagagaggaagggtagttgagggtaaaataaagagaaatttgaatgagaaatgattaatgagaccattagtactctattgtgataattattttaagataaatttaaattttcgaaatacaattattatgggacaaatgtagtacgaggtaagatgttttccactgggataacaggtgacttatcagttgctaattttaaaaaagattttactacaatactcctatcttttaaaaagttttgcatttcctaacataacgattaccagtactccctagagatgatagatttatggaatagagattctacaaagattaaatggacaaaatttaaaattcagacaaatactactacctctatactaaaatattactacaacataggccatgtttagttcctcctcttttttttttatgtatacggacgcacatgcacattttaagtattaagcgtagactaataagaaaacaaattgcagattccgcctataaactgtgacacgaatttattaagcctaattaatccatcattagcaaatgtttaatgtagcacaacattgtcaaatcatggcgtaattaggctcaaaagattcatatcgcaatttacatgcaaactgtgtaattggtttttttcggtccacatttaatgctcaatgcatgtgttcaaacatttgatgtgatggaatttttgaaagtttgaagggaactaaacacaaccatagaataaaattttgacaataaatccgcagattgcaatgttttgagtctggaaaaaatacttttctcactaactaatacagcagatatttcgggtgaagtgccgcatgtcagcttagggtgtgtttagttcatataaaattggaagttttgttgaaattagaacgatgtgacgaaaaaattgaaagtttgtgtgtgtagaaaaaatttgatgtgataaaaaagttaaaagtataaagaaaaagtttagaaataaactcggccctattgtcatcccatccctctttttctgcatccctctccatttctaggcgtactactacatttttctttgtggaaaagacatgaagcttttcgaatccacagccacagtgatgctatctcaaagctcaccggggggcggggccgcgggggccatagccacgggcttggtatagtacatttctgatccgaaactctgaactcgaggcggtgtttagttcttcaaacttccaacttttttatcacattaaaactttcctacacacataaactttcaactttttcatcacatcgttctaatttcaaccaaactttcaattttaacgtgaactaaacacagtctgagtgaaccacatcaacaagtacggaacacttagaccgagtttagatctaaactttttcttaaaactttcaactttttcatcacatcaaaactttcctacacacataggctgtgtttagatttaaactttggatccaaacttctaactttttccatcacatcaacctgtcatacacatacaacttttcagtcatatcgtaccaatttcaacccaaactttcaattttggaaggaactaaacacagccataaatttccaacttttccatcacatcgttttaatttcaaccaaatgttcaattttagcgtgaactagacccacccttactacagctctaatggcgctggagacatacgtcacgactgatcctaaaacaaaccatcacatcgacgtgccatttcgatggcacccagcaccgttgccaatttgtcattttcacgaggtcctcgacgacgcgttgaatcttccactgtctttgttagggctagtagtatcagatctttttatattatcaaaaaaatcaagtctttgtttcgttcttgtaccaaatctctcagcctaagaaatataaggttcactgaaagtgacataatgagcaaatgcaaagaaggtaaatttgttccgtagtatttccgtcagacttgcggctgccgacttttctctcttaacagaataaaaatccgcaaagagatacctatgggtaacacacaattgatcctcttttttcatagacaattcacagtctacagttgaattgtgcgtccccccccctctcttacatgcatatgtattatgagctggcagttgaaagtcaatgcatggttgtgatgataaattctagaaatctttttagattaaactacatggatgttagatgcttcctaaactttgaagttcgtaaactgtttcatagatagcccccgtggaaactctgtttcaaagtctcctttggagcacaaaaaaaaattgtacagcttttatagagtatattttttaacatactcttttatttagagtgttgacaaaaactttcaaattctctacgctcacacgagtctcgattaagaatgagtatttcttattacaaggaatgtaactagcttttctaacttctaaatgatattgggctatgttcagcaacactgctctgcagctataaccggttgtgctatacagtcagtgtatatattttctttaccatgcactatagcgctgttgtgcagctgcagtttagctacaccgaacaaacccgcgatttcgagaaaattatatataaaaaaatcattatcaaaccattttaaatacacttttaacttcataagattttgatcattcgactattcagccaagaaaaaacacatatcctaaaatacttctcgggagcgtaattaataaactctagggcctattcactttaatgccattttcaaccttaccaaattttagtaaaattactaaaaaaatagctacatttagtttgttgctaaattttagtaactatataagaaatcctattaaaattttagcaaattactaaaattttagtatttagcatcaaagtaaacaggcgtatagtcttctgagtacaacgcataagcattgaagcaaaagcaagtactactatcaccaccatccgatgggtgggtctcaactctgtcttaaccacaacgcccaaagaggcgtagaccgtggacgtagaccagcacggtccaccgttttgaccggaatccgagctggcacatcacgggccccaccgctcgtagaaaaaacagaaaaaaaaaacggacgggacgggatcctctctctcatcgttcgtcgtccatccatccatccatccatccatccatcccctgcgccccgccagagcagcgcacaggcatctcaaccccacccccagcgcgtgcgtgacgacccgccactggctccccgcctccgcccccccccccccagtgggcccgtccccctgacaaggtggggcccacgtggcgcagcaggtgcggcagggtacggatgccgcaccggatcccgtcatcacgaggggactttttgactgcgggattagctggcctcctgacgcgtgggcccggggacagtgaaggcgagggtaaggtacgtggctagtacgtgaacctgccgtactgcaccgcgagtttttgggatggccgtgccgctgtgcgtgtaccggtttttgggatacttctacaaacagggcacaaaaatgactggactggggggaagtaagtacaacccgtacgaggtgtgtgcgagcgcatgaccactgctgtgaactggagtggcaacgtactggagtactatcaccgtaggaacgaccatggtattgtgtattagatttttaatatttagccattcgtgagatggaacaaacagaaatactgaagtagtagagcatttgattgaaaatagagtttggcacatcgtggtaacgctgttttgctctcgttttaattatcagctcttgaaaacttgtgagctagaaagttttttttttaactcaggtagatctttatatgtcaattacttgtttaaaaaatatatacttcagttagtaaagtaacatagaaaatattatgcgttttcattgcttggggttgttagacagtggccccaccatatgaaaacatgttaaatatggcttgtttcaaggtgagctgcatttactcactccatcccctaagcataaaattaagagttaatgctctattaatagctaataattaagattgactcttaggtaccatggaaccatgaacctaatttgtatacctatgtaaaataaaaaagcttatatataatactactatacatatactaaaataaaaagatagtattatgcacacgaaacttttaaccctagcaaaattatggtaaatatcatttaattcacaataattttttaataaaaagcgctttaccagagaatcttttaaacttacacccatgatacattacaagtttggttttctaagagaacaatataaattgttggtgagaaatttgaaaaaacaacaacagaaacccctggattctttccatgaattacagcatagaagaaaaggcctaataattcatggaccgaaaaataataccagcgactcggcgagaagtcggtaaaaaagacaaacaaaacgtgaaatttgacaagcgagggacagtccgagttctgacgaaacggctgcattcctcgagaggccggagaataattgggacgggcgtacgaggaccgtgtccaccaaaaaaaacccctccgcatcacgcccaagccagcggcttccccatccctcctctcctccagtcctcctgctacacttcgatctcccactaaccccatcacctcgcccagcccgaaccattcccacccctccaaacagacgatctcccgctgacgcgtgggccccacctctcctcgcccccacctgtcagtaaaagttacgcgggcgacgcgcggtaactctcgccgccaccccccgaacaggtctcctttaccaatggaacaatttaggttggaacacacactgggtctcggccaaaattttaaaagtctcgagctgaataaaaacactggtaaaaaaaaaaggagagagagaggagagacaggtcgcttcctgcttccattggagaagaggagaggagaggagaggagaccgagccggcggcggcggcgacgaggagagggagctgatcgggcggtccccccctttgccgaggggacgccggcggcctccgggttgggtccacttggcagcggtgagcggcggcgggggatggcggaggcgcggctgctgcggcggcggcggctgtgcttggcggtggcggtcgtgtgggtggtggcggtggccgtgagccgggtcggcgccaacacggagggttagtgtgatttttcatcgaattcagctccgtttttcggcggattacgcccacccctatttttggacttgctttcggattcgatgaatctattggtcatcgggtgattccgtttgggtactagtacatgttacctgcttctcggtacatatgggcgtggatggattgactcatttaaggggatggagcatacgcccaccgaccttccttttgtagactcgatggattatctaggctatagctctttgttttgctgcctctcatggtgtgttgtgaatttgctcccagcagggagatttgtccgaggtaggaaacgtttcttgagtaagtttggtaggtgtgatttgtatgtgcacagaaatgggatagcttttttttttagataatggaataaatcctgacagaaatgggattgctaatatctgggatgagtttggtgtgctattttggccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaagattgggagttatgcagatagtattgtaagaaatgaaagtactgtatcttataccttcttgtactcaatatatgcttgcatactttagcctgaaaaggcgattgaatttgccaaaattttgacgagaagctactgtcactattgtctacttccttaaatactatgttgctgatgttgagggtatgttcgatgtcaggtgatgccctatatagtctgcgccaaagtctgaaagatgctaacaatgtgctgcagagttgggatcccactctggtcaatccatgcacatggttccatgtaacttgtaaccctgacaacagcgtgatcagagtgtaagtttttgacagaattatcatttttaggcttgtcaaaagtaagaaatgtgatcattttgtgtgttgactgatctattttcctttcgcagtgatcttggaaatgcacaactgtcaggtgcattggttccccagcttgggcagttgaaaaatctgcaatatctgtaagtttacacttccagtctttggagaattatgtttttagttacaccatgcagtagcgtatctattcaagttgtcataatatactgcattgaagcttggttttcaaaactcttggaatatggcttatccttgtggtaaagatggttgtgttgccaccttctttcttgcatttttattgtgaaatttaattatgttgtgactaattacagggagctttacagcaacaacataagtgggacaatacctaatgaactgggaaacttaactaacttggtcagtttggatctttacctgaacaacttcactggttttattccggaaaccttggggcaactctacaagctgcgtttcctgtaagtgtactccactttttttttattatgaatagaattataaattgtgtatatcattgaaggccttcctgtttgaatgatcataacataattctttatttgcatgtcttcttgtaaggatagtcgtcttaacaacaacagtctttctggttcaattccaaaatccttgaccaatatcactactcttcaagttctgtaagttccctttctgctaattcatatttggtgtctacctgtagaaattattgcttacatggtaatagactttaagatggatacatattaacaaaatgtccaataatttatgcagggatctctcaaataacaatctctcaggagaggttccgtctactggctccttttcactctttacccctataaggtgctttttctagatagaatttaggttcttagtgcttactacatcttgtgaggctgacaaatggttatttcattgtcgcagttttgctaataataaagatctttgtggcccgggtactacaaaaccctgccctggagctccacctttttctccaccacctcctttcaatcccccaacacctactgtgtcacaaggtgattctctatagttttaattctgttacatttgtgatactgcttgggatatgcatatgcataaatgatgcagacaggggatttgacatattcgggtggaattaattctattccatcaggtgactccaaaactggagcaattgctggaggtgttgctgcagctgctgcattgctgtttgcggttccggcaattggatttgcatggtggcggcggcgtaaacctgaagaacacttctttgatgtccctggttggtattatagttgcatactgcagttcatgatacttatgttatccatttaaataatctatattctcctttaaattcagctgaggaggatccggaagtgcaccttggccaacttaagagattctcactccgggagcttcaagttgctactgataactttagcaataagaatattctgggaagaggtggctttggaaaggtgtacaaaggtagactggcagatggctcgttggtagcagtgaaaagattaaaagaagaacgtacccctggtggtgagctccagttccaaacagaagttgaaatgattagcatggcggtgcataggaacctgcttcggctccgtggattttgcatgacgcctacagaacggttacttgtctatccctacatggctaatgggagtgtcgcatcacgattgcgaggtgccttaatcttccttactttttcttagagtaaatccattaatagtttcttacacgtttgtttgcatgcttaaacataaatggcacagctattatggttattgaaatcacttaagcactctttttaatttcatctactcacagcatatacctagttgtttcagttgacatatcacattgttcatttaaggttatgactaagactgtaataatgaatggttgagtgcatgccttctgcagagtccggaataaatatattccttcatctaaaaatgcacgcccataaattaattatttcagtttttgagtcgtggtatatgattttgtagagcggcagccaaatgatccgccgcttgaatggcaaacaagaactcggattgcgctgggatctgccagaggattgtcctacttgcacgaccattgtgatcccaagatcattcatcgtgatgtcaaagctgcaaatattctgttggatgaagattttgaggcagtcgtgggtgactttggactggccaaacttatggattacaaggacactcatgtaaccacagctgttcgtgggacgatcggacacattgctcctgagtacctctctactgggaagtcctctgagaagactgatgtttttggctatggaatcatgcttcttgagctcattacaggacaaagggcatttgatcttgctcgtcttgcaaacgatgatgatgtgatgttgctcgattgggtaagtaccaccacatctttatatattggggcaaccatggaagttttggttttgtttttccttgtgcatgctagttgtcctccaggacacatctttcttagctgtgtctcagttctagtccaggaattagaacaaatggttgaaattattggactgttggcagtgataaagcgagctggcagttcagtctccatgtgtcatcaattatggagatgcacgccatgacaaattggcagctagtttttcgccatttctgataccgagacatgatccatctgcacgcatgacttagcaaaattttgtactactacatttggaaactgacaggcaagtaactaaactggtttttgtcttttcaggtgaaagggctcctgaaagagaagaaggtggagatgctggtggacccggacctccagagcggcttcgtggagcatgaggtggagtcactcatccaggtggctctgctctgcacgcagggctccccgatggaccggcccaagatgtcggaggtggtgaggatgctggagggcgatggcctcgcggagcggtgggaggagtggcagaaggtggaggtggtccggcaggaggcggagctggccccccgccacaacgactggatcgtcgactcgacctacaatctccgggcaatggagctgtccggcccgaggtaaaagaaacgaaagacaaaatcacaaagcatccaacctttgctcgacggcttcctcgcccttgtttgtgtatatgacagacagatcgatagctggcaaatctggagggaaaaatggtttacttgtaaccctccctggtgcctcggtaattttcaagtaggctctgcacttggttgtcgttagaaatgcatggccgggcggaattgcaacacattgttgtggcggctctgcgtctgtaatggctgaacaactgatgcctctctctctgctgtattgtacgtacaactctctcttttgacggtgctaaacatcctaggcaatcttttttggtctcccgggtcacaccgtgtccgcctgtactttgttactcttcgttgaaaaactatactggtagcaaactcaactctttatctgaaaaaaacaaggtccatggcatatgcaacggctgatacggacgagctggtgtattgaggttgcaggctggatcaatgatcatgcagccgtgcaggttgcctgtgtgcgctctctcatggtgtcatgcatgcgagtgccagagtgccagaccatcaccagaaccgctacacataaacaaatccactgctgcctgacacggtgttcagccagcgtcccgttttttcggcattttctgcctcccgattagccatacaaaccgttagtgttctgcatcagagaacgccagaacggcctaaatattaggccataccaacaaaggaacaaaatgatcgacaaaagttcacgcccaggttaattacgtactctaccaaggacagccaaaagtgcaaaactataactagccaaaacaaaagtgcaaaagaaagggacgagagctagtgcagcaagcgtgctcgcgtagatgctggccggcagcctacctgcccacacgcgtgctagggcctaggagtacaaaatacaacgcggcattagaaaatcctctctctacctatccacccatcaacgtgtcggcgtcgcacgcacgggcgcacggccgcgcgacgcgaactcggctggctagagggtgggcacgcggaagaacctgccgcggcacatgcagcggtacgcgacggggcacgactccgcggcctcggcgcaccggaggctcaccatcacgcgccggcacggggagcacggcccgcacgcgtgcgtgcagtccggcagccgcgatcccgtcgccgcctccgccgcgttgcccatctccgtcgtcgtctcttcctccggctgtgcgccctgctgcacctggaacgtcgccgtctggccgccggtgcctctgtcgtcgtaggcggtggtggtgctcccgttcgcagcagcagcagatggagccgtgccgccgttgtgtaggccaccggctgaaccttgcacacctgctgcattacgtatacataaaaacgtagtacgtacataatgaacgaaatgtgggcacaagttaaatgcaggtgattcaggccgtgaagggacatgccacatgatgcatccgccgtacgacgtgccatctttactagtagtgcacactacacaggagtagcactaaaagcttactacatgaacacgtgtattcctagtcagattagtacgtactccagtgggaagctctggtgaattacctggtatcgtcctgacgccatcagcaacgcacgagctcatcacgaccactgcaaacgctagcgccatggcactaaacctcctcattgccgccggtgaatccgtcactaaagcaccaacgcgaagttggagcagctagctgatcagcacaagcacaagatcgatcgacacgccaagcagagagagcagtcagcgacagtgagcacgcaagcaaggagaggctcagcgcgaggcgaacgtatatatggccggctgccgacccgcgagcgctcgccgcgtgcgtgcgagaacgagcgcgcgatcataaataaaccccactgcggcggcatgcacgcgctggctcacaggatcctcgacgttggtggatccaccacacgcagcccgtgcgcggctgcgcgcgcgcgaggcccaaagagcggacacgaagaagacgacgagggaaggaggtagcgatgcgtgtgacgggcagcaatggcgaagccccgctgcggcgcccggtgcattatttatgcagcggcgcagggagacgctgttgttataattgcggcacctcggagaggagcaccgcaccggcgagagatcagctactacgcactatacgtcagaagaggccgacgtgggggttcccgtggagatgcattactgtacctgccgctgctactgtttctgaagaactgaaattctgatcgcgagctcaaaaaagttttgctgcctcgtgctttcgacgatgtgcaaaactgcaagtctgtagctctagtcagactgccccgtcaccgttctcatcaatgcgcgcctgcaaatccgttgttgcagttaagagatgtactccaataaatgaagctccaaggtttttgcccatggatatcagaattggattgattgttcgtgctttgcttcttcagtcagaagtattagcttcttcagtttagaatatgggatatgaactgaaactgaaactttctttgcttctaaaagaacagagcctaggagtattagctttcatgacctgatctgacctctttgtgtgatcttgtcatatgttttgggcctttggctttggtacaatctataggtagactggagttttgtactccatccggactgcgttttggagaagcagaggtactatcgtcatcatcctttgcatgagatttgggtcatggatgcatggagggtgagtttttgaatgaagaggcaggcatttctggcattgcctcctcttcaataatggggttcactgaaaggccgaggggaggcttgaatgcctctgctatctggacaattgtgctgctgaatccttattatgctgctttttgcagacctgaaatctgcactttcatgtaaaggaggacggaagaacagtatacagttctctgaactttgttggcccaaaggtgcaaaatcaggaagatttcaccccctcggtgtgatagcatgtaacggttcacccaatgaaatatatgtaagtatgtttttccagcgaagaaagtttaatagaggaagaggacgaaatcatgcggttttcctaaactttcagttgatgaaggattcctgtgttctgttttcattgattataaaacttttgcgtaatatgtcaagccggatccgtggcgcaatggtagcgcgtctgactccagatcagaaggttgcgtgttcgattcacgtcggtttcaataccccgaaccaagccgggattatttttttcacctgtgtacatttatatttaggctacccataatttgttgatgcctttccatgatagcagtttgtttgatcttttttttccctgtacaaaccccaatccaaatttgaattatgttttgcccagcacaatttatttagtctatccacaatttgttgttatcttttcatgacaacaatttgtcgatcatgttttgccgctgtacaatttatttaatgtatccacagtctgttgttgattattttttgccctgtacaatatatttaggtatccacagtttttgttgatatccggattatgttttgccctatacaatttatttaggatatccacaaatgttgatgtcttttcatgataacaacttttcatgacaacaatttgtcaatcatgttttgccgctgtacagtgtatttagtgtatccacaatctggtgttaattattttttgtccctgtacaatatattcagggtgttgacgtctttttatgatagcagtttgttgatcattttattttgcccatgtacaaacccctatccaaatccggattatgttttgccctgtacaatttatttaggatatccacaaatgttgatgtcctttcatgatatatataacttttcatgcatgacaacaatttcttgattattttttgccgctgtaaaatttatttagtgtatccacaatatgttgtttattatttttttgctcctatacaatctacgtaaggatttgttgaagtcttttcgactcatcatcctcaatttgttgatgtgtatgatcgtggtcaaaacaacctttcttttgttgttgcttatagggtgtgtttagttcacgctaaaattagaagtttggttgaaattgaaacgatgtgacgaaaaagttagaagtttgtgtgtgcagaaaaattttgatgtgatgaaaaagttggaagtttgaagaaaaagtttgtaactaaacttggccatagtcatttttgtctctatccttgttcatgaaagatgacatagatctgatgtgatacgtccaatctcttcccatcaactcttcccattttggctgaattcaaacatattttacaaaattcagaacttgtcccaaattttggaaataatagtcattcatttttttccaaaaaaatagttgattttttttgtaaatttttttgatttctacaatttgggacagcttttaaaattgtacaaagtgtttaaaatcagccacaagtttttcaaatttaaattcggtaaggttctccaagggtaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaatacataaagaaacaataaataagggaattccagcggaagaagaaatggcacttgtgtaatttactgactgaattgacacgtgtgtgtcacgtagaataaaaaaccactctcaactaagttgaggtaattccagtggcagagctaggcattttgtgaaccgctaccagacatattaaacagttaaaaaaacaaaaaaaattattatagaagtggactgttagtatgcctggtctcctgcattgatgcttaaacgctgcttaattcacataactaatttttccggcataaagtgcatgcacaaatagacgatatccaccgaacttgcatgcacgcaccagcaagaatcaagaacccatcttgctccactgaaatacattactagatgaggtgattaactgacactttgccaaaaaagcagcaaatcaacacacataaatcactcgaatctcaatggatcgcacgctgagcctaggcaactgcccacctagccgggcggtgaattcatcgctgggtaattcattcggtgtaagagcttagagggtgtaaaatatttggtattggagttgagagaggtaattcatccttttacgaaactagtgttgatgtttgctaagactactagactacgctagttttttctaaggaaaattaatggtaaaatacattgtgtttgactttttaaatcttggaggtgttactttaatcaataatttatggctaattttgctacaggacacttaaattttgtgtaatttgctaggatacatcgtaaaaatatttcatggctgaaagacatcaagtctagtaatttgctgaaggacagtttcaactcaattgaagtgagaaattcttcaaaaggacaagaatgccctagagagtcaaaaccttttgagctgaggctggagtgaagatgaaatacgatgtatgctagtgatgtacttgggatgatgacaaatttagagttgcataatttctaaattttcactctaacgtcatgtttaaagcatgtggtcttatatacattctcgtctttcttaagaatttatctctttaattgagccaaaaatggcctctagcaaaacaccagttttttaaggtgtctcttagacatgacacatttttcgatgtctatcagcaaattgcacgaattttaggtattctgtagcaaagtttgccataatttatactctctttatctcaaaacaagtctacgttcgtatatgaatctgaatatagcacatgtccagatttatatataaaagtgaacttatctcatatatgtagtattaaaataactttataaaatacaatacggttagatatttggtaaaatattagtacattcttaagtacaatattacatacgcctgagtatatactccctctgtccaattttaagtgtaaccatgagttttcgtgttcatctttaatcgtgtgtcttatttaaaaattttttataattagtattttttgttgttacgagaggataaaacatgaacagtactgtacttgtgacttatgtttttaaatgttttttaaaaatttttaaataagacagacgattaaaattggacgcgaaaaaacattgatgcactagaaaataggacggatggagtagtgccgtagagatttgccgttgcttctaatctctttcgcaacgtgttagtggtcgtacttaaggggggtgtgtgtggtttgcgagttgtataggtcttccatctaatcggagaaaaaagaaatgtgccttttttactatacaacgtccaatggtctgacactcttgactgtgtgacagtgtgtgcggcttccagctctcttggcaaatccttccaccattccacgcgattttctcggctcggcagtcggcacccgccatctcccgcgcggcagcgccccgcccgcccatgaacggtagtatatgctccgtgttctcctctccttccctcactctcactctcgatcgctagcccccgcgcgcgcgcgcgcgcgggagcaacggataccaattcgccaagctttttgctcttctttttgtttctcactgtgaccactgttaccgccagctcgacgccttcacaaatgggcggccaccgcgcggctggtgctcctcctcttagccgctgctgcggcggcggcggcggcggcggcggggcgcagggaggtggtgacctcgccgcacggcgccgtggcggcggacgacgggcggtgctcgaggatcgggcgcgacgcgctccgcgacggcggtaacgccgtggacgccgccgtcgccgcgtcgctctgcctcggcgtcgtcagcccggcgtccagcggggtcggcggcggcgccttcatgctcgtccggctcgccgacggcaccgccctcgcgtacgactcccgcgagaccgcccccctcgccgcctcccaggtcagcgcgattccgatcctcccaatcactcgcgtacggtagcgtacaatccggtgtagtcaaagccggcgacttcacttacgtttacgctattcaattacatatggttttctagataatgagttcaatcacatgattcccgactgattacgatgttctaaccactcaacacgatatttaaatggttctaaaccttcagcaatgctgactgaactgaagaattttatgatatcttattacttggatatatatttctctttatctgtcacaacttatcagtaaattaatcaactcgagagcagtcattttccaatccttgttaaaaagcacaagacttggccgaggtctccaggtcgtctgattgatctgtagaaaatgcatggagtaacaattagtcatgccaaatgttactgcttatgctaccactatccgtactagtccactaagccagtgggtagttggttgattcacatggtacttgttgcttcctgatttccttttcttttcctctcttttatgaaaaacgaatgcttctggacctgttctattctattctatcacaacaaattaaacagaaaacacagaaaagggcatgagttaattgacttagatgcacccccccccccctgatagctagcataattggggatttattagtcatgttgcttcagtggcggatgtgccatggagtgacgggaagaacaatgagcataacgagccatgtggctggaaacatatccttgtaggtgaagtctgtacatgccctagtggtgccatctactatgccggtccttgtcttggttcgcctctcatcctgttgaatgtgtctcacgctatcgtccactagccgtctgccccctacatttcgcaccattcatggctggtccagcccgaattctgggaaagccaaatggaatccgagttagggatagcgcctcatgcagcgatacaatcacgtcaatatcagttcgtgttgcttttgcgagggcatgtgcagcattgtagaagcgagaaatctgcctgccagtcgttgatcagtgagagaaaatacacaccaagctgttaactgatcaaacacatgccacgtattgccatgtatttttcagaaaacataattagaaaacgaaattgctaaatggcatttgacggaaaatcaaggggaatttcttacagattttgaaccacctgatttgcttgaagattcgtgcacccaaatccttctccagctccgatgaatccatccccagtatcagggaaactattttaacagctcgagtggatgtccacccgtttattgcatgtcatctaaatggttatgaaaaaaattaaaaaaatatgaataagatagatcaatatgtaatgtatcaatccacaaacatgcaagttaaaattcaacttctacagattgtaataaaaataacaaacaaaactcaaattactatatgtatatttacagttaaatttgttgtttttgttacaacttgtagaagttgaattttaacttgcatgtttgtggagtgatatattacatattgatctatcttgccaatttttttaaaaaattttcgtagccatttagttgacatgcaataaacgggtggacgtccactcgagctattagaatccatccccccagtatcagcgatgacccgcgacaagttagggttggatcctaggttgggatgggggtgggaaggggtatggggatgggaggcagcggcctgcggcttggcggttggtggtggacatgtgagggtggcgaggcaccaccggcggcggcaccgaagccgtggggatggaggaaggcgatgggccagctttggtgacggggcaaagcaaagtgaatgcttaggagagtggtaggtggtggcagattcggtggcagggagtcacgagagacaggaaagatggcggatgaggacacacctcatcactactggcttgaggaggagatcgtttggggaggcctcaccgaagccttctgggcttccagctaggtggcgatggcaacgaagggggtggggtggagttctagtcatgtgcgatggtggtggattgggaagagggagggttagggttggggagaacgacacgaatcttaaagtaattcaatggcctacaattcgaaagatttaggagagtgttggtcgcatggtttaagttaatctaaatgggttttaatggtaagcagaagaaaaaatgttttatatactcgccaagccttgaactaagtgtgtcaatttgagtattgaagtactacttagaaaacaaagcagaaaacaaagcaccaccctaacttttgttaggaaatataagagatatctaggagaacctaatcgtttaaaataaaaaaaaatgttgctctaatttgatccaaagaagactggaaccgaagtggcagaaaattaggagggtatatccacaagcaatcaagtatccatagtaaaaagaattgtcctaattaattttcttttactggtattatcatgctccattctaaacaaacagagttaacgctagaaatgtcaattgtgcattcaggatatgtatggtggcaacgaaacgctgaaagcaaggggagctctatccatagcagttccaggggaaattgcaggtctgtatgaggcatggaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgacagtattaagcatgcctcctccttcagctggtggtgctgggctaatgcttgtaagttttctttgtactaaattttgttcactgttctttggtagcttaagtttgttgatttcaggtagcaaatttaattagtagaatcaactctatcggataatagaacctttaaaaaaatcttaatcttttctgcactagtattatcattttatcttgatacccttgctcaacaaacaggttctgaatatccttactcagtatggcctccctgctggtttttctggctcacttgggatccatcgtctaattgagtccttgaagcattactttgcaataaggatgaaccttggcgaccctgagtttgtaaatgttaacgaagtcgtctctgatatgatgtcccctaaatttgctgctgacctgaagaaaaccatctatgataacatgacatttgaccctaaacactatggtggcaggtaaagcttctcttttgtgcacaaatatgtcttccttttcaagtagaactgtcagcaaagtcctattaaattcctgcatatactagtatactactattactggtgaactaatttagtaatctgcattattacaggtggaacatccttcaggaccatggaacaagccacctgtccatcgtcgacagcgagaggaacgccgtttcgatgaccaccactgtcaacgcgtactttggatccctgatcctgtctccgagcacaggcattttgctcaacaacgagatggacgacttctccatgccggcgaacacgtcggccaactctccgccgcctgcccccgccaatttcgttaggcctctgaaacggcctctctcctcgatgactccgacgataatactcaaggtgaccaccacctcgcgcaatggaaaataacacgaactctcaactctgaagaaagttcatttgaaatgtctgaaaagttcagtcttctgaagatggttttttttgttctgattggtttgtgctttatctgtcgtaggatggcaatctgaaggctgcggttggagctagtggtgggagcatgatccctgctggaaccatggaagtgctcctcaaccatttcgtcaagaacatggacccgttgtcctctgtcatggcgccaagagtgtatcaccaggtgatctgggcttaacgtctgccttttcttctcttcgtagaaattcttctttctgatgagctttggtttgattcttgccatggctgtttgccctctctggctggctgcagctgatcccgaacgtggtccagtacgagaactggacgacggtgaccggcgaccacttcgagctggacgccgcgacgagagccgacctgcggaggaaaggccacgtcttggagccgctcgccggagggaccatcagccagctcgtcgtggacgacgtcgagcgccacggcggtctgaccgccgtcagcgaccccaggaaaggcggcttcccggccggctattagaccggagtggctgagctatagctgcctagctttgatgcagcgatgattgcttgctgcgccattcatggacatatttgtacacgtcgttctgttctatgattctatcgaataaataatactccctcagcttataaaatgttttaactttgatcaaacttaaactgcttcaaatttaactactccatccgttttacaatgtaagtcattctattatttcctatattcatattgatgctaatgaatctagacatatatacctatctagattcattagtatcaatatgaatgtgaaaaatgctagaatgacttacattgtgaaacggaaaaaatagtttatagacaaatatagaaatatttataaacttggtcaaacttgaagcagtttgattttgattaaattcagaatattttataacttaaaacggatggagtaataactgcagtgaattttaaatttttgtttgaaattgttagcgatcatccgtgcaaaataagctactccagtactgttttgtggacacgtttgtcacgtgacacgtcacggtgcgtttgggatattgagatggcccagatatcccatgactactaaggcctggactggacgtggctaagtggttgctcctagtccgtggcctgtgggtttacggcccacttgaatcagaattggcctgcgccggatttggggtttggcacgtactgtttttttttcttttttttagacacactacaaacgcaacaaacgcagacactcaacttaaaaaaaataataataagcagtaaatacaagtattggtgttaagtctaagacttaaacctaggtgaactgatttccccataagaaacttaatcacttgagttatgttaaatttacaaacctcatgctcatagcaggaggaaggaaaaaaaatagcgaatcgtaggagataccacgcgtacatgcatgtgtgcggctgtcgtctgtgagactgtgacccgtgttgatcatggtcggcggcggcggcggcggcgtgccggcactggcaacgtcgagagccactgtgtcactggtcgccgatcgatggaaacgcatggctaggactcatgagaaaatcaagttatctcctgtgttatctaaaaaaaaaagagaaattcaagtttcaaatcctgcgtagaaggagcaaggaggagggcacggacgagacgagagtgagtgaccggagagcgccggcaggcgatcgatcggtgtggagcgttacttccgaagagtggcagctgctatcacaatccgtcgatggtggctcagttaggtacacaaggaagcactgatttgaacatttcatatacgcattgtttcgatccatgtcgactcacaccccactaattaatctattgctagtacaagctagtacttgacttcaacagctaccaaacatgccagttaatttacttgtgacgtatcgctgggaagttaatttttcatcagttctcacgccgggtcaaggctctccctatcggtctcagcgtgcctgtgttgtgtacgtgtcatggcaacgggcaatggaattcatgcaccaacccaaaatcgagagagcaagagagttacacgccgtttacctgctagctaaccaagactccgactcttctattagtacctacacatatggcagtgagactctctctagtaattacagtaagacacacttctcagaaaagaagtacagagcttgcccagagagaaagagagaggtgaagatggaatccatggtagcaggagacctcgtacaggcctacgtgttgaagaaagcctgcaaggagaagatgagggccgaaacaaacgccggcgaggcagcggcggcggcgatgacaggaaagaagacggcggtgggcggtggatcgtccgaaaagaagacggcgcctgaggttagcaagggagaacgccggggattctctgggctgatgatgatgaagaagaaggtgcacccgaagtaagctagcagatcgaactagctagctatcttcaaaccaccactgattgcagatttgcagggcttggtcatcactcgtcagtggcacatagttgttgctaggttgtttttgctctaaattaagcctgtaaaactgttctcgtgtttccttgtttcgctcttaaggagtgcaagtgtataattatggcaatacatgaaggcatgaaccagcaaatttcttggttactttgcaaaatgttgtggaatgttttagtaattttctcggagaaggaaaatgggttttaaggggctgttcaaattgatgtcatttttaatcataccattttttttctgacatagttgctaaaaatatctctacgtttagtttgttgccaaactttagtaaatacatagaaaatcttttggtaaaattttgataatattactaacttaccaaaattttagcaatatttattttagttacaatttgaatagaccctaaaaaatcttcaacacggaagatcctgacttctaaagaaggacatatcattagttacagttcacaagctaacaaaaattgcagcgtacgtgccggccattcagcaagctgcacaaagcttacgacaagccaagggacggtaacagcagcttacctaagtacctcgtgttacttaaagacacaaaacaaatattctagtaccctaaactcctaatctccttttcacctgagttctggaggatttcacgagcatcaaactgcattctgtatccggccgctcttcgtgctgtggtatactgtcctgtctgtgtaagcggacaaatagcactttgggccataagttgggctagctgtgccacgctactttatgggattctttatattgggcctaagtctccttgctaaagaaactatccaatttgattccctcaactataggttgagtctaattcatatccctcacctgcaaaatcaggtataacaacacctccaactattaaaacaagtgcaaaatgattacctcgataatattgatggtagttttcattgacgtgacacattgacatagtcttcatcctacgtgtcaattttacaagaaaaaaaaccatgggaccacatgtcagtcactagggaaaaaaattgcggtgccacttgttagccattcctcctctcttctctctcgtcccatgtaaatggaggggtgatggcgaggagtcatgcagaagtaggcctctaaagcaacggcggaggacagcaggttaacctagtctcaggatgaggagaagaagagcacgatgtggaggagggaagaggagcagcatcgctacgctcagtaaggaggtggcccgcacaaggaggaacaacggtggccatcctcgtcattgttgccaacctgccatcatcgctgctggcctcttcgttctctttcctcgtcagcctgtaagagaggagggtgtgaaggtagaggagagaggggaagagaggaaagagatggggtagcgctcacttacctagccaccgctagccagcactggcaggaggagcgcaacgtgatgatgttcgcaaggaggagcacgtgctaacggcagctactgtcctcttgcctcgagcctgggtggccgcctctgtgctattttcttgatttcgttgaagatttggtacgaaacatgaatgcccgattcattgatttgttgaagttttggcgtggttgcagatggcggtcctatccgtgctagtgcacgtgaacatgacgattgtgggagaggagtgggtcagggtatgtcagggtgcttacaagcactgcttttaggtggctccatagacacgtgcaccttgcactacaaaccgacccgcgtgcaggccagcaatgatgctcgagctcactgatattccatcagtgtgctcatgaaaatagataggagggtgtcctttgtgcgatgtcccaaccgaatcaattcaatggttagggtggtgacaagatctgggtgaacgaccgatctacaactctcatttaatctccaacattatctttgtggttttcgtcagccgctatgtcagcgaaattcgaccggtataaatgttatacggaggtactgtttttttatttgaggaagacaagaactatatatataacttgcaagctatggggataaataacggttgtgtatatttttgtcaactatagattaagcttatctttatctttaggctggtaatctaagtaaatttcttgttttcaattaagctatgattttataatacaaattaatttaacatgaaatgtttttaataactagttatagtttctttaaagtaaaggacgaaatgattttcattatcaaaagcaattcatcttgaccaacttccctcctgatatgcatactcgggcatatactataggaggaagggaaaaaaaacagggccggattttttttactccttttttcatgatgcatttttctttatccacgatcatcaagtgcgcggtgtgcatgctaattagctactactactaattattgtttcagtacgtagtagtactagacagtttgcatttgtacatcattagtcgtttcttgatcatggccgccgtattgttgccgcagcgcaggcacagcctcctttgctggagaagacgacgacgaggcctccttattctttccccacagtacgaaatacagcccaatgattaccagagcagatcctatcacactgcatatatgtatatatgcacatgattaatgccaatcaatttatactagtaattagacatgatcgatcgatgtgatgagcgtaactaacgtacgtacattccaagatggagttgctcatggagaacgatgacgttgatagcagctgcgatgatctggatgaggggcgtgaacgccgtcgtgaacacaggccctctctgctccacgcaccatgacatcgccaagaacgctattcctgatccaactatcccctgcatttatattcatatcatactacaaaacgctataatgttgaatactatacagtttacgttactgacattagcatgatatctaggtatatcatgtgtatattatgtctgctacctgacgccagtaaatcaagtattccgttggaaagtaacgggtataggcttcccctactcgtcctccattcatatcgatcacaattactgtagcaattactactaactaattaaggtgtatatatcaattaaacgtaccacaaagagcacggtgatgatctgaagcttcgttgttaagatccatggggataagctaattctgtcgacggccaacgcgactgcagccatctgaaggaagctgagcaggaacatcagggcagtgcccgagtagagcgccgggtacttcttggcgatcctcgactgcaggatgaaccacagggaccagcaagctgaaccgcccagcagcgccaccgacccgatcgcccacctgtgcgcgccgccgccgctgccatgaccgacgactgccgccgttgcagaagaagaagatgatgacgatgatgatcgagcagcagcaggtcctagcttggtgagcgatggaccctggtagagagcgaggatcatcgctccgctgaatcctaacactgtgcctcccacttttgctatgccagctcctgtcttcaggtccactttctccagcctgcactagtactagcttagcttacatctttccgaggaagtgatttcatgcatgccacctaaatagttataatttttttaaaaaaattgtcatctatattgctaattttttttaaaaaaattaatatctattttgatgacatgcaaacaacgaaaggatgtctccttgaggaataaaaatccacatcccatctttcaaatatttcttcttctttagtactactcctaagtagttactccctccattccaaaatatcactctgtccaaatttatagtattaggatatgtctcatccggttctagattactatattctaaaacgagggagtagttaggttgttaattgcgtacccataaggcagtgctacaatgaaagtgaagatgggagtcatgttgatgaaggcgcaagcgaatgttgctgtggtgtactgcagccccaagaagaagagccattgggtaagggacgctctgcatgcaccattttattattattaattactatgtaattaatcaattcatttgttagagaaaagaatatatatcgatctttcaattcatcaagttaaaattgctagctactactagatatattatacatatatgaaaatgacttgcccgagcactgcactgaagaagagacacaccaagatttcagccgtaagctttggtcttgtcttcctgcatgcatatttggcacatacgtatcaaccaactagtaattaatacacatatatatggtactatacagctgctagctagcaatatatagtagtaccaatactaatcgattaacgcatatatacgaaattaaaacctatcaattaactgatatgcatcggactaaacgaataactgccatttatacaaaacacttatcctgagcacactcaagggaaccatagataggtaagtgaaatccaattcatgaaataatttaatccatggacggcaccattgtggtaaaggtcgtaattcaagtgaatcaaaaagaattaagtgtatatttacctctcccggaagtaggcgattggggcgaggaagagagtggcgatgagctgacggagcgtgatgaggacggtggagcgcatcccctcgttgaaggccatcttggtgagggtgttcatcaccgcgaacaccaccaccaccccaaccattgtcaacgttggcttccaactattacagctacccattaattcaggatctcttgaccataatcttctttttatctggctagagcttagctatacctatctgcaaatgtatatgtgtgcttgctaatgttgctttcgccttgctatatggcatcaagcatgctgctggtggcaacaatttatatgcatgcctggcctccaagtgacaatttgacaatattccgttccttgctttactacatatatcaacatatatcgcgcggtacgtacgtatttctgcattgctttaattatgtgcactcaattagaaggatgccaataagatattatagtattaattagccttactttcttacaccactcaagttgaacaacttatcatcttcatgcccaaaaatatttttttaagaaaaagatagaggaagaatttgttcatcagctttatatatgcattttctctttaaaaaaaaaagaaaagaagaatgagaaggttggatgcttggctggcatggaaaataggacaaggtacgcgtttagattacataacaaggagtaatatatgtatgtcaaagacagtagtaatgatgatgagattttcaggtattgtttggtgccacatactgtagtatagttagtattatatataaatcatatcttcaggttagtagtaatgatgatgagatcttcaggtctgttcttttctccttccttattagatcgatcatatctagctacctagtagtgattaattaatttgtcgtgcagttttaatttgatcacagggagagagatgctggctgcatatatatatatatatatttatcaaagctggcaacatgtataactttatagggattaaaaaacatttttattctgaaagaaaatgagatagatgctttaatttctttggtgcgtcatccgttgttggtcagcaaggtgactaggagggaagggggaaaaaggttaaagctgacttatagtatatgccccaacaaggaaaagaatgatcattaaaaaaacaaacattaagatggaacaaatatatatagcaattaaactatataaatcagataccatgcatagctgggcctctcctctcagctagagcatccgatgctccattgaatactagtagaacattcaatgcacgtacgcatgaaggaattgatccgatgtgtcatttttgccggatggaacacatgggctggccgggcgaccaatttatgttactaacaattaagtttttctaaggatggcacgtcattgtataaggagatactaacacaattatgttactttagtcttcttcagggcatcttaattaattactctaaatattattttcttccgctggaattcttccgtttgcaagcgaaagcaaccgtgtcacacgctgtcacttcgtaccggccatactcatactcatatagtcatattataagcatcacatatgcagtaatgctctttttttataatggaataacattttgatatttgtttaatgagttactacccattattataaagtttacgcataaataaatccaacgcacactgacgtgatattagtgaagtagtgcattaatatgctgatttttatgcccccccccctacgtcatataatatatgctaaccgaccaggcatcatatcagaaacagtaaaaattcaacctttgtgtacgtgcgctgaatatattatttcctctgcttttgcttgctccttttattttccaggaacaatactgtatgatgcttcattaattaagcgtattaatattcattttattttatgatacaagaaaatataattgattttatttatatgaaatgaaactttgcacgatcgatccgtcaaaagatataggaaagggagaaaacattgcacgatggccgtgtttagattcaaaattgttttttcaaacttccaatttttccgtcacatcaaatgcttggagcattaaatatggacgaaaaaaaccaattgcacagtttacatgtaaatcgcgagacgaatcttttgagcctaattatgccatgattttgataatatgatgctacagtaaatatttgttaatgacagattaattaggcttaataaattgtctcgcattttacaggcggaatctataatttattttgttattagtctacgtttaatacttcaaatgtgtgtccgtatactttacaataaatttagcacacaaactaaacatagcctatgtaagatttcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcatatatatatatatatatatatatatatatatatatatatatatatatatatatagtgaaagagcatgtagtctagtggttgtagtgatctgagtaacaccctgtttcataagttcaaatctttggctaagttccatgtttaataggttaaattcctactccctccatttcataatataagagagataattggtgaatgtgatcacatcctagtgtaagggagtaatttaaaatggctgcataatatatccggttggatataaaggccgaaaaaaaaaacccttccaaaaaaatagttatatataggaggatactgtatcactggagtatgcacgtacgtatgcagtgcactgtttgactgacgtactataaggtaggaggactaacgaatattgatcttcatcgaccattcttcttatcagtattcgttcgttcgttcatttatttgtcatcgatgatatgatccatccatcattccatcttcaaccgattcaattctcatcttccctttcacaaaagaaaccgaccgacagacagagaataactagtccacgtctctgcatagtgtatactcctgctcccgtggatctgatcttcttcctcaatcgtcaattcgtcagcatactgctcgcttactatatatgacgaatcattctgcccggggtttgataaaataaatctacatcctattattaattcaagatctacagattattaaattttagcatattttgttttaacaaaaagtagcacattgtgtgtacattaaaggaaattatatcattttctagatatttttttaatttctacataaatttattatagcttttgatcccacggtgtcctttttccttcctaaatagtaggaagttggtggtggggttgtaagatcaaaaaaaaaccgagcttaccatagggaggtgaaaagtgataacattagcagaagtcaaataaccaaacttcgatagataaaaaactcaccccaaccttaaaaaccaaaagatcaaactttgacactctaaccggatctgtacgggtggctaatcgggcttagaactggtttgactgaagtacaattactagttcgatcgtcagattaaaaagaaccttacatcacttgtgtaaaatcttgttttctctaaaaccagccattagatcgagctctaatcttgacaggaaactaagagacaaatctatcgaagggtcatgcaaaagtaataaacggtttaagagaaaacatctcaaaagctagacgtctcagaaatttcatcaaatatgaataaaacataaattttaagcaaattcgagtcaagcaaataccaatgaaaccttttagatctgatctataatataatagaaatgtttcgggtggattaacttgaacaaaaccataacaaaactaagaatcacaaattaatgccaaaaacgaaaaaaataaagattacaaaaccagaaaagatcgttgacgccttgttgattgaatatgatatttctttttcaagtagtattcataagacggtcattgcacctctcacgaatttctcacataaccctaacacaaagagtagtaaactctttaatctctcaattgtggcttaccctcaatgcatagcctcccttattcacatctaattacaaaatcaaactaaactccaactctcttgaacttggactccaatccaaattcaacttatccatacgcacacaattccccttgtcacctccatgtgcattattctctagccttggtatccacatgatctccttgatcttctagaactcaacttctaccaagtctagtcttgatccatcatcggcaatactctcgtgacctcaagcaacagctacacgttaacaaacaaagaaaccatatttgagcacaagatcttccccaatttgactcacatatatctcacgtatagaaaccatctaaaagtcataaacatttagcaatcaacatattcgatagaatcaacccaaaactgattcatcaggagtttgccggtctaagtgctccctcccatggcagtcagatcgctggccccatggtggtgagaccactcttgccatgaaacttcgccaaattcaacatcacttcacaaacatcagctcaatcacttttttatcactcttaataattctttatcaccagaatcaaatcaacaccttaatttaataagggtggtgataaattcaccactcaccaccaccgctactctcttttaaaaagagttagaatagattactaattctctgcagttgtgatagttcaatccagttgaccaactataagatgtttttgattaattggggagtttcttttcagagatcccaactagtatacaaacaatatgagaagggctacaatgttttccaaaaataaaaaaaacacaaatcgcaacgcacaagggtcaattactcttttagacggtgcccatatagaaagcccaccgggcttgctttcaaccgtcatgtgggctaatgttggatttaagtatcaggctttaatgtttgatgttaatcacatggcaaatcggtgatgcaagtgtagctcaactggttatgtttttcttgtggtggaatcaacccacctgagttttagtcctatacttaacatcgatgctcatatttacatctaattattctttcgatggtaggtggctgtcggtgacacgggaccaggagtaccatgactagaggcttgaggcagacataatcgcccacgtggcctggcaccctcgggggacgtcgggcccgagggtgacgtgttcgccctcctcttagtctccccaagggggtcgggccactcccgcctcggccccgagggccgaagcgccccgacccctcgtggtttctcctccgcgtgtatgggttaggtgagcacagcggggctcacctaaccgcatttattgcggtttggttgaacctgtcatgccgcatgtaacgcagtgcagtgcgctcgtttatccggtctgtgacaggtcacagaccggtcagatcgcggtcaggtcgcgacaggcggtctgacgcacgcctcgccccatcccgtcaggacgagggcttctaggcgctcgttcccagacggagctagcgtgttacctcttagagatggcacgttagtcccggttagatatatgccaggcttcattctaaccattacagacaagatgttgtgtgaagaagggcaaacatgcatattgctaagctgacgcgtggtggacaagaatgaccgatttgtgaccagtctgacactgatcatgtcgtcagcagacagccacgtttcccacgtcgcacctgcctccggcggaagtggaggtaggtatgtgccgtcccatcagaagatcattcggacagcaatgatacaaatctccgtccatttatgaagagagggcaagtccagtttggaaagggagagagggtgcatgtggtatccccttaagatataaaaggaggaccttgcccactaagagagagggacgggactctggtagattgagaacggagagcaacggagactctggttcatactttgtagctccttcatacacagatccaccaaaaacacaggagtagggtcttacgcatttcagcggcccgaacctgtatacatcgcctgtgcctcgtgtgctctttcgactctcgcgaacattgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgtaatacccatttacctggtaaaagcattattatcaaataaatagtatgctcagaatgtccttaaaaataaaaaaggaaaccctagggtggcgtagctaggggcccactccggagggccccaggcccacctaaaatttcatacatggggttcactccggctgaggaggaatattgagtgtatggcccaaaactctgagtatcaaagcagcttggggcctagcttgggtcccaagcataccctaaagtatataccttaagaatgtaacctaaggtctgcccggggcccgatcccattccgggccctaggctcaccctagtcctcgcaggttctacggttcccggcaagaggagtgtaaaacatgcaagacctatatgccttaagaggataaactatggtctgcctcgggcccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgacttcagctgtccaccatccagcctcccaaggttctggatcacatcgtgccaccgtgccggctcggctcacgcgtggatggggaagacggcgaccgaaggggacaaggaggcggggcggggcggcggcggcggcggcggcgcccgccgccccgtggtgctggtgacgggctgctcggagggcgggatcgggcacgcgatggcgcgggcgttcgcggcggccgggtgcgccgtcgtggccacggcgcggtcgcgcgcctccatgcgcgggctggagggggacccgcggtacctgctgctggagctcgacgtgcgctccgacgagagcgcgcgcgctgccgtggccgacgccgtccgggagctcggccgcgtcgacgtgctcgtcaacaacgccggggtccacctcgtcgcgccgctcgccgaggtgcccatggaagagttccagcaggtgttcgacaccaatgtctatggtaggggtggaaatttttgctcccttttttttcttctttgttttaattgctgtctctcgtgcttgctggtatttggtgattgcgatgttctcgaagaagacgggattttagatcctgcgatcaggtggtccattaagtatgattagtaggcaattaaaatgtttgttcttgtatctatcgattggttgagtagtacaacggcagaaaagttgcaaatttaggattactttgtcaagacattttatcctgttagtgccagtactaatttaggaaaagtatgtaaaatcttctgtagtcacttgcagcactggattacttataagtttgcaactaggaaccctatgttagcaaggagatgcgttaatatttagtagatcacactgagctggttctagttgtgcaccacaatgaaaatccaaccaaaagaatagcttggtggcatgatatgtttagtaacatggggtttcattggcgaaattgcagtaccaatagttgaaagatgtattatacacttgcacactctaacactagtcagatcagtgctcccagggcacgcttcctgtcagttgcacaaattgacagtcaaagtgcagtgacgatgctgcgatgatgttgattgggaagcaactggaatgtggaattgactcattctctcattggatctgacaaattattttgtcccattaagtgtatgattcacaatagctcttaaaccaatgtaaaggtatttgaaaggagcatagcctgttaacctacaattaggctttccacgctgtttcatacgctgataaatagtcttcaaccggacgtaaatatatgtaattccaatgtaaaaatgtatgctggttgaactgctgagttattgtttcataatgctagaatgatgatggaggcgcaggggggaatagttatcaattaggctttccacattgtttcataatgcttgaatggttcatggcttcatgcttgtgcaacagcttgtttgagattacttacattgggcctgcacttatgaaaatgtctaaatgactgtcttttcatctacaggagcaatgaggctgattcatgctgttattccccaaatgatagaaagggaacaaggtacaatagtgaatgttggaagtataacagctttggctcctggaccatgggctggtgtatattcagcatcaaaagccgctcttcatgcattgagcgatacgctaaggtctgtacattcaaggagcactctatactatgctggtattattatgccacattgtttttctctccgtattactgctggtttatcactactctgagaacttgctaaattgtttgatcgtgcaacaaaatgcttttcaacagaagctataataagaaataaaaatgaataacgatacaatagtgtgagactattcgaaattcccatttgtttgttttccatgtcatcttcttgtatattcagttcttttcgacttgcaccgcatgatctgtggcttttgacgctgaaattatttttcacttttgacactgtcagttgacacgacagtttttatcactgcagactggagctaaaaagtttcggaattaatgttatgattgttgcacctggagggacaaagtcgaatctgggaagtaactctacatccaagtatgttcaaatacgtgactggaagtactacaaaaaattcgaggaatccctcagagccaggactgatgcttcccagggtcctggttctactccagcagaagacctcgcaaaaagggttgttgctttggttcttaagaagaatcctccagcctggtttgcttacggccagttcagtgctattctaagcttgttgtactatgcaccactatggtttagagattacttctataagattgtcatgaaatgctagaacttctgatgtcagtaagttcaaaggacaaagaggttgccactcagataacccgcaatacatacttgcatacagttttacagggaccattcattcaagcgaaaaggcccctcccagtgtatgccatcttttttcacctgtaataatagcggtgctagtttgttcatgtagtgccaaaggatggcaatctgaaatatgtggcctgaagaaactggtttccttgcaacctccactgttgacatggcctgcatcttcctgtctcaggaaatcaaatttcgacgcgcaaacgggtcgaacacttgtgatctgattgtttgaagtttgcattctactatgtctggcagcatctgctgtagttggggggcgtcaagtgcacacggtgaaactgaccagttgcgcatcattgttcagatcagagccaagctctgcaaatatctgacgatactgcaacagttcatttggagagtgataatgcttctcagttttaagtgggaaatgaattgttttggcaaaatattaccatgaaattcttattcttacattccaattggccttaaccttaacggccatttccggcaaatgtatttttttacaacagttttgcggtaatttcacgtaaagaaatcgagtccaacatgaaagaagaacgcaactgaactggaatacttgtcaaatcgctcaggattttactgcggggcggtctcacaccagcgacccgtccccacaaatcacaagcagcgtcgtgggcaggatatagtccacgtggcgtccacctgcgcggcaaaatccgatggcgcgcgctccccattggccggcgacatatccaccctagctccccggggatttccccatcctgtggccgcggcgctccgcggcgccacgattaaatatcaactcgccgccgtgaccgtcctgctcgctcccgatcacaccgtccgccaccggaagagagagcccccctacgacgacgacgaccatggcgctcgccttcacctccgncacnncttcgcggccgtgctcaagacggccttcctcgggcgaagcgcgcgctcgccaatgccgtcggcgtcgcgggcgccaagcccgcgccgcgccgcgcgctcgtcgtgtcggccaagaagtcgtggatcccggccttcaagagcgacgccgagttcatcaacccgccgtggtcgatggctcgtaagttcttcttctcttttttcctcttcctcttcttcctcctcctcgcgccgcgcattgtgtttggctggctgacaacccgagcgcgtctcgtgtatggaacgggcaggctccccggtgacttcggcttcgacccgctggggctgggcaaggacccggcgttcctcaagtggtacagggaggcggagctgatccacgggcggtgggcgatggcggcggtgctggggatcttcgtcgggcaggcgtggagcggcgtgccgtggttcgaggccggcgcgcagccggaggccatcgcgcccttctccttcggctccctcctcgggacgcagctgctgctcatgggctgggtagagtccaagcggtgggtcgacttcttcaacccggactcgcaggcggtggagtgggccacgccgtggtcgcgcaccgccgagaacttctccaacgccaccggcgagcagggctaccccggcggcaagttcttcgacccgctcggcctcggcggcgagaccagggacggcgtctacatcccggacaccgacaagctcgaccggctcaagctcgccgagatcaagcacgcccgcctcgccatgctcgccatgctcatcttctacttcgaggccggccagggcaagacgccgctcggcgccctcggcctatgagcaatcaaccccgctctcgctcgccatggatctgacacacagagttgggtttcgcttgcatgcgcgcttcgtgtttgatcgctagctgttgcatcgatcgggcgcgtgcatgggctcggatcgaacgattggaggtcggaggagcagtagcaaaatgtatcttgttgtgttcgtggccgcttttgggttgggtggtgtgcgtgaaccaaatgggggaattaatcaaggagttatttttttttatttttcttcccagtgtatgtaccatatgtaatatatataattaaggctgcaggatgagcaaggatatttcattgatctcatggtgttcgtgccattcctttgtcatgtgcactctgtttggccgcttgcctgcatggcgaaattgcatcagctaaaggccgcattgctacgaaatatctcatccgctcttcgaggttcgaaatgaccatagtattttgtttcttccattgcgccgaaggaagaaacgtgctatagtagctctggcaaagataagtaggagcatatggtaagaactgaagaatactctctctgcaaactgaagaactccagagtacctgccactctttcttcaatggctgcatttgccttgaagcagatacaacatcgatactgcatttggtcgtaacatgagctgatttcaagtacaggagcagatcacattcccaatctcaaccattgcaatacctgccggtaccaaactccactctgcaaattagtgcaaactagatacctctgctctgcttggagctgtcatttttttcaatccaaaatggaagagaacgaaattaactaattaaacaggcataaataattaacaaaactccacgcctatctatatcagattatccggcactaatccgagctcgacccccagtgacagatgggactgtccgggaagtcgctcatgtccaccacttgcgcgacaccgaggagaccctccagcatgtcgtcgtcgtcgacatgcacggtctccggagcgacgctcccatccccgccggctccggccgccacgtccttcccctgctcgccgccgccgccgtcggtgtcggtcccctgcaggcagctgtagtagagcttcatcagctcgtcgatggagctgcggtccgcctccgggacgacgtcgatgtccgccggcagagagagctgcatctcctcgccgccgccgccgccgccgccgccgacctcgcgcttgcgcttgtcggcgtgcgactcgcgcggcgtcggcccctcgttgggttcgtcgtcgtcgtcgtcgagcggcgtgatgtggagggagcgcagcgcgtggcggctgagcgcctcctcctgggtgatgacgcgggaccaggtatcggcgtccctggcgctcatcttgtgctgaagccgcttggactgccacacgagcttgcgaatctggtcgaaccgcgggctcaggtgcttgatgacggcgctagctctgagcagggagatcttccacgccttcttgaggtcgtgcggcttccggtacggcggcgggccctggctggcctgcgcctcgccctgcaggccccaccacgcctcgccgccggtcggccaccacggcggcggcaggccgcggtcgagcgggaagctccgctgcggtggctcgcagtgctggatcagcgccgacagcagcgaccccagcgtgctgtcctggatgtcaaggagcccgtgcaggaacgacgccgccgccgcggggctccgcgggctcccccggccgcctcggcccgacagcgccgtcggccccgcccggtcgaatgcgacgtcgtccttccaccacccgcggaggctgtcggaggagccggacaccggcacgccggactcgtccacgatgccgtacacgaacccgcgcgcgttgcaggcctccatcatcttgagcatgtggcggagcacgccgtcctgcgcccggagcatccccttccgccggtaccgcgcctcgggcggctcctcctccgccgcctcctcctcccccctgacgacccggtggtcctgcgccgcaagggcgccttcgtggcccgaccggccctcgagcttcatgagcagcatctggtccttccacatccgcttcttcaggtcggcgatctcgatggactcggacccggactcggagtcactaaagaactcctcctgctccggcgccgcctcggcagcagcagcggcgtcagcagccttggctttgcctttgtcgtccatggcggcggttggccgtggcagcggctcgagagcaggaggtttctgtttctgtggataggcgaggctttccatgaggagagcttgctgtgtgaagcggaactcgtggaaaaggtggcacggaagggtggcgggaaaggttgcggcgtgcttacttatgtacgtgcagacgttccgggcggatcgaaggatgtggaagaagctaggcttggtaggtggatttgctgtggcacgcagcgccttggagcccgaagggacttgtagggagtagggacgggagcactgaccagcgaggcactcactgagtgcggagtagggtggtggtggaccggtggtgtacggtagcacccgtccgcaccgcacatgcttgtaggagaagaatacacacgcggctaagactaagaagcctaattttttatgcttttgtgctttcttgtgccacagcgcggacgcgataatttttctgctctctaggagaaggttgagggtaatgacgagccctgcacttatctttcaattattgttcttgtagtatttgtttatgatgttactgggcctgttcagcaggccggctacaacggctgcagctgcagctacacatattgagtgtggcactgttcacattagctatgggctgcggcgcagcagcagccccggctaccaaacaggcccactagtgatctttttcatgcaattatcactcttgctgttgtttcgaaaagaactatattcattcggttagggctaacgccgggggctactgtcaataatatggtccaggggtatcatgtttggagggaagaggccaccccgaaacccacatggcacttccccgagggggatcgggcccgatgtggagtgacggctgccccctcttcgcctgagggtattaaaacttgagggaggaggctgctcctagcacccacgtggcactcccccgaagagggtcgggcccggggtagggcggcggctgccccctccatgatt

SEQ ID NO: 61081 - DNA, 2082 bp, Oryza sativa
tttgatgcataagagagcatataatatttgaactgtggtgtgctgatcagttagtacctccaatgacaagcacatagactcatagtttctctcgtgtttgatggattatactagtacaatacaacactagccctgttgcagttagttaaatcgcccaatggctataagagcaggttacgtcgttgaaggtcaaaattaagtatcataaaaaaaaagtgctacagtttgtggcactatgcaggcagtatgtatcagcgtagcaggagagaagagacaaaaagaggtcggcttaacgattgcgagaacagggggtccagtgaagcaagaagcacaggatgcatgctacctgacgctgctctcgtcactactattcgtagctaatactactgccctacatgctacattctgtagctgccaagggctggacccatatttgttttcgtcccaactactaatgtcattgctgttccccagctactgatttcgtctatgtcctcatcaaggaaacagtagggggaaaagtttctccacacttaacattttctcgttaattgctacttcgctactcgttcatcaataaatataagacattttgggtttaaattttaactgtaaataaaaagaattatgctacactactcttcaagcttcggtaagtttcatcggattaggtttacgggtttagagaaacattaaaggatagttgagttggtaaaagacctgcaataggcggcaaagataggtcggcggtgaggcaccaacgctaaaaccgtggggatggatggatcggatgatgatgcatggttgtgggtggggttaataatgtcgcccggggggagcggcaagagaaacatttttcacttttggtgagctaccagaaaaaatggatgagatacggagtggaggaaacttaaatgcactagctcaacttggagacagtggaggcaactacgtgttggcggaagatatgggagagaagaacgaggatgagagctagagaggcgacaaggagggagtgagttgagtggctagcctcatcggaaccagcatggtggagggcaagagcatcagtatatgtaacaatttgccctttagaaccgcgtggcctatcctatatgaccggcggatccatttacacatatcactgcacttacacacatcatcgtttcatgtaaaagaattaacccatgggtgatatgattggagggataagcccttataaaatggttccacccttattaaactagtatggtgatactaaacatgcacacattgctctaatggaccatgtatgtcaaatcctatttggactaggatgtcacagtacactaggttaggcgggagtaaggtggtgggcaacgaaagtagtgtgatcaggcggaggaagtgaggaggagaagtggagttatagattagttgattgatgaacacataaaattacgagtaaattacagtttgggctatatattcttcccaaagttttcctttggtatattgaaaaggggatgattctaacaaaagataatcttgctaaaagaagatggaagggtaacttgccttttagcttgtgtaactctaatgagtcaattcaacatctcttctttgattgcataatggctagatacatttggaatacaatctatcttacttttgaaatcaagcaaccacgtaatagttcacacttgtttggaaattggttaagaggtttgaacttaaacttaaaagacaaacttgggtgggcatagcggcgatttattgggctttgtgactcagtagaaatgacttagtctttaatggctacaatcacgtatctttcttgcaggtaattttcaaagcaactcagttgtcaaggctttgctctttgcttcttaaggaagacgaaggcattgaagtaatcgcgaagtgcaagcttttagagaagcgtatgatggagctcttctctacttttgggtgaaactttagaagaaggattgaagcatagcttttagttcctcttgcttgttgtccatctttaaaacttatttatgatttacccatgtaacgggagagtcttatgtactcgtgtttgtgacttttaggctg

SEQ ID NO: 61082 - DNA, 8848 bp, Oryza sativa
gtgtaaagttttaaaagtatacggacacatatttaaagtattaaacgtagactaataacaaaacaaattacagattccgccagcaaactgcgagacaaattgattaaacctaattaatccgtcattagcaaatgtttacggtagcatcacattatcaaatcccggcggtaggctgaaaagatttgtctcgcaatttacatgcaaactgtgtaattagtttttttttcacatttaatacctcatacatgtatccaaatatttgatgtgacgtttttgctaaaaaattttggaatctaaaccaggcctagatataggtcttgtttggatcctccggactattaaatagccttccagaatcttgctatttaggattattaaacgtagattactgacaattaaaaccgattccataacccctgagctattttgcgagacgaatctaacgatggatattaatccataattaacggctaattactgtagcatcactgtagcaaatcatggattaatataccttgttagattcgtctcacaaaatagactagaggttatggaatgtattttgtcagtaatctacgtttaatactcttaaatagcaagattttggagggttatttaatagccctccgaatccagactggccatactctatcggtgttggtttcagaaagggaatttgaaacccagaatcaagtttcggacgcatctctagctctcagggtactacgattgcacgaatcactatgatccagcaggcagtcaggcagagagagttcacgtgattgattgatcggaggcaaggcagagagaaagaatgcatgggtgcacgccattgacgagatgtatctatcgagtactagtagtagtggtatgagaggagagagggtgacggttgatgatctcagagacggaatgcaaccgtgtccacgtcgatctttctcggaatacatgaacaatcccttttgcctggctctcgcagaaacggtgtgccagctctcgactcatgctcacatactactatgttcaaaaataagctaaccctaattatgaatgtttcgttgataggattagtattttttatagggcggagatagctagcgagagggagggagagagagagaatgagagatgatattctagatgtagttctgggcaatgaggcgtctgcgtcgtcgtcggccctgcgtgtgctgccacaaaggccagtggtggggaacgcacacatcttcttaatttatgtgcatggcgccaaactccccgattgaattcgatcgataccgctgcagatcgatgcatgcatgcgtagtagtagtagtagcagctccctcgccagattccaccaaattgcgcgccggtcgatcggtgtacatgatacatccatccatccatccatcggctacatctacccaagtctcgtcgtcaagcctcgatcgcatcgcaccccacgccaccgctcgctctctcatcacacacggacaccaacatgtgtagtacgtgtatgtgcacatgcagggtcaatataggagtcgtcggtggatcggtcgatctcccgtctctccacgcaacgtacgcaaacgcatgcgtatacgcgccgcgcgcggcagaacgggtgtgcgtgcgtgcgtacgtcgcgccggccggggcccgtacgcaagtacgccgtgtgtgtgtgtgtggcgctgcgtgcgatcgatcagcgcgcgcgcacacatgcaaatttagcccaagcgacgacgcacgtacgacgagcgctgcggcgctacatacgcatgcatggatgtatatgccgccgtccgtaagctggctggccggccgggaacccgggacgtcgtacgtacgaacgcccatcctcgatatatccaacacaaacatcatggatgcatacacacacatggttcatggatagatgcaccgatcaataaatcggagatatccttgtgtatattatacgacgtacaatagcatcgggtacttctctatcatgatatatagagatcgatgctagtataaacagagtatgatcatcggcatgggtggtacttccccggctgcctgaatgggtgctacttaaggcactactcccatgagagatgaaagcacaacatgcatcaatgcatgcacacgggactagctagtagcaacgatatgatcgacaagtactactcctatattatacgacgtacgtacaattagtatgttgcgtcacaaatcaatcggtcagacttaggacccatgcagatcgatatttggttcgattcgatagatacatgtgggagcgtgacgtacggccgctgaatacttgtatctgttgcatgtacttgtatgtatctcgtcatcctcactgtgtaaattttgccgtttctttccttcttcacatgacggcactatagtacgtgcgtagaagtgtaatttgtttgtttgtttttttggaagacgtactgcgttgtttaccgtacaggcgtacacaaccatcctggatttctctggtggacaagtacgtgtacgcccatgatacggggaaacacttttaactacctaggtggagtccatccatttattacatgtcaaccaaataggtatgaaaaaaatttagaaaatttaacaagataccttcatatgtaaatgtcacatcacaaacatacaagtttaaatttaacttctacaagctctagcaaaaatatcaaatcaagtttgatttgttatttttgttacaacttataaaagttaaattttaatatatatgtttgtatattgatatattatatatcaatatatcttgttaattttttataaccatttaatcgacatgcactaaatgagtgattaaaatccatcgccatgatacccccaggttgttcttgtatgtgtgccctacaggcttttaggagtacattctaaccccatgcccgctgcacagtaattgacgcggcccatctgcgtggccgtcgacgtatccagtatatgggtcaatttggatcacagattatgcagtggtcctaaatgggacgggctagaggcccacaatattttttcacgttacatccaaatttgtgtggcccgattaggatcgctgccaactattcccttcgtctcaggattttgagtttttgttttgcactatttggccactcatattattcaaaaaattttagaattattatttatttatttttgacttactttattatccaaagtactttaagcacaaattttcgttttttatatttgtacaattttttaataagacgagtgatcaaacagtgcaagcaaaaaactcaaaatcccttatattatgggatggagggagtagtcagtttggcaggccgacaacaccggcttccctatatattttagcaactttataggtgtcttatattgatgtcgagttcgaattatatccttaaactgtaatactgatgttgagctcgcattttccaaaacaggttaaataatatcttaacatagtatgtatgtttattttagctgacgtggcaatatagtcagaaaaaatacatgggggccacatgtaatttaacttcaacctcttcccatatatgggctccacattttttttactaggaagccacgtcaaaaaaaaaaaacatccatctatattgtcttagaaccttattttcctgggttttaaaagatggaggttcaacatttatagtattacgattccaggatgtaattcaaactcgacgtctagattagaaaccttaatgaacttattcctactagaggctctaatcttttggcccaatcaacgtatgccaaagccaaaatttaaatttttgaacttaattttgaagtagtttttgagttttttcaatcatagtttcttatacaatatggtcatttaagtcgctaagaacataattgtaaaagttttaatcacaagttatattttttcgctactacgccaaatagcgtatattccgcatatagccatccgatgaggctgccgtttatagggttctaaagaaaaaggctggtttgggccgagcaccagataagtcgggccgatctcaaacagaggcggtggcatggcccagtccagaagaaatttcgcatctccaaaaatttccacccgcgaaaactccgtgcgacagtgcgccgcccaccaaattcaaattttgaacgcgaaaacttcccccgcgcgtcttcctctcatgcttaaatctgcgcaaatcacgcgctcctcgcaagcaacagtgagtttgaacagaacaacgcgacgacccttgcagcgcacgaccccgcggactcgatccagatctagggcttctcgtcggcggcgatggcgggcaagggaggcaaggggctcctcgcggccaagaccacggcggcaaagagcgccgacaaggacaaggacaagaagaaggcccccgtctcccgctcctcccgcgccggcctccaggtacttcccccttttgcccatcttccctttcggatttgtagatgtgagtcttgcttgttctctcctcgagctgcgaatatcttggatttcggttttggtgcgcggatttttcccaaatcctccgtttgaattcacgatctgaatttgtcttcctcagttcccggtggggcgtatccacaggcagctcaagtcgagggcgtcggctcatggccgcgtcggcgccaccgccgccgtgtactccgcggcgattctcgagtacctaaccgccgaggtcctggagctggccggcaacgcgagcaaggatctcaaggtgaagcgtatcaccccgcgccatctccagctagccatccgcggggatgaggagctcgacacgctcatcaagggcaccatcgccggcggtggcgtcatcccccatatccacaagtcgctcatcaacaagacctccaaagagtgatgcgaaaaaaaaaaaactccctcatgtgctttgcttgactcgaagtttggtgggtgttttactgttaatttgttatgttttctcatttgatttgatgtatttgtgctacagtgttcaatccttagtgggtttaggtgccttttagtcttttgaaattatcgtgacaatgttggttgcagctgaattcttgtgaattcttcactccgtatgctgttctgaaccatccatctcgatgcttcagttcagattatcttgttaatgtttaagatcagttcgattgattggcatgtgcccatgtgtttgtcaagatgttgtactgctggtaatttggtctgtttacgtttttgaaatttggaaacgtatctgtcatgatttgatgcgtttgcgtttttgaattgtaccaatacctgtatggaaaccacaagttatggaaaccagtgcaacatcttacagtgccagcaagtcacaaaagaactaccaagacagtttacagtgccagcaagtcacaaaagaactaccaagacagtttacagtgccagaacagctaagtagctgtatatgattatatccttaagcaacagagttttagactttagctcctgtgttttgtccaacagcttctttatccattcctctaagcaccttttgtcatcctctttttcaatcttgttccatcgctgcacaagcgagatcatattgtatatcacattaagagtaggtgtttgtttagttcctaactttttcttcaaacttccaactttttcattacatcaaaacttttctacacatataaacttccaacttttttcttcaaacttctatttttggcgtggaactaaacacaccctagaattcaaagtttattttcaaaaatccaatcattcctaactagacacaaagttctcttttttaaaaaaagataaaaggatggtgcccagctattgcaaatttagggggcatttaagatgtgacaattaattatttgccacccacagtttatgatatgtgaaccctcgtgtctatgatatgtggatccagtggcaaatcttaattatcactcgtaagagtaacaaatatttaaatatctccatttatatacaacaagttttgctgggattgcaatatatctagaggaggtaaaaagtctaacagcccacaaggcaagggcatcgggaggcgcctcgtcgaggtggtccaagtcatcatctggaggcggtgatgacggttgtgccccctctgcggcggacctcaggcggcgaggctagccacggtggaggatgacgaccaatcgtcatgctctggagcgaggcggcacagtcgctactgcatcctctccaccggcgcgcctcctcgcttgcgtggttgtgaaaaaaaaaaagaggaagaggtgggcgctgacatgtggccccgcatactctttcttctcacttacatgtgggcctgtatgttttttatttttatttttatttttgctgactaggattcaatgtcagcgaagcgagttgctgatactgttataggaccgaaattgtatggttttgtataatttaagggttaagattttagtattggagggaagcgatatcaagtaaactcggtgtaaagttgagggaaaagaaagggaagtagatggaccgaccaaaacatttacctgggccgaaaactgaaaaagtcgcgcgcgcgtgggccagcgtcatctgggccgaaaaaaggaaatgcctttggaaggtacctgggcctctaatttctaccttccctaaaagtgtccatttgcccccggtaactcacaatcacaggtatgcaacgtgactacgattcacaagcttccgtgactgtagtcgatacatgtacgcaaccaactatgcatggcatgcatgatccattgatgcatgaaattgcagcactggtagatttgatccttactgcatcatgccatcatgtacctggctggcatggctgcactgaactctgaagtttctcgcttctatcctttactgcatcatgtactatctatctatccggtgtcatcgtcttcgtgaggccatgatcgatgaagctaccgttcacggatagaatggccctagccttgtccacgattctcgcttcgtcttcccatcctcgacaagaacagcattgctcttgatcatcaaaccagtgggccggctgcgtgcgggttcactggacgtcaggagcaaaacgaattcaattcctggccggtggtttcttcgacgaggccttttgtgctcttgcgggttggaagcgagcagggcgaatttcgcaacaatggtagcgcgtcccccaccaccacatcaactctggatgggtcacttcaccttcccctgtccaagcgcctcacgatacttctcaaaaatatcttctctattattctttcctttcttccactgggttgtattcttcagctattttgaggcaactccaatttacccccaaggaatacaaagcgtagaaaatagaattttgtgctcatgaagtttagaaaaccttttgttgctactactaacttggtaccgggtccattctttttctaatcgagatacatattgtatcttttttttttgttagaacgtttttaaaactgttaaacggtgtgtttcgtgtgaaactttctatgtaaaagttgctttaaaatatcaaataaattcatttttctagtttatagtaattaaaacttaaataaattcatttattgtcttcgcttaatctttatcttcattagttgtgaacagggtaataatcttcatatctgatcagtgcaggatttcttgattgagtccatatcaacagtagctagcatatgtatcagcattattgaagttgtcaacagcttaacatttgccaaggcactcgtggcaagaagaaaaaagaaaacacagtatgtcgatcgagatcaattaaagccatcgttttcacctcacaagccaggtgatcattcagcgccttatctatccgtgctctaatagcgaacgacgaaggggaggttacacctaaccaccactcatgatccatgacccccatcaaccggagggaccatgcacaatattcacaatttgcacatacacgcaggaacgcagcaagcaggcaaccaggcatgcacctacatgccgcgctgctcggacgatcgacgccttcctccgatcctcgcatccaccgcaatgatccgctgatcttttccctgcacgcacgcatgccggcccgcggcaacacaccgcgacggtttcggttgatcactccggctacgatcgatcgatgccgacgtatcagccacctcccatacatgctgggcatcgcctcgtatcggcgaaatgattcgttcgttcgttcgttctcctttgatcaatgatgcatcgtcacgagcaagcctgagtgactgtgaggccgtgaccgtgtgaccgcgacgcagtacacaccagctagctcgatcgtctcgcacactgccctgcctcgatcggcagctagcgatccaccgatggcgacgtgcaacacaaaaccatcgcgcgatcggggcatcggtggaaagcaagtgtacgacgcggatgactgtgtacgtagcagcgtgcagtgcatgcgaggaggaggaggggcatgggaatcatggcctgacgatgggggtgagatccccttgggttgtgtggacttgaggtcatggaggaaaagggagtcagttgcctttcctttccttccctttctctgccggtgcgtactacgtgagcccaggccacgcgcaccttgtgaatgaagcgcgagcagatcgatcatatcgctgcaatttgcaaaagctccccctgcctttccctgctccccgcctgctcttaccatctctagctaatcgactatgcaacttgagggaaattaacctcgatgaacagggagatttcactggattagagaatcaagctgatcaagggggggcagtactagtgtactactgctgtcatgtgtccgttcccagttcg

SEQ ID NO: 61083 - DNA, 8333 bp, Oryza sativa
gggggggagagaacagcataacaacaggggaagttctgaagataacattgaatgcgtgatgtggccacataacctgatcacagctttcatgtattgattggtgtatgaagttggatatgacctgttatccttttttgtttttctttttctcaacgaaaaggagagggcggtccttttccaacaggattgtggtatcgccccccctgtatagttgtattcaaccgatacgaatggcaccaaacacagtgacggcttgtgtattttgatgagaaaatcagcacaatggataggataactaaagaatcgttctgaataattgaaacagttgacattttctcacccaccttatttatgattggaagcaacttgaaatacttaccagtacaagaaaacggctcaaatgattgcccgattctcttatggcatgtggagcagagcaatattttactgcatctgaagcctttgcaacgggacaatctctctgatcaggaatggtacattatcctctctgcaacaccctcacacatgttcttcgggtggctatcgctcagccacggactcacagctatacctgcatacaaccttacaagcctgtcaatctgccacggcgtgccggcctgggatgtgttcattgttcatgtcccaatacccaattcgcaatgggcgagaagttatcagaagaccacgccgtgtgttcatcagccgtaacgccgtatgcaccaattgcaatgcttttccaatttgctcaccggttgctgggaatgttgagagtttacaagatgagagtagctaggcaggcatgtccggacccagctgataccgacgttgcagggaagcacagatggactgtatagcagtagcacgggaacagtgtacgagggagcatcgctcatgatgttgtctgatgaatggaaccaaagtagtagacccgggcacgcctacagtggaagaaaaccacaggaattttcataccaacacgtcctgggtctggacaaacctcccacagtcccacggtaacaacaacggcatatactgtgtttagttccacgctaaattttaaagtttgaagaaattgaaatgatctgatggaaaagttaaaagtttgtgtgtacgaaagttcgatgtgacagaaaagttaaaaattttttttaaaaaagttggaatctaaacagagccatagttatttttttcatcagtacagctgtgtgtaccatttgatgcagaggctaggatatttaattcctttatcaaaaacgtttttaacactactagcagagagcaatattggccaacaaatgagactgatattttgatacctgaggtgcggttgcgatgacagcaagattggggcatagcttgcgaaccggcgaaagcggatcggaacaagaagagacggggtcccctaatctaacgctaaagctctagccaaacaagtgcccgagttttccccgcaaaaaaaaaaaaaaaaaaaaaaaaaaaaggaccaagtgcccgagtttgagtgagaatccggggaatcaaacgcttcaagacatgtgtaacccctatggcgtgtgctagctcacgtcccgtcccgcgaccacgacaaaacgccattttagcccgacgcgtccagcttcattggcctgatcacacagtagttgaacctgccctgtttatcagccatgatgcgtcttggcgctacgtgagatatgaccccgatggatcgatcgctggtttcactgcacgatccgtggcaagcaacgcaagaacccttgggcgcaagtttccttcaccgattgggtgactgatctctgatctgatcagtttttgcttagcccacttttgtgtgtgtgtgtgtgtgtggttgttgcatgcaactgtggaacacattatacacaacatggcgtctgatgctgctgcgtatggtggctgggttggtttattggacggccatggccaaaaggcttagacgtcaagttatgatcctgagaatgtgatccagtggatggatggatgctactgtcagatattcagattgccaatggtggcaccatgctggattgattgatagtccatgggaccccggtcttctttcttgatactgttgttacaaacagggttggcctaatcatggattcccgggacatttccatgtggaaattgctgtgtagtgcaggcccgtttcacgcgtacaacaccaatggcgagaacctgatcagacctgaactacagctacaaaaaaaaaaaggacaaaagttctgaagctaggtgacatttcgtgtcaaagtatggtgaccagttttggcaaaatttgctacaggacacttaaaaatatgtaattagctgtgggacaccgcaaagacgtgaatttgtctgaggacacttaaaaaatgtggtaatttgctgtaagacactgaacacattaaaatataatatccacccaattgataagagagaaaccacacaaaatgacatttttgcccgtatcttcttctcccctctttcagtcttcttccaacgctcactcttgcagtgagctccattggcttgcccatggtggacaggcgctcagcgtagttgacggtgcggtcgcacggtatgccgagaatgagcgtagcaggaagttcctcacgaccgtttagataatttaaaggtgacggatttcctcgccgctgcagccataccggcatccaccaccgcgccgctactgcctgactccgagccgacggcgaccacggcgccgacactgtcactgcctcactaccttgcttgttctcctttcaaccagccgccatcgctccatgcgctgacgtggacagactttcagcgccatgccaccagtgccgctctgcgcgtgccccgccatgttcaaggagagagagcgcctccgccggagcatacacgccatgcaccgccaccacctccactgcactctgatgttgcggcgatgtggtcagcaagctccggagtcagttcttgatcatggccagcacaatgccgccgttgccgttggctgtagtggcactcaccatatcactgctgacgccatcgtggatgacgagctgtgaggaggtggctaccatgacggagtcagcgaagtggagcgaggaggagctaggagggtacatgtagccgacgctgctgccggagcttgcgtagcaagtggcaccggtgctgcccttgccatgatgctgctgttgctccgagaaggagatgatgccgaggaagtcctctagcttcggctctgcggcgagcgccgacaagaaatagatggggtgatggggattggggtcggccggtcggggatgtattggggaattgatggaggatcggggaaaagaagaagggcaaaactgtcattttgtatgatttctctctcatcaattggatggatattatattttaatgtgttcagtgtcctacagcaaattaccatatttttgaagtgtctttgggcaaattcacgtttttacagtgtcccacagctaattacacatttttttaagtatcctgtagcaaatttttgccatcagttttttacatgccgtgaagaagttttgtatcatcttgcaaaataatttttcaaacttccaacttttccatcacattaaaatttttctacacacacaaactttcaacttttccgtcacatcgtttcaatttcaaccaaattttcaattttaaggtgaactaaacacatcctttgtttccttctaaatcgcttgaaaaaaaaaggctttccactcggtttttgccatccaacgatcacctgatcgatggaagtgggagcatcacgaaacgagcggcaggactgacacgagagtagtaaaaactgcaggtctgcagccttaacttctcctgtcacccgctaaataccaaaactacccacaaaatacagcaacatttacagcttcgacactgcactcaatgccctcacacgctaaaggccaagcaggggtaacagggtcatttccggtgggaccgatgtgtcagtcgccacgtaggacaacgtttagataggcacgaccacgcagcatgccacgccgatctcctcgcgccacgtcacccctccggatccctttaaaaccaggctctcctcttcgtcttcttccaacagatcgacaccgaaaattcgaagcaaaaaaaggagaagaaaagaaaaggaaaaaaagaaaagaaaaacaaaccctagccgcaccgatcgaagccagtgagacgccgccgacggctatgcgtgaggcgatcgtcggtgaccacgatcgccgccgccgccgcacccgcatccagtgaaaccctgcactgtcgtctcgttcggttgtgaggagatgagggcggcggcggcggcggcggggcagatcgatccgtcccctggggcgccggcgaagtcgcggctgaagaggctgttcgagaggcagctgctgcgggtgtcgccggcggagaggctcccgtcggtcgcgggtgtcggggagaaggatgagtcgtcggagccgagctccgtgtgcctggacggcatggtgcggagcttcttggaggacggcgtcggcgtcgagcggccggcgggcgccgcgcgctgctgcaattgcttccacggcggggaggcgtctgacgacgacgacgacggccccgctgctgccgaggcggcggccacctccgacgccgcagagaccatcaaggtagtgtggtgtctccgccaccgctagttattatcctcccatgttcgccgcgttgccggcggcgagaaggcgacgaacgccggtgctgaccgtttctcgcatttctcctcagggcctcgtccactgcgccagcctccgggaacgcaacctcctcgccgacgtctccacgctcgtcgagcgccaccgcgccgcgggggcgcgcaagcgcgacctcctccgcctcctcgccgactcgctccgcgcggcggggcacgacgccgcggtctgcatctcccgctgggacaagtcctcctcccacccaaaaggcgagcacgcctacctcgacgtcctcctccctcccgcctccgaccgcgccgagcgcgagcgcatcctcgtcgacgtcgacttccggtcggagttcgaggtcgcgcggcccaccaaggcgtaccgcgccgtgctccagcgcctgccgtcggtgttcgtcgggaaggaggaccgcctccgcctcctcgtggccgcggccgccgacgccgcgcgcgccagcctcaagaagcgcggcctccacctcccgccatggcgcaagcccgagtacatgcgcgccaagtggctttcaccctacgagcgcgacgttccttcaccgcagcagccagatgcctccgccggtgagctcgccgtcgacggcgagggaggtggagcgtggactcaatgattgatgatcaaggactcgtcttttgttgattcttttttcttcgggaatttgcatttgcagcgtcatcttgggctggatgcaaatgttttattctttcttttcctttcctttttcccccttcatttttaccctttaatgggtttcattttggccatggagtagtagtaactgtagtagtaagcacggataagacgaacgggaacaaaaaaaatgtagtgttagttgaacagaaaaaaaagagagataatggattacggcaatatctacttctttcagtttcagtgttggtctgataacagaagataaatttaacttaatggagtacaataacataaaggaaaaacagttcagaaaaaaacaaaagaaagcagtacattgctcagcgaccagtttttaattggaacaatggaacgtatatttgcatttcatcaagttatttcttgttgatttcctatccggttcctgtaatttcacgtggagcgggtgtgcaatttgctgggcctttccagttttgcagaacaagataccgggaaccgcagtgacagtagcttgatctgaactctgaagtgtgttgacatggagcggctttgatattttgcagcttcaacgtctccggcatcgtcatgctgatgggtttagcttgtgaagcggagctgaagaaatggttataaaaattcttaatggaattgtttaagctgaggttgctgtcttgtgcaagctaaagctcaggtggggggaaagaagcaagcaaggcagagaaaagagcaagtggatataggaagagtatataaatctgcatcggtatacgcgcttcttatgggttgtttattcctgctagctcgatgagaaacggcgtaatccgaatctggatcataagataatctgagcaggtcacaatactctgtagatctaacttaactgctttgtcgatcctctgcggcctctctctttgcttgcttcccatgtaatgctcggtcgatgattggtgaaagaaggaatccacacggcttaattgtactcgatcgatgagtaatagcacaataacctcatcccgaaaggccaaaacttgtccactgaagtgttgttatcggtcgatctgtcattctgtactcctttgtccagccacacggaacgaacatgctctggtgatgcctggacgcccggatcacgccagagagagatagtggtggtggtagaaaaacaaatcgcgagcgcgaaatgcacttgacgaggcggggacgcgggccgcggcctctctcccctctcgcggggaacgcacggttgttttcgcgtactccgccgccgtacgcgccgctcgcgacctgtcacctccccaccgcacctgtggctcgtacgcgagcgcgagcgagcgagcggcgcacggcgcacacgcgtcgtcctctgcaaactgcaaggcgaggcgattgttgggatcgactcgcaaatggccgagacggggatgcaccgtgcgcgcacgtactccgtactccagtaggagtaaacgcgggtgggggtgtaccgtgtatgcgtgaccacgcaccgctcggtggcgcggcgcgcatttacggccggaatggcctcgcatcggcatgcctccccgtagttttttcagttcgaaacggcacggctgttccggtcgtttatcaatttatcatcgcactcctcgtcttttttcgggggtttccgttggaaaagggagagcagtagtactggcgagttggctcactccccggggtgggggagagaaaaagcttttggaactgaaactgacccgggtaagaaagcgtagctttattgcgtgctccggctgtgcccccgctgcgcatcacacaatgattgtactccgctgcatgcaaaagcaggcagggggaaggggaacgaactgcctccccgtgcctttctctctcacactcgcacacagacacgcacctttcctttcctttcttctctctcacacctccctcttttgtttctgaccgggaaaaaagagacagccatttcgctctcccctctgtgtaaaaatgatctgtttggtgtcacacttgatgagtcatgaaggggaccctcctttgtatcggtaccagtacgaactcttcttgatcttatctcgcagaaaatggccggtctcacttcaccgagaaacctcgttaggtctctgacgcttatttaccaccctatggcagaaaacctacatggcaccaaaccgatcatcaccactctttctcccccccccccccccttcttcttccgtgcatcacaccacataattcatcgatcgattggggggcgcagtggacaatggtacatgcatgcttggctgcaatgactgcgtgacgcttgcggcccttgcaaggggcgcaaacgcaaccgcggcgcgtaaatgcgtgctccccctttcgcagctctcccgtcttctctcacaccacaccacccggctgcgtcagctacgcataaatacacggcagcctatagctgcactgttgcacacaactccgggtggtagtaggagtgtactagtacgtagtacggctgcttgcacttctcatgcgatttacgcctgctttagttaccaattttttctttaaactttcaacttttccatcgtattaaaactttcatacacacaaattttcaacttttttatcgcatcattccaatttcaatcaaacttttaattttgacgtgaactaaacacacccttaatcaagagtcacctcgtcatcgcgctactccgactttacactagcaccagtacttactactccctccgttttataatataagagattttggatggatatgacataatgaaactggacagacgatttattgtactataatattatattatatccatctaaaacctattattataggacggagggagtactctactactccttcgtacgtataacgccgtaacgtggcagtgatgacgcgatttattactaaaataatactggtagtcttgtactgctacaccttgcagg

SEQ ID NO: 61084 - DNA, 6271 bp, Oryza sativa
catgtcaaatcagtactcaaattagtgatgatggcgcgaagaaataaatcagtaaatctaggataatcagctgatatgcatggctcaagaatgtagatgagggccctattttctccaaggttgctcacggatttactatagaaaaaaagttgatatcaccagttggtggaccttggccatttgcaattattgggctattctgtgagcagcccatgacactgaattatctgtcacttttcatcagtatatgcaaagtcaaatgtactggaaaaaaacagcatgatacaaaacttgcaaaattacaacttgcacgcctaaaacttgctctccatcattgcatctcaagcaagacagttttttcattttcagacgcaaaggaaaatcacggatgtagtactagtactccctccgtcccataatataagggattttaagtttttgtttgcattgtttgaccactcgtcttattcaaaaaaatttaaaattattatttaattttttgtgacttactttattatctaaagtactttaagcacaacttttcgttttttatatttacacaaattttttgaataaaacgagtggtcaaacaatacaaataaaaactcaaactcccttatattttaggacgaagttagagatcagtatagaagttgcacgcatgctaggaatattcaggccaaggagaagatgacaatagaaaccttataggggacaggaggattaggtcatcagatatgctcatatgcaagctatccaaaagtgaccaatggatcgattcccttggcctcacgagtttgtgtccttacatacagacatgtgactccaaaacattacatgacaatttctcttaatcatgcctctcaggcagactttgtcagttttgactttggcagtaattacatcttacaagtaagtaaccactaggcaaaagagagactaaccatagttttacttcaaccacaagactaacctaccttagttttcttaacttgtaatctactgtttcagaaatgttcaagctctagaatcaagctgaattgctcaactactgttgccgtcggcttacttgtcccaactcataatatctttggggttacttactacacgaccacacatgcacgaatgcaaaacggaatcttatcgccattaactatcctaattatggtgtcacaaagctaagcttttagttgtcgcaatcgtgggtattagtgtgtggtgtgatttcccgtcatgaatggattctctcgtcgtcgtcatacacactactgtactgcttttaggatgattggaccaggcatttaccggcgattcttatggctaatacactacttttttttttctgctagtaccaagtagtatatccctagatcacacttcatcaaagactgaaagtgtaacatgtgctaattaatatgctatattattctcgagtaaaagtgcatgcatatctagaccttaatgttcttttcttcaaaaaaaaaaaagaaaaagtagtatgcgtctatgtctaattagcttgagttaattacaacagcaaaagtaaagggaaaggaacgagagtgttaagcatggacttacgaagaagcgggtgatgaggaggaagaagaggaagccgcagcccatgacgacgctctcccatcgccactgcaatcaaccaatcagtcagtcagtccaattcagtcacgaccacacacacacacacacacacagctcgtagatcaaatcagcatgtaaaaactaattaatcagcttaattgatcgtagattagagctgtaaaaactctccggttttcatcgcgagaagaaactatagtctagtactatactcctaggtaggagaggtgaccggacagatcgatcgagacgaggttgcaggtgcagggtcatgtccctgtcgcagttacactcgtcgtcgtcctcctgtgtcacctctccccgttgcggacagacagattgccagtggccgcacgacgcagctagaatactattcactccattccaaaatatatcatattttaaaccgataagatactttctataacaaatttaaacatagagtctgtttagatttatcgtactaacataaaatattctatctagacagggttcgtttgaaggacattgagggaaaaagcacctcgtttttcgcacgcacgcttcctaaactactaatcagtgcgctttttgcaaaaattttctatagtaaagttgctttaaaaaaatcatattaatccatttttaaaatttaaaataattaatactcaattaatcatgagctaatggctcacctcgttttgcgtatcttctcaatctcctcaatccccttcttctcaaatacacccctaaaatcttttatattttgggacctaggaattaggcacatgtacaccgacactggcttggctaatgcaaagatccatccgtatacatgcataagtacatgtactgtacatacgtatgtgtattcgaattagatattaaaaaaaacgtgaatattagaaaatgactttatattaaataattagaaaggaggaggttttaaattcaggtcgactagcccatcatcttgtaaaactagtcaaaatcttgtgaaactagtcaaaaagactcctcaacgtttctcggatatatacaggagtagtataatttaatgtgtaggtacgtacgaggtgggtttgggagaagacggagctcatgacggagacgaggtcggtggcggtggtgaagtggtcgaggccgaacatgcccttgagctgctgcaggcacaccacggtggcggcgccgcccatgaacccgacgatggtggcgtgcgacaggaagtccacgatgaaccccagcctcaagacccccagcagcgcctggaacacgccggcgaagaaggtggcggtgagcgcgacgtgcaggtacagcgccgggtcctccgccgccgacacctcctcgctcagcatcgacccgatcagcagcgacgccaccgccaccgtccccaccgccaggtccctcgagctccccatcatcgcgtacaccagcggcggcacgaagctcgaatctgcagccaggaacacatgtcgaacacctggtcgtcatgcatcatcgcatcaatggcgtctaagctagctactgtatgtgtatgtgtgtgtgcgcgtacagaggccgaggacgggagggaggttggcgagcttggcgtagctgatgccctgggggatggcgaggctggcaatggtgatgccggcgatgaggtcggacttgagggtgccgagggtgtacgacggcgcccactccatgaacgggaacacgtaccggagcgccgccgccgcgcgccgcccgcacccgcgctcccgccgcaccaccctgaacgggtcgtccggcaggaatgtctccttcatgttcccccccagcgtctccaggaacggcttcgccgccggcatcggcaccctcgccgcccccgcccctcctccgccgccgttcgccgcgcttccactacccatcttagctcgtcgcactccttcgtctacctcagctccggcgaccgcgcgatcgagctagagcttggattaactaatcttaactgcgcttgtatgtgtgagcgagtgagtttgagatgagcgttgttacggcgagggatatatatagcggccacggcgcggcgagctcgagctcgagctcgagctcgagcgattactatggcggcggggcccaccaccccgccgcgtgtgggtcgcgatcgcgtgacgctgcgccgtgggtcccacctgtcagtgagacgtgtcccggagcccccggcacgcgcgcgtacgtgtggcacgcggccacgcggggggaatgataagttgggcacacgggacacgtcaccggtcgctgttggtgcaggttggcacggggtgtctggctcgtgtgcgaccgagcctgacccgacccgacccgtatgtggctcggctacgcaaatctcccggtttttgcatgctcggttcgtcgattaatcgggtaaacaaacgggttcaaaaaaataatttttgaggggggagtagagaaatgacgcatgtgaaacacaattttcagacgaatttttgttaggcacaaattcagtatattctgactattagccgctacatactccatccgttcaaaaaaaagacaaactctgattttccgtgtccaatatttgactatccgttttatataatttttttataattagtattttcattgttattagatgataaaacatgattaatactttatgcgtgacttgtctttttaaaatttttttataattttttcaaataagatggacggttaaacgttggacactgaaatccagggtttgtcttttttttttttttagatattactcgtaaatatgtgtctggctgagacgtgtgttcatgttactgtcacgctgcagagatgatgattgatgatgagatgggccacctgcatccgtgtgattatagtgccgtgttttgttggcacgttcgtacgtgattttccagatttgctgggatatcattccacagatacaaaccgggtttaactcgtccatctctcgtgtcctaactcataaatatgaccagtaatttgactaaaataaccaaagagcatgtggatatatatagaacatcgtatcaggccaacgtggcatgccacgtggtttatgttgccatttggaacagagagagcacttgtgtgatgacgtaatctcatacatatgtaaactatactgtttgttgcgtgctgaatttatttttttttaaaaaaaatgaaagacaaggtgtatatatatgtatacgtcatgtagcgatcctgcggccagatcgagccaaagaaaagagcactaatctagatactctttctgaaagctaggccaatgcaatccacacaacaaaatcaattaactaataactaccaaaagaccatttaattagagtatcttcccaggagacggcacggatcgacgtggcctaaacacccactaatccaacaattaagacgcacaaacacgtattaaccttttctcaagatcagtggctgctgccccagttggaaacgccttttaaattagtggcagtatgatgataatgacaatgataatgatgatgattaatttgatcatccaaagtgtgtgggtatccaacacagtggcaggcaaagctagcttaagctgggctcagctagtggccacagttgctgcactcgttgcgttgccttcttgacctcccaaaaacaccacaagagattggagattagccccagcgaccgatcgacgtcttaatcgaatcattgaccaccctgcatgagtgcacgtgcatcgggcccagaaacctaataattgaggccctagaagatttgttcatcggccaggccttgtttagattcttaaaaaattttggccaaaaacgtcacatcaaatatttgaacatatacatgaaagtattaaatgtggaaaaaaaaaaccaattgtacagtttgtatgtaaattgcgaaacaaatattttaaacttaattacgccatgatttgacaatgtgatgctaaagtaaacatttgctaatgacgacttaattaggcttaataaattcatctcgcagtttacaggcggaatctgtaatttgttttgttattagtccacgtttaatacttcaaatgtgtgtccatatacttcaaaaactttacaccaaaacaacttaaacacaccctaaccatttttacactatgtttcaaattactcattgttttagtcttttccaagttaaacatgagtatctttaaatattattttttaagaaaattaccgagtttaacatcatgataaactataattacagagttttagtattcactattagcaatattttataagtacacaattcgcatgctagtaaactataaatttttaaatgagttgataaaaatagtaatgtttaacttaggaaaaaaaatgataagtaattgaaacgtgtgtagtacctgttatggtgtacgcgattccacgtcactaattaaattaatagatagcgaaatgcctgctattttagaaatttgaaagcgtcaaaaacattttcgatttgaattcttgggttgaatgattgaattaattgtttagctcaattatcagttagctcgttgtgcaaggcaacaggtcagtgtgatgcagatacgcagcgcagcgcgtgtacgccaccgaaagagctaattagacgcgtatcagcttatcagcgggtcaaagctgcactaaggcgttgacctctctgaccagagctcagaggaaataac

SEQ ID NO: 61085 - DNA, 1852 bp, Oryza sativa
gactctagaggatcccctgagaaattagttggatgcaatccaaaggttgttcagttcgaggatgtcaacaattcttagctagcagttgttgatggaggagtaacatacaatggcatcatcgatgcaatgggagaggatatcattgtgcatatcattttcaaactttctcttcggcattgcttactcaagttctaaccaaattatttgttttgttgaatgattgtaggttggaccgtaggaagagcaagaagattacggactggcatgctcatcatctccatcttattgagcggtgggacaacatagcagctaacgtagtgcctcacggagtggagcacaacaagacatacttcgacgagtacctagcttggctcctgaggaactaccgcctttttcttcggccggcatggactctagctgacatagctacagatcccgaggatgttgaggagatgaacgagtatgacacccacactcgagcaggggcgacggtcgagtacgggcctgtacgtgaccgagtggtaagtattaaggctcagagttgtcatttcacatacacctacatgttctcacaatattaaatccacttgcaggcacgtgagctgatgaggtccgtgaacgacgcgggtgttgcccttggcacacctgctgggtcagagaatgaagttgggatacttcggagcgcacttcaggtaattaaccaattagttcaatccatgaatcatttcacttgcctctaacttatttgttttgttcttgcagaggctaaaacaacgaagtcggatgttagcggcaagacttggttgtaggtccacaaacgcagtcgacccacaaccaagactaacgcggacacaggccggagaaacaagtcaacaaagagctgaagaggaagggtaggaagaacatgatgaaggggaggaagaacatgaggaaggggaagaaggagatggacagagtgacgaagaggaagaggaacaacccgaagaaatcgggtcatctcagcttgcaggtgccccgcagccatcgcaaccttcccaaggtcgcccgcatagaaagagagcaccggtggaccggtacacaccttccactagtggccggaggggtcggcactagtggattactttgtacttaacactctaagcagcgttagacttatatcaaactttagatgatggttgatggatgtgttgaactctatattttgtgatggttgatggatgtgttgaactctaaatgctgtgatggttgatggatgttcagttgctgtgatgtcttaaatactatgtggctgtcaattttatgatgctgtcaatttctgtgtggctggctgtgctatgccagccactgcttgacctcagcgccaaatagaatggcgctgagattgtgcaggtcagcgccagagcagttggcgctgaggtgcacaagatcagcgccaaggtctttggcgctgagatgcagcccactcagcgacccagccatccctcgggtggcaacctcagcgccaaatcggctggcgctgagattcagcccccccaaacgtcagcagacggccatacaccgaaggaaacggccgtcaagtactcagcgccgatgcggttggcgctgagttgttcaacctcagcaccgtcggccttggcgctgaggtcggggtccagatctggtgatagtttttgccagggaccaaatttgcaaatagttttcaaaaagggccaaattgtcaaattttcggttgatcactgtattgttgcaatatccctccacgatcaaaggcttactttgggctcggtcgctccaatcaattaagagattgactctgaggttgatgatatacaatgttcaattgcgagattag

SEQ ID NO: 61086 - DNA, 847 bp, Oryza sativa
aatttcggacatccatttctcaatctaacgatagttttcaagtttccactacatatatagtttgcactacatattttccttattgaaaagactcttcacagtagcaagctagcatagacatcgtgcgtcgttcttctccaatcctaaggttatacatacctttgggttcgtcttcaaggctcttaattggtcgttggttccgcgagtctttgagacaaagttaggtaaaaattttcacactttgcatgcaaattagtttgtttagtaatgcctcatagagtcaaagcatgaactattttctccatattttcatatatacaagcatattgcttgtgcgttaaatatacagtacatgttgtacaaacgttaaattgtaaatgttgtgtatacttaaatgtacataaaaatattttaaaaaattgtgagatgtgcaacatgcatgtacaacacgtaaaaatgttactcaaaattatcatatgcggcatgttttgacttagtttctacttatttttaagtctagctaactctcccttagtctcaaaataactttactttagcctctacctcgtgtcaaaataagtttacctttatcaacttacctatatcatgctctaattcacaattcgatgattttttttattccatcaatatcttttacctatccttacctacctatctacctatccacacatactagtttcctattagtgagtgacactttggtgttttttcttctatattgttttgaacatccaagtctaaacttaaagttattttgaaatggaaggaccgaagggttattatcttattaaagtgtaatagcaaagaaataagcttgagtattggg

SEQ ID NO: 61087 - DNA, 1245 bp, Oryza sativa
cttgctcttcaccacgctgacgatgacggtcatggcgttcatcctcaggatagacattatgtctatcagagacctgccctgatctgggattattgagccttctttgcttcaatagcctttgccgcaaatctgaactgtctgcagtcaaaggcataggttctctctgagaaaacctactctctgacaacaatttctcagctgaacctctgtgtgacctttcaaatccataactatcatgagtttgcctaagcatcccaatgtgctgctccccgttagtacgacggtaagcaccacggtcttccctgagtgactgttcagtattgtcatcagcaccaccagtaagaacatcagaaccaggagaaggttccctcacaaattcacccatctccacaccattttcagctaaatcgtctccagttgagggtggaggtcggtaattctttgttacacccgatggcatataagaaccttttttatcatgaataattcctgacgagtgaccagccctgtttgtcaaattttgcttctgagcagttttgccattatgagcactgtccttaggcttgtcaaatatggcaggaggtgcattctgctgagcagaagagtttggttttgtccacgagttcttcaactgaggatgaggcacagaagcaggagcaaaaacctttgttgtgtgctgaggggcaggacttccagtagcctgtggcaaatgcaagaaggcgcacctatccccttttacgcacatgcccttttgaaagtaataacatggaactccttgcttggctgtgccactggcaggattaggcacaggagcttgagcaggcacagaaacctgtggtgcagattgttgagatgttcgtggtgttgtgggtgctccgaccaggccatccaacggctgaaaagtgagcaagattattagttatcaaccccaggttgctcgtagtatttgattgagtaagtattatcatgtgcagttgtgtacaagaattgttgccacaagaataagctaattggagaaacttatatagtagcttacagtgtcggcatgtttcgcagtggcactaaacatataataattgcagtagttttggttgaagaaaaaaaaaacggagagcaagggagtaccgggtgcctgaatgagcatttaggattagcgcagttgccattgaaccaataccagcaatccctaggattcatcctggcagcatcactatgacggtactcacattcacttccctgagtgag

SEQ ID NO: 61088 - DNA, 696 bp, Oryza sativa
acactcgtacccatcccgcacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatttgggccctttcaagcgatgcacccgatggcgacttgtgccttgtagctaaccaaaaaccttatgcccatcagaagggtgtcaggtgggtgatcaaagctcttgcccatatggttggaccattcgggaaccggagaacc

SEQ ID NO: 61089 - DNA, 15573 bp, Oryza sativa
cccccccccccccccccccactctcctcgactagctatcttgctggtaggtatattacagggacagctccccctcccctcgccggccgtcgcgctctcgaagccgtacgctgttcaaagcgaagcgaatcgaataatcgatcatatccattgcctaattcgtagcacgtcgatggatcagctggtcgtcggcgtggcgcggccgtcgagcccctcggcggcggcgcacgtcgcgtacaagatcccggccggcgacgggccgtacgctcgggccaagcactaccaggtatatataagctctgttttctctcgccggcgttcatggctggcgccgccgcgtccatggggaaattatagctctctctatatatgcatttatttatatattagtagatgctttattaggttaggtaattaatcaggatctagttaggaccgagacttggtacaaaggccttaatggttcttgctcgcttatttcttttttcgaacgaattccttaatttgctaacttttttttgagaggaagatctggctaagttgtttatttggttattactgcttaaatttcgatgagaatatgcagaggaaaaaaataaagaacattacacggcgtaagaatacaataattaattttataacgtactccatatatatacatgccatatggtacagtctttactacaatttaccaattaatggatttcgccaggttggctaacctcagcagatctaatattgggggtgttcgtttgtgctagctctgacagctgttatggctgcagccgtagttaaatttttgatagctactactattgttacagctgtgtatagctgcagagtagcggaaacgaacaaccccattgtaatctactcccaactggtacaaaatggtattaaaatatattttagatacatatttcatattctcggtccttttttgaaattaaaggacctatatgtcctctagtcatcaataaaatatttagttttgcacatcgatctatcttcgaacaacaccagccactattttctattattgcatacactttaactcaacgatattttcatacattgaatctacttattaatacttagaaaattagtactatataaggtcaaagctttaaaatattttttccataaatatttctagaaccatgcacatctataatttctatttagtcagtactcactagcaattttagaagataataaagattattatacaagtatattacaacaacatctactagcaattattgtactagagagtatcttaaatctcattcaagtatgagacatcatctagaataaaatattatataattatgttaaatcatcttcctcatattattttcataacatttcaacttccagtatttcatgatatttagcatatattcatctattatttgtgtagtaaaagcataaggtatcacctagtggttctatatgactgaacttccatatacaacggctttgcatgcatgcatgcatgcatggtaacgcacctcggagctagctagctaacgaagttcactttcttttcagctggtggagaaggatcttgacgcgtccatcgcgtggttctggaaggcgatcaactccggcgacaaggtggacagcgcgctcaaggacatggccgtcgtcatgaagcagcgtggctaccacgccgacgccatcgacgccatcaagtcgctccgccacctctgccccaagcagtctcaggactccctcgacaacatcctcctcgacctctacaaggtatcctctcactctcgaccggccggcatgcagtaatggccgctgcagggcggatccggcacagggatggcggaatctcgagcccccactattagcgtgaagaccatgagaacccccacaaattctccgaattcttttaccatacgtagatgggagagaggattatagctttatctaattgttcagacccctctgttattcagtaaatgacattgttgatgatgcaggcgagcgggaggacgaaggaggagatcgagctgctgaagcagaagctgcggaagatctacctgggcgaggcgttccacgggaagacgacgaagcgggcgaggtcgcacgggcggaagatccacgtctccgtgaagcaggagacgtcgcgggtgctgggcaacctcgcgtgggcgtacatgcagcaggggaatttcatggcggcggaggtggtgtaccgcaaggcgcagatggtcgacccggacgccaacaaggcctgcaacctcgcgctctgcctcatcgagcagcgccgccccgccgacgccgaggccgtcctcgccggcgtgctcgccgggaggtaccacgcccgcgacgacgaccacggcgccccgcacaccggcggcaagatcctcgccaaggtggaggagttgatggcccgcatcaccggcgaggtcgacggccggagcaacagcagcggcggcagcagcagcgacgacgacgaccgcgacgtcgaggacgagatggtggagctgctagacgtggtggtccggcagtgggcggcgccgtacaggaggagcaaccggaggctgccggtcttcgaggagatcactccggtctgcagggagcagatggcagcttgctagaagatggtaattaattaagagtagtagcaaattgttaattaaattagcaggtccatcatctagtgttgggtagatatatagaatttcatgcacctatccgacgtgtcaacggcttcaactttatagggagaactagctgcaggtgcatgaagctaagcatgcatggatgtttttttttcttgtgagtgtgtgtgtgtgaaattaatagtgtgagatagagaagtataatgtgtgtgtgaccagttgcatgttttgtactctggttgtgttgttgtgtacttatgtagagttgataagtgcatggcttggtgaaggatataaatgtgtacataaatgtctggtgtattcttcccaattcaatatttccgttggaaaaaagaaaatattttctatctataaagcttatgcccattaaacacctaaagcttaacatacaagtataatgtatttattgccactcctaaaatctgcatgcaaacatgccacatcaacccattaaggtggtgtttgggaaggatctcacaaaaattttagtctctgtgggagagacttatacttttgtgagagtgagacttatacttttgtgagagtgattaaagtctagtccctccttcccaaacaccatataagtacacaaaactcaacatgcaaacatataataattatatctataatttatttcattctaaactaaacatacacatgctaaatcatcatactaaaatcattttcataatatttcaatacaaattatttcatcatttctccaacacttaacatatagggttcccgcagcaaagcgcggggcatcatctggtttttatgatgaaggataaaagtctaatcatatctatgaatccggacatgcatatgtccaaatccattggtagcgttggatttttttaatgatataaagggtgtatgtattaacgcattatattatctgggtatatgaaaatagtgtgtatattattttagaaaatcttctttaatacgtcatttgctccatattacaattaatgtttgttctagtcaaacttttcaactttgatcaaggtgcaacatttttaacccaaaacaaatatactataaaaatatatttagtggtgtatttaataaaattactttggtgtttaaaacattatcatatttttctataagattggttaaacttaagaaagtttgacttagaacaaaaccataacgtcttataatataaaataaaatttctttatacaatattaggtccgttttattgcctaagaaagtttgaattggcttctcactgtatagttgcaataaaaaaatatcttgatatcatatactagtaagatgcaactgtttcaagttaaaaagggaggatgctatgtggcagtcaaacagtcgttaaatatagaagagcatgggcctggacaattagctctgtacgaaatatattgaagcaaacatgcaaaattacctcttctgaattacaagaatactagtaatattacattgtagaaagaatatggacatccctgtacaagcacaggagagggctctattatatattgtgagcctttgggtccagaaataactaaataaaagttgatgagctagcaacaccatcaatcaagctgatagattcatggtgatttcgcactccctatgtgacagttttgtttcaaaacaataaccctctaacacgccctttctccttttttatgtgtgccctttcttcagcattatcagaactgaaggctatagcaaatattaggtgaggtgagccgtatatgtgttgtgtgttaccagcagttcaagtcacggcaaaccgtcaagatgatgacgaggatcaatgcaacgacaatgccgaaaacaatgagcttcatcttcatattctcccaccacatctttcgccgaatctttgttcccgcttttctaaagtcttgtgcctataaatgaaagaatgaatatcatcatgtccaatagaccacatattgtgcaattaagaggaaataagattatgattcaatgtgagagcaaatgatgaaacctgtgagcggagatcctctgtcttgtcgacaagcagctcaattttctcaccacgatctaaaacctgatgcaacagatgagaagaacacatttccaaggcttcaaaaccaccattgtaggctgtatggaccagtgtccaattggtgacagtaaagggaacactaaccttttcaatgttttgcatcataactcctttgacctctgtaacctgagccttcactttggcaagcttgtcaatctcctcagggtgcgcatcacagtacttcatgtgttctttaagtttaggcctgataaaagaaatcctttataactagcttattcagattgtaattaagggcactcacaccatcatatagccatataaattatgataactcagtaaaattttgcatagaggccatcaagcaaatttttaaaggaaaatacccatattctcgcttgaggctattcgcggtagcattctttgcttttcctccactatatttcttggaaaaatcttcctttactctctcaatgaagccaactggaagttgccgaccagcagactcggtagcaacaacacagtatgctgaaaaccaaatgcattgtcaaatgggaactagcaaaattgaaacaattctatagcagtaactttgctgttcaattagttttatctatactaaacaccaaagaaaataataaaacaataattaataaagatgtggttttctttaacattaaattttacaccaaagaacatatgggatgaatctttttttttccttatggttatatgcgatgaatctcaatgaataaaataggcgtacctttcaaagacaaaaaaaaataacacttattcgtggcatgtaatgtttatataaggacaaagtaggctatggtttgccttttctccaaaaaaccgtaggctatggaactaatatcgcaatgggagtaccaacaaattatcaaagtgcaaatgaaaaggtaatgctaaattgctaagtggggaaaaaaaacctaacttgaacaaacactgaagatctgtaggttttcaataacaaaaaaagatgaagatccacaacatcagataaatgaaatatatattgttgcacattaaaccctctagaaacgacattatgcttataaaaaagaagagttctttttgacaaaagaaaaggaactgtacacctcacttgtccagatcttaaccacatagttaaacgagcatttctaatcaagtaacaacgaaacaccacattaattaaactgatcagtctaacatcaatcaaacaagacaaactatgcacttgcactccgaacacgcccatccaccacattgcaccacgacaaacacggcattaacccagatccaccatggaatagcccaacatgatcccaataagtcgagttgaagggacaaatggtgcaaatgcatgcattgttgaagaaatccgatcgattaaacagatacgacacaacgatccagccaatgccaaatcctaaagcatatccatgaccatgagcagcgaaatggagaaggaaatagaatcgcatccttcaaaacgacgctaatcacatactgtcgatttaaccaagtgatagtcatggaatttttaatatacgagaatcgagaaggggatggatttttttttttttggggggggggggggggggccattactgaatccgtcgtggacatggtagttgaaggtgtggccgtcgcagttgtagctgtggcggttgttggtggaggggagcttctggaggcactgcgcggcgacggaggcgaagttgccggagacctcggcgtggtcggccagcacgacggcgccgcgcgccacgaagctgtagaccagcgtcgtcctcttctgcggcgccatgtccccccctccggccccggccgccgccgcctaggctacgctacgctacgcgcgcgcgcgatcggggaactcctcggcggcagatggagggagggaggcgggcggtgggaatgcgcgggagcgatgtgtgggaggcgaggaggtggggggtgctgcatggagagaggaaggtggtggtggggaatggaggtgggggaggcaagccacatgctaattttggctgatggttgattttctgattttttttcccctcattgaatgatttgctaaatttaggtgttattaatatttgttgtttagaaaatgttataatctagaaagtttttatcgccctcgccttatcccgcatcgcagccgccgtcgccatagccgtagtcttctcctgcatcgcagccgccgtctcgtcgtcgcagccgctgccgccctcgccttctcccgcatcgcagccgccgcctcgtcgtccgcctcatcctcctctcccgcctcgccccggcggcctttgccccagccgccggccggcttgtcggaagagaagagaaagagagagagagtaggaagggagaggacggggaagagaacctgctgatatggcacctgatatatgggtcccatgctgacttaaccaccatgtcggataaaaccggggtcaaaaccgccgagggatctagtttacattggttttgtaagttgaggaatacgttgcatccggttttacggttgtgagatgattctataactcgatgataagttgagggaccttcaatgcacttttatcctcatagatatagctacgtgcggtgactatgggtggtaatgaacataactttttttctgtaaaatataaggactgagttgaaaaaaaggttcggctgacatttaataaccctaacatggacaaaaatggattgtgaaatagcccatgagttctggcccactaccaccgatccggtagcggaaagaaagcccgaagactaaaaaatacggcccgtcccggcccatgcaaaaccgcaaccgtctatctcagcttgccttctctctctctctctctctccatcatctatgtaccactccgcccgcggcggcccgatctccgatccgcacgcagcaaacctacctccagagagagtcgcgtggtgggtgtgggacccacaccccaagtcgaaatcgcgattcgattgccattttctatcgcgcaccctcccccccctccaatctcattcgttcccctttcccatgggccgaaagaagcgaaccctcaacaccgccgccgccgccgcaaaccctactcctccctcccctccggcggccggccaccccgatgcggcggcggcggatggcggcgccgcggtccgggccgtctgcgagaaggccctggcagcgctgcagcgggggaaccacgcgaaggcgctccgggtggtgaaggacgcggtcgggaagcacggggagggatcgccgctgctgctccgcgcgcaggggacggtgctggcgcgctacgccgcggtcctcgacgagcccgtctcccgcgcgcggcaccagcggctcgcgctcgaggcggcccgcaaggcggtcgagctggccccggactccatcgagctcgcccacttccacgccatgctcctctacgagatcgcctccgacaccaccgggtacgaggccgccagcagcgagtgcaaccgcgggatggccatccagagccccaccgacccggcgccccactccctcaggctaccggccccggacgtcgagcaggtcaaggccgagctcagcaacctgttgcagaggtccaacatgacgtccatctcgctgtgggttaagaacatgaacatgggctacacacctgaggataaggttcgggttttccccattcgccgcggcggcgccgacgattcttccgaggtccggctcctgcctgctgcgcctgcgccgcgccgcccgaatgagatcaagaaggctaataagacccctgaagagcggcgcaaggagattgaggtgcggcttgctgcgatgaggctgatggagcagcagaagcacaatgccacatcggcctcatcatccacctcccaatcacagtcaccgggggatgaggccccctcctcgtcgtgtcagtcatcagtgtctgggcatcgcgctgaccggaggaagggtgggtccaggaaggcagcagcttcgccagtgtccggtcgcatgaatcaggtgcgtgagttctgggccacagtgcccatggatcggaggcttgcattcttaagcaccagtatttctgagctcaagtcacactacgctactgcgatgcataaggagaaagatgctgccagtttggtatctgatgtgcttaacgaggcgataaggtttgccactaggagtggaaaatgggagtttttggtatgtggccggtgtgaggagcattttgctgatgctgaatcacatgtacatcatgcaatggaggaacatgtgggtgtactacctccccggttgaatgatgtggtgccggaggagattgatgatgcctgggcagaaaagctcactggttcaacctggaggccggtggatgctactgcggcactgaaaattctcgaggaagaactagctgacaatgttggctcagatagggacaaagattcaatgtcatcggatatttggagtacaaaagataaatcagacacatcagattcctcaacctcgccacacaacgaggagtgtgaaagttttggcgccgtgacaagggaaggtgacaggaagtggccactgtctgatgatgaggaaagagcaaatattttagagaggatccattcgttgttcaaaatcctcgtgaaacacaagaatctttcattgagccatctgaacaaggttctacatattactatggaggaactcaggaagatgcattccgcgtcactgctgcttaaccactcgttggatgagtcaccactctgcatttgtttcttggatgtatcatcactgcggaaggtgctcaaattcttgcaggaacttatgcaggctagtggacttaatgataggaacacagataaggatgaggaagtagctgacaaagatagtttcccaaaaaatcgcagtaacttggagaaggttacacttgattctgattcatcattgcttatccttgatggccaggcatttgaaatgagatctgaccgtgataatgttgttgctgacccattcctttcatggttatatactggaccttcagttgaagagcagctgttggactggaaccatatgcttgatgtgaggtctgatcagtgcacgcacattcttcatgagctcgagaaagagttctcagccttgcagaactcgtacgaacagaagcatgaccagctgagcagtgaggagggcttgcttgctgtggatagccttttatgtgaagagcaaaggcggagggacgacgtggatccctatccatttcaaggatatgaggagctcctaaagaagcgacaggagcagctggagctcaatgctgaggaattgtttagcggttgcagatctgagctacatgctatctctactatcttaagggaagttaaaacagcaccttttagatacgatgaaaccttttctggcatgacctcgaaccatcgtgactatgatgggacagaggaagatgaatggggtttttatgactttgaacattcaaacgattcggtggtacagttggttgtttcaagactgaaggaacatgttgctatggaggtcagttcttctgggtgttcagtattcccataaaaagttatatctatttcacttacagcttaacacgtaacaactaacaatatatccctctcttatctgtttcacttacagcttaacaagatagatgctaggattatgcgaatttcagccgtgattgagcagctgaaactcaagcttgggcctgcttctgtccttgattaccgaacaattatccttccccttttgaaatcattcttgcgagtatgtgtacactaatctctttactcattcaattgctttaatacctccttgctttgttcatttcttaatcgtggttattgtgtgacgattcagacccatttggaagagctggtggacaaggatgctagggagagatctgatgctgcaagtgaagccttcctggctgaacttgctttggatgctaagagaaatgcaaacaaagtgagcgacacaaaacaatcccatgataagtcaaaggacaagaagaaagtgaaggattctcgaaaatctaaggatcttaaggtatctatgcttttgaatttgattatatgtgtactcctgttactcacaaaagggtattttatctttttcctaaattacatctaaatattttctaggatttgagctggagtgatcagtacctcgtccgcccagatagtgtagacgaggagacatcagagcaatcgtaagtaatgcttttactctccttttgctgataaaatcgcactatctaaaatgaatctgaatgcaatgtgttgcgcatgttttctcaaacgtgcatggaatgccttcttttttcatgttcccttttctctatgtatcctcagttacttagtaatgctaaagtgctaatctaaatcacaatcagtgtaaggatttttggttagaaagaactcatttcatatgctgtctgtgttgttttcttgttaaatctagttagcaattaaattaactagttataacttataaggaaattgagaaactagtcagacagctcacagctgagagctgacctttgaagcaagctggaacctgcttacaatattggagaaagtaaattttgtgcatataatcttcttgacatcatgtgaacacatgtgttggagtttacttgatctcaatctttcttttggtaaaccgtttcaaccatgtaaacctgctcaatgtttgtgcatctgttttgaataccgtcttatagtgcttctattaacgtggcacgttcctttcactattacagcttgtttagttgagtggttatcaaatgttgatggttgagtaatcctttattgagccctcactagttgtttcgctctttagcgaagaggaccaattactatactgtcatactgtttttcgtttcctttctcttttgcactggctgctgcatcaatgaatcataagagctccagcccttcctttagggaaaaacaatcctagcaatagtgcccatgcattgtttctgatcaaatagatataaggccagtaccgaactaaaaaatgcataacattatcctcaactttacataattacatattttgcatcacatcaatcaaccagcatgatgcaatccttttaaaaagtgtttatcgtacaaataaaacatgcatacttgcttatatctattcacaacatgaattatgaactgaaaccttgaaggaggtatgtcagaacatatcatcacaaccaccagctccataaaaaggagtaaagaggcatgtcagaacacatcatcacaaccaccagctccataaaaggagtaaaggactgtcatttatcttgagatgtcaaccaccacacattttagaattctccagcaggcggtcagggacatgaaaatattttcgatcttgtggaattcattgctttgaatcattgtttattatctgctgtgggcttcattggaacatactgcagatgttttctaccttccgttaatggctgcattggtttttagtcatgtgcagcttgaattaaaaaaagagaggcagtaatagaatcgtgaaatgcatctcccttttattctatcctattctgcacatgcactatatcacgggtgaggctagtatgcaagaactcgctggtcgtgagggtgcaaatgcattccgaaaaatcttcagcgagggcgcgccgcaacacactcgtgtaccattgtgtaattagcatgctgccgcttaattaatgcaccaccatgtgattagcatataattagggtgcagttatttgaaaatctcggccgcatgcatatgcatttggctgataaaatccacaaagtaattaagtgttattgtggtgtaggttaaaaaaaagatagcaataccttccaatcaataaatttttatccattttttaaaacttcccattgtgataaacacctattcaaattttaaaatctctactcataagttttgtgcaatataaaaagtttgtattcataaactttctatagatcaatattaccaggagacttttgcagtaatttaaatgatctactgatgggattttaaaaaatgcaaactgtaagattcaacaatctctacttataaactttctatatgataaaagttctatttgaaaacttttacagtaattaaaaaaaaactagtgatggaattttttttacaattacaaattgtaataactcagcgagtagaaattttaacaatgattgcatctacatgcaaaagtattctatatatgcaaacatgcatgcacatatagagctgagcgtgggcccacccacgtgcgcatttgtgctatctcggctcgcatgagcgtcgcagagtagccttttcgctatatctcccatctggtgattcaggactcatgcaacaccatttcttgatatacaatatttggttgttttgtttgaattttgggagtctgtcattctttaggttcatgtaatggtggtcatagtgcatgcccctgtgaaaaaaccattcttgaatagaagtgtaatctttatcaacattgatattattatttgctttggaactttcatgtttggatgagttcaattttattgaccatgtacactattgcagtcagactcttgttgattgtgatgactttgtctgcagactttcaacaagtgataattacttaaatgatcaagaagaattcaggaatcgattacgacttgaagcagaggaaagaaagttggaggaaactttggagtaccaaagatggatagaggaggaagcaaagaagaagcatcttgcagaacaacacagaaggacttcaccaggttccgatgggtcagcttgccttcggactgatgtgaatttgaacggggatcaggataagcaccattgtgctcaaaataactcacacactcatcttgagggcataaattttggtgattttcggttttctgaagttcctttgcaggaagaacattctattttgagatcatgtgattctgatcttctgcaaacaaaggagaaaaatcataacgaggtacataatggtctgggctatcctggtacacgcccaatagccagcagcgatgtggaccttattaagcctacagtgaaagtgaatggagtttggaaaaatgtagaatatacaaaggctacactgaaagcgaatggagttgggaaaaatgcagaaaatacaaaggttccaactattcctagcacccaaaagtctaggagaagtaccagccaagctcataaaaagtacattcaaggttgttggtttgtcttgtccaaatcagatattttattttaatcgtttttgcaacttcaatccaaacaattctttacctgtatgttttttaaggtgtgacaggcacttttcctgttgacgatggtgatgatgatactaggccatctattcgacaatctggttcaccagtttcaagatggagcagttctggtaaagcagttgacactgccaatcacagttatcaagacacaaaacaaaatcagctaccactattgtcttattcacaccgtgtgcatggtgctcactccgctggaagagagaattcaagtagtgagaaaggttagttggtgttcactcttatgtttcattcttattcatttaacttgtgcttgtttattcgttttaactacttttattgaaattgaagagtgtattaactccatgttgcacgaaacttaacgtgttaaaactttgagtcgccagcacctaaaatgatcctagccttaatctgtctcctactcgtgaacttctatttaattcaaagaaactggcagaatgttttccagctcaattgtcactcgggcatttaatttttttgccacttttaagatgtggcaatcaaggatttgccactcagtctatgacatgtgggtccagtggcagtggcaaatccttaattgccactcgtaagagtggcaaatagttaaatatctctctgatagatgaaatactctatgaaacatgcaatccatttgttactatagttttgtttgaatgctcaagttatgctaaagccttaaggtctgtgaagtattaaaacagagaaaatgcatagctattcttctagatatttaagtgtctcttttcttattcattactattgccatgtccatgttggttctttttttttttctctatgttttctctaatcacctattatttttggtggatttctgaagcttgattagatggtagtaatgtagtatgttagatttcatatttcatagttgatcttttgatttgagattttttaaacgtgttgcttaatccagttgacagtagtgcaatcccatcaacaaatctgtacattgaggatgacaaaaggttcaaagcagaccttgagagagctgtgcttcaaagccttggtatactaaataccctttttttgctatgcttttcttccctcttatcaacacgctcttactttggaccttgaactgctgtgaaaatttcaatattagctagctccatgataaatgagtcttgtatatgttatctgttaatagctggagatgtttagttgtgattttggttactcagaacaagtttttttttatatgaactgccaactagtttgttgtagcatatgcgtggacatggtgatgcagtattgctaaaacgaagactagcttggctatagccccaaagtgaaaacaaaaaataattcgattttaggaaatgcataacattacctccaacaaattaccgattttgagttatttagtgtgtggggtgcatctttaatattattaatttttaatgagctgatcaatgactgtgattgacattgaaatgatatgtataaagtgcaatttgcaatgctaaatgtcatactaaggatgttttaagtaacaggagaatatgccttttgtcttttcactattgcttcattgtcatcatagatatttgactat

SEQ ID NO: 61090 - DNA, 962 bp, Oryza sativa
ttatagctcatcaatcaagctatttcccccacatttgctcccaaactggagtactagtcactccctccctataggtatgtaagtccagaaactccagatctacctttgcctcctttgggtcccaatttctgacacacactctagtctgcttgccgcacgtacaagtacgaatgaatgaatatgccgtttttttgacaaattgacccttttcaaaaacttaattcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcctaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcgacattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttt

SEQ ID NO: 61091 - DNA, 4817 bp, Oryza sativa
  unsure (1)..(4817): unsure at all n locations
ttttgcaattactaataattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggtaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccgcaccaggatgcagaccgacgtcccactgtagctcacctgtgggaatcggccccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagaaggcggcaccctccgcaacgccctacaggtaatcgttggaaagagatgaaactacggtgttttcttccaaaagcgataacttaacatggattattttttatgcagagactacggtagcgatgtcgggagttggcagcaaggctcggctgcaggtcgactgatgtggtcgaacatgctcatgcccaccaagagggggatgaagaaggggaggtgggtgacgaggagggcgagcaaacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactagaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgcttttatttcttatatatatggacttcatatatggatgtattgatggattctatggatgtatggaatgatgttgggattgatggatggatgtatgttttgtatggttctctggatatattactgcctgtaaatntctgtgatttgatgtttgcctctgttgtgtgcaaagttttgctaaagtttagcagggctgggacgtcagcgccatgctaaatggcgctgacatgtccaaactcagcgccagtgcacctggcgctgaggtcccagcccagccatccagaaggcttgctgggctgggccacggccgaaacggccaagtcccacctcagcgccaggtgggctggcgctgagtttccaacagtcagcgccattatggctggcgctgaggtcccagcccgcaagccatccagcaggcttgctggtctgggccttgggggttgcggccaagtcccacctcagcgccaggtgggctggcgctgagtgtcccactgtcagcgccattatggctggcgctgaggtgccagcccgcaagccatccagcaggcttgctggtctgggccttgggggttgcggccaagtcccacctcagcgccaggtgggctggcgctgagtgtcccactgtcagcgccattatggctggcgctgaggtcccagcccgcaagccatccagcaggcttgctggtctgggccttgggggttgcggccaagtcccacctcagcgccaggtgggctggcgctgagtatcccacggtcagcgccattatggctggcgctgaggtcccagcccgcaagccatccagcaggcttgctggtctgggccttgggggttgcggccaagtcccacctcagcgccagtccggttggcgctgaggtagctgccacgtcagctggagatcggcccggccgccacggtagcacaatgtcagcgccagtcccgttggcgctgacacggccaacgtcagcgccaatgtgtttggcgctgaggcgacggcctatttttggttgaagtttttggcagaggttagtttcgaaataagttttccaaaagggtcaatttgtcaaaaaaagggatgaatatgcctatacaggctttacaaactccagtaccagaagtaaccacttaacggtaccggtccgtatttatagagctagaggtgtcaaattttggcgtatcgtttagacaataataaaaaaactaatcacagaatctgtcagtaaaccataagacgaatttattaagcctaattaattcgtcattagcaaatgtttactagtaccacattattaagtcatggagcaattagatttaaaagattcgtctcacaaattagtatcgagatatgtgcaattagttattttttagcctatatttaatacttcatacagatgtccaaatatttgatgtgataggtataaaatttctgaacagggcatcataaacagctgacaaaatttctggaataacagcttctcacgatgaatggtgaattagattgttcgagagatgtttcgactctacggtagcgacatcaaacagattacatcgtctccgtgcataaatgaacacaacaggtaacaataataatgaatcaaacactacactggagtcccttccccttcgggatgtcaccaagcaattccaatatacacactagccaagaaaaaaagaaaagaaaagagcttgtgccactcgctcatgctgtatgtatgtgtatgtgcatccaatgaattgcagtctacagctacaaccatacttcaaacctgcgacctctgtgaggttgcaggataaataaacacattccgatattacaacagtcaaaattgagtttggttagggtagtctttcggtggcgggaagtgctgcttcttctatcttgtcaacctgtgcacagcgatttctggatcacgctcctagctgtacaaaattggctgcattcattcattcagttagcacatatagccaccaaacattttacataggtcactcaactgcattttctacccgatgttcgccacaaacggcacaaggcgcttatgatccctcttacgcccaagagcgcatgtatcaaggacacgcccaagcagcaaccgggtattctgcagcgccacatctcgggtggccactccagtatctgcagcgctgccaccgccttgccccattagagtcccaaaccctgaaccggcagcagcatattgaagaggtccactcctagccttgaatgatgattgaggaagaagcatgctttggtgaaccttctcccccatcccgtgaccattctcgccaaatccaatatcatcaccttgaccaccagttacaccgctgcagctccgtaggagcgcctccaacacattcaatgcctctgcacatagtgcgctctccacgagctgtgacacaacattgtacacttgaggtatctgagatggatccactggggtttgctgcaacagtgatttaagcatcagaagcaccactctctgataatccagaggacctctctcaaggagcctaagcaggtgcccaaatgccagagatgagtgcttagggaaccactcggaacatattggcggcgaagcgcgtgcaaaaagatcttctagggagatgatttctccaaaggagtatgctctgaagacttccgctaaatcatctaaagatttgacacggcaccacaccgaaatgttggatgccacatagtaagct

SEQ ID NO: 61092 - DNA, 26440 bp, Oryza sativa
gaattagacgtatatagtactgtaaaataggaggagtcaaagaaagaggagaggaaccggtcggctttgtcggcagcgttctgaagagcctggatgtacttcttgtagtagtgctggtagaagctctgcatctcgcgggcgtcgctctgcttgaccctccccttgagcgtggggtcgttctccctctccagcctctgcaggagcgcggtcttgaactgccggacgccacggccgctggacgtcgggtccagccggtgcgccttctcgaacgcgtagaacctgcacaggtacgccacccgcgggttgctcccctccacctcgttcgccacacgcaggatcggcgctatctccaccagcgacgacggcaccacctcgctgtcgaatatcgactcccccaggttccccgccgtctgcgtccgtaggatccgtcgaccccccgacgccgccgcccccgcccccgccgccggactaggactactctccccgccgcccctaggccccccaacccgacgccccgacgacgacgacgccatccaccctaccctacctaccttcctagtgctgctgcttcaagcccggaaatccccgacccgaggaggtgcagccggtggccggttgccccgcgcagcagcagcagcagcagtgggggactctctccactcatcacatcaggagtgtgagggagagctcctgcagctttctcctactactgtaaagcagaaaagatgaaaacgtttcttttcttttttgtttattttatgctactactactatcatgtgtggtgttgtatccctaacgtaaatgggatagaatggaatcatttgttggcctccgttttcctctcccctttgacgaaccgtttagaattccacgactccccctactttagttgcgaacaacacggtacacagcatcccagaaaaacattcggtggcaaatactactagatttttatcacaggttacaaaattcgtatggttttgacgcttgcttttatcatttcgaatcgataacagtagcgtccatagcaattggataaacttgcttcaagtcggacgttgcagtctgaaatgaatgctagtactagtcctgcagctgcagcaccagcacacacaccgcagcagcaacagagaggcagcgtgtgtgtcttttgataaaggcgaccaaacaatttcggtacaggggcggtgccggtgcgcgtcaaacttgtgtgtgtttgatactactactactacaacaaaatagattacttgttcctttctgaaagtaaaccaaaaagaagataaagtagtacgtgtaatttgaagcaggaaagacgatcgaaattttattcaaaagaaaatagtagaagcttaggccccgtttagttcctaaaaatttttcccaaaaacatcgcatcaaatctttggacacatacatggagcattaaatatagattaaaagaaaaactaattgcacagttaggggagaaatcgcgagacgaatcttttgagcctaattaattcatgattagccataaagtgttacagtaacccacatgtgctaatgacggattaattaggctcaaaagattcgtctcgtggtttccagacgagttatgaaattagttttttcattcgtgtccgaaaaccccttccgacatccggtcaaacatccgatgtgacacacaaaaattttcatttcgcgaactaaagatgccctaacaaggtcctaaattaaggttaggttaggttggaattccgtctttccttcatgaaaagttggcgtagatttgcagcaacgccattccatccatctgttatctcccgttctgtcttttagtagttttgtttctttttcttgttgagaatatagaaaaatgaaactgctactagtccatatatatttcaggcaaataattaaattgagtcatgtaagggcatgttcaatgaagaccacaagcactagtggtctcaaaacaccacgtaggatacaaccacacaaagatcacattaaccacaatggaaacaactccaaaacgtattttgcatttcagccactatctatttatatgtcagccttgtggtgtatcttattatcaaacctattaaaactttatattttagtccctataataactaaaagaagtatatatgcacccttaaacatcatgtggacccactgtcacctctccccctctctctcccgagtcttctcgtcttctccatagatttttattctctctctcccgactcccgagccgtatcatcttcttcttctgacactgtcggcgctctccttcttctcccaatccaccccgccaacgagacccttccccttccccgccaaccgttcccctcccagccccctcacgccgccgcgagcttctcatatcccctctcattttccctaggcgagcagagggcgatgagagatagttgggcggagcggatccaacctcatgctcgccggatctggcgacgcaggccacaacgacggcggatttgctggcgagcggtggcggggagcagcggtggtggtggatctagcgagcggcgacgcgaccacaacgatggcgatgagtggcgccgacgaccacaacgatatggggatttggggtatgtgcacggggggactgaccggacgaggcgacacgcggggctctgactcctcgaacgcgagtcttcgagccgtggcttcgcgtctcccgagcccaggcgcggcgcttcaagcattccctcttcaagcgcgctttctggcctgcggaaccacgcattcggctaccagctcggctcggctctaacgtggagccgtgtgatcacaggccgagtggagcgttatacatggccgatgtgtatgatgtgtttgtttatgtgtggactttataataattagttgtaattcgttgagcgaatgccaaaatgttattccattatcttaataaataaataaattgaggtctctgctctttcttcttgtgaatttgtatagcccagcccgcctgagatatggaccattcaggcccatcgaaatgagaaaggcctatatttatggttagttttggcccatctagtctgatctgatctgatccgatccgagtgagtaacgacggtcacttcccccctcatccactggccggccgtccgtcgtcttggctcgcggcggcatcctaaaccctagctgcggcatggagacttctctgcggctgcgcggcggcgggtcacgtccgcagtcaaagtcacaggagggcctccgcatccacgccaaggagaagctccccatcgcctccaacgcgctcctccaggtactatactatatcccgcctactcactccctattcattctcttcaccatcgattaataattcattcatattcccttgtgctacggcggcggcggaaggaaaggctcacggcgagatccacgccgccaccggcgccccgacctatctcgccctcctcttcaggaacttctatccccgtctctccgccaatctaggcctaggcctcgccatccacttccgcaacaaccaaccactaccactagcatgggacaacttctcctacaccctccgtgccagcaaggctatcatccccttcccctccaacgccttgctcgggatcaacctcaagggacgcctcctcgccgacaaatacttcaacccgggctgtctctacttgcttttattctacttgtacagtatactaccttacttaccttaacttgccaatgctgcctaccctcatgagcagaccgcccggactgctgccgtcgagttagcatggaccatacttgatctcaaaaggggtcaagatgtcaggctcaaacttggatatcaactcttgcacaaggtacttttctttttctttctttattcttctttatatatatatgcacgcccaccatcaccatctaaacgttacagccacaatgttctagctctacccacacaacttctgtgcttatctagcattttgtctccctttattctttatgcaaatgtctctttcctttcaatcaaaacaacttccaccacgagttctagaaaactaaaagggcatccatgtcttgtaaaggagcttcattcattacagattacagacacttacaatctcaccaaacactctcagtgaaaggaaacatcactagcaacgttgcaccaaaaccttctgcttaccaccgacctcccgagaccttttgtctctcacccatctacatccacttatctacgtcttgcagtcaagaccttggcaagctggctgagcaccgtgctgtcttcctcctttctcttgaaatacggaccaaagctatcagcagccaatggcatatactactgtttagtaccttccaaggatcatgtggaaccacacccctgaattgtgcattaatcctggtttcccacagggtcaatactgtaagtcaatattgacttagaataactaggtttctaccttttcctgtaaatctgaaaatatggacccaatggtgaaacaggtgtctttcatttcttggtgacatgccaaacaaaaaaggtcaatggaaatcaaatgatcaattatctccttggctctgatcccctcaaaattttgcctatacttattgggcctcccagtcattctcacacagtgcattagcctaaattatctgtcttctggtaatggattttctaaaagaaaatttatttgtttgcagatgccttatttccaactcagggaaaacaattggacttttaatgcttatatggatggaaaatgggatgttaggtttgatctgtgatcaaaaggcaatgaatggaggtagggggattctgtggtgatcaactaggccctttcctgtattccttttttttgcatcaatccatcaactcttttaaactgtactgcttcactcatcagtaagcaatgttttacagaaacctgtagatactctattgctttcatatgtagaactacaaacttaataattgtagctcttcttattcatggggacggaatattctgattctgtgtatagtaaccaatcggttggggccactagacacagccagtaaccaacactaaggtatccgcatcacagatgataccaccaaatcatgttggtgtgcattcagccataggctgtatcgtgcaccacatggctgatggtatggaccaagattgatactaccaggatcctatgggctgaaaaccagcaaaatagattgaaactgaactttcttggtcctgtgctcaatagtcatccttctctacttttttggtataaagtaccgtgataagctgcacttgtccccaccttttggcttggggctttaagtgcttggttgctccgttatactggtcctgtcttgcattcacggcgtggctgttactccagagaccaatgcagtgctgttattctaacgtggtgatacttggttgatagttcatacgaaaagaagtgctaatctgtggcatgcattgtttcgttttacccagagatgcacaggttttgcatttaggcatttgattggctttgttggcatcgcataggagctcttgggaaatattcaaagatagagatcattcgtaattggtttggtctaacatgagtggaaaaggattgggggtttggaatgctttggttgatatgattgtacgcaggaagaaaagttgatgtgtttgggcgtgcagccttgttgtttggctttctgggattttagataggaaggagtttcctccttttgcttcttcctttggtgcaatgataactgaagtggctggtcctatatagaagtagtacgtacgagttgggtgttgatcattccgggattgaaacaggatggatgttgcatcgtgagaagaaccggaggaccggatagcatgctgttgggcacattggaatgcacggccgatttctcatccttaaacaagtaagtggtactacttttaattggatgagttcataattgaaaaccatttgtgcagttgtatttgggtcacctgttgtagctcgttaatgccttctgtgtgttgtggaccctgtcagttggactgagaatatatagattcaggtgtgagcagagtgcagtgttggcagcagtaagcatgcatgttgagaaaatatctcatctggttttggagactggcatgctgagaaatatcttcctttagttgatgataagagggtgaggatgggattaggattggaattgttgacaattggcaacatggcaagctaggtagggagctgagaaaggcaacaaaattaaagaagaagtcggaggaagaggagaggtttgatgctttctttgcaatggtagtgtaggcagctgggtgcttttgggggacagggtgaggtggccgtccatgtccttttttttttgtgtgcgcgctttgatttgcaagttgcaatcggctccctcctcccgtcccggtatagcatgctcgtcgtctcttggtctttgttggtacgcgactgggaagaatcacttaatggagtgataatcaggaattcagaaatcataagtcataaccctacctcccgtaatcctttctttctgtagtgaataatctgtgtgtacattgaacatactacatacacggcccttgctgctgctttgcttacagtaagtttcaaagtgagagggggacagcaggagaagagagagagagagagagagaggtcgggtgagctggccgcgctgccacgtgtgacggtgtccacgtaggcgctgcctttgtctggcttatatatactcctactactctcctccacgtactactacgcagcagagcaaactcattcactccgatagattgattgatttgtcagtccgaggccgaggcggctccatccaagtcgagcagaaaagaatgcgagttctcgtccactccgccgagtccccggcaacaccggcggcggccatctccatcgactcggacatggtggtcatcctggcctccctcctctgcgccctcatctgcgtcgccggcctggccctcgtggcccgctgtgcctgccgccgccgaggcgccgctaccaccaccaccaccactactactacaccggctgctacatcccctgcacccaaaggcctgaagaagaaagccatcgacgcgctccccaccgtgtccttcgcactcaagcagcagcagcagcaggcggagtgcgccatctgcctggctgagttcgccgggggggaggagctacgcttgctgccgcactgcggccacgccttccacgtctcctgcatcgatacgtggctggggacccacgccacctgcccctcctgccgcgccaccgtcgggactagtacattattcctccctctccccggccgctgccggaggtgcggggaggtcgacctgcccacgctgcacgatttctccaccgccaccgccaccgcccaccacaacacacctccctagctacgtactccgatttggttgtatatgcatgatccatctttctcatcggatcgctgtttttaccacccatcaacagtgtatatatacgcagcacatctatctattaattatttcctgcgtctattataatcatcgatcacattagatgattgcatctcaatatgtatgtctatatcaatgcgcatgcatatattgcttcttcttcatttctttattttcttctcgatcgatcgccacccctcaaccatcattattctatatatactcctacagcccatctatatattcgatcgatagagtaccttaatttcaatcaacattactccttgatttagctgataatcagttactatctatcggtgctttggtttagttgaagctctctccccccccccccccaaaaaatttcccagtttttagtgcaagatctacactatatatgattatttcatatcgtgtacatatattatatgcatggtggcaaataatgaacttcttgcgtgttcgaagaaggtgtgacaagaacactgcttacttcttaattttgtcgtagtgttttagtccactgaaataatataatacttcctccattttataatgtaagtcattctaacatttcctacattcgtattgatgttaataaatctagatagatatatatgtctagattcattaacaatgtgagaaatgctagaatggcttacattgtgaaacggagggagtactatatgtcttacttaatttggagtgccatatatatgcataaattaaatttcatgtgtagtgtagatagtggcaaggcctgcaggaggcgatcaggtagctagtagagggcggggttaatttggtctccggccggtgttcctctctttatctcctggccgatgcttttccatcgcgattgatatgatgcacctcccctaaacctaaaagagcactccattcattggcctttactacatctaaacctaagccattgttggaggaattgaataaagtagagtagtagtagatgatacgtttgacctctcactagctagcagcccagcagcatagaattagaatatataatcaccgatttagtttcagccgttgcaagtgccagctccattactggactggactctctacgtcctttctctatcaaaccggtcccaacgaaacgatcgatcgaggacaaaagagaccaaaagaatggaacacaacttaaagcaacccgagaatccgtgatattatagtatttacttttttgaattgaaacaacacaataaactcttatcatatcaatacatatattctccactgatcggccctctgttcataattgtagtctcagataccttttccggctaaagattctgaatacctagatgaaaccttgtgtattactatgaaaatttcgtatgataataacataaataatatgtaagataattggacaatataattttgtatgtactttatataatttctcatatgattgactatatactgaaaaaagctacaaacaattaatatgatgtggtttataataatttaaatactgaaaaaagctacaaacaaataatatgatgtggtttataataatttaaatgttatgtagcattaatctttcaaaagcaaaattaaaatggtgtggttcaatgtgagaaggaaaataatatagattaatcgtccaaggtaaaactaaggtgatattacttcatgagaaggaatataatttttaaccatagatcaatcactctcccaatcatcttaaaatttagtgtgaaattgtacatatcttgtatcaatgccaaggaaatttaaaaccacttgttagttacatgtatctattttcttggacaatgtgggttacatcacaatcatccttccaatgctgctgcacaagccacaatcgtttgaggcaaaattgagagacacatattgaatgaatgaattaatggtacaagaattatagtgacaaaaaaggaattatagtgggcatatatagtagtaacaacaattttttttatctttaagaaagaaagaaagaaagaaagaaagaaaaatgtgcaaaacaaaaagaaatgacaaatgttattaatggataaatggtgtgttaattaatagtggtcgtcatcgtcgtggaggtttggtagggtccctttggctccgacgttgaagaagtcgatgatgacctcgagcgggaggcccttggtctcgggcacccgcagcgcaacgaagacgagcgcgacgcagcagacggcggcgtagatggcgaagaggccggcgaggccgagggaggcgagcatgacggggagggtgtaggtgacggcgatgtcggcgagccagaaggcgagcgagcagatggcgatgcagaggccacgcacgcgcgtggggaatatctcggcgcacaggatgttggggatggggccgaaccccatgacgaagcagcacaggtacaccaccacgctccccgtgcacaccgccgcgtgcgccgccgccgccatcggcgccacgctcgccgccaccagcaccgccagcgacgccaccagcagcgggatcgtccacaggagcaggctccgccgcccggacacgtccatgagccgcatggccacgccgatgctgggcagcatcagcagcgtggtgacgccgctgatgaggatggaggcggagtcgtcgcgcaggcccagcctggagagcagcacgcccacgccggcctgctccagtatctgcggcgtgtacaagagcacgccgctgatgcccgagaactgctgcaggatctggatcgccacgccgcacaccagcgcgtgccggacgccgccgggctccagcacctcccgccacccaccctccacctccgcctccgcctccttcttggtgcacaacgccgactggctcaccagcgccgccgcgtgcaccccctccgcctgctcctcgtgcaggtacatcctcttcaccgtgctctgcctcgtcccgtccgccgcgacgccctccgtccacttccacgccagctgccacccgccgccgatgcccaccgtgctcgtcgcggcctcgccctccatggttagcagcggcgcggcgatgtcaccgtcgtcgtccccggagttctcctcgtcccagtcgatgggcggcctgtcgtggacgccgatcatgctgccgaggttggggacgtcagtagtgccaccggcgggggggttcatgtcgtggaggctgtcgaggagggcgacgacggggtccttgaggtggtcgagcatgctgccctgtcgcgatgccagcgtgacggcgctgccgaacatgctgcctggcgccaatcccgaggacatcccgccgtagagcgtgaccttggcctcgtccgttgggccgacgacgtactcctcgatggccgtgtcgcgtccggtggtgagcccctcgacgaggagcgccatctcggcggacacgtcctggcgtcccctgagcatctggagcacggtcctggcctccttcatccttcccttgctgacgagccagcgcggcgactccggcaggaagaagatggtgaggaggaggtagaggagagcaggcaggaggaggacaccgagcatgaggcgccagttggggatgggcgcgagcgtgatgaggaagaccatgcagtaggagaggaacatgccggtggagccggtgagctgcggcagcgtgttgagcaggccgcgggtgtcgggcggcgccgtctcggagatgtagacggggacgagcgtgacggcgaggccgatggcgaagccgtcgacaaggcgcgcgagtaggaggatggggacgttgggagaccatagcatgaggaggccggcgagggagtagagcagcgcggaggcgatgagcatggggcgtcggcctcgggagtcggagagcgggccggagaaggtggtgacgatggtggcgccgatgagggaggtggcgacgaccagaccctggagtgcggggtgggcttggagcgccggcaagtccctcctcatgtagaggagagcgccggcgatggtggcgttgtcccatccctgaagcatgttgccgaccgccgccgccgccgccgccaccaccgcgcctctcatcttccttaattctgatcgtcctctcctctacctagctagccgcttcaactcaattcaactcgatcgggtaggcacgatgatcgacgcatgcaaattaatatgcaatagttaaccagccagccagcggcgaaatcgaattgatttcttgatcgatcgatcgatctatcacgttgttcgtatatatatatatagtacatgtgcatgcagatcgatgcagatgcatgtgcagattggaattggattaagccttgccacacggaaatgactcggcgctagctagctagctaccgagctcaagttaagacgtgcctgtccatgactaagtggttactattagtgcttacctactacgccagcttcaccagcccacccatggcatgccgacgcctatccagctcctccttgcataactcgacttgagcaattaacgagttgagttgagtttgaacttttattcgcatatcaacgttgttgttccgtgattttttttcgatcaataattaatagtcacccctccttaattttcttctcattgaactattatccattaatctaaatacatgtcttttagacaccatgatcagtcatttgttccttcctttctaactccagaaattttaccaaaacataacctttcattgcacgttataatcatgcatgatcagcaagcacgacttggtcagaaaatttagaatattttctataatattttttttgttaaactattattcaccgatgtgtaattgccacgtcctcaatatcttgggaacaattatatatcctaaaaaaggttctagggaacaattcatatttaagcaacgggacagataaagctgaactagctagttattaacacttaacacatggcacatactatataaatagtacagttttaaatcattaattcagtgtattatcgtgttaattaaatttcacgagacggctctttagcatcccaaaatataagtatgtactagttcagtagccagtgatggaattttatttttgtgaggaaccagtcctatacgtaagaccaataagagtaagattggaaaacatgatatcgaatactccctccagcctaaaaaatatcgttttagaccttttgaaagtcaataagacataaccttgatcacttaattcttttattatattctaaataaaaaatatttagttgcgtaggtataatattatgaaagcttatatgctaattaaaaatttgcagtaaaaaataaacttctgttgattgcactgattctaaaacaacattcttttgtgtttgaagggactattatttagggtgtctctaaaaaagaagtattatttagggttttcctaaaaatgggagcattatttatgtaactgttggcgccttttccaatcaacagggactcacctaaagatttatggtgttaacaaagttgccaaccaccccaatctaaaaactctaaaccaacatggatttaagagattaattggctagtggagttgatttagattgatttgaagataacactcatctcgcggacgaatcggaaggtttacgggacaaacctacaataggtattacactgtcgcagcgaaggcggacgatttatgacgcaaatcaacaaagatagacgaaactaaggtaaagtaaaaaacatggctaaaaaagtaaaggtaaaagaacaattcgatagattgtagggattatggttgggggttagaattgaatcggacatagctcgtataaaggggctggtcttgccttctcaacaccatctccacgttcaagaaaccttgggcccaagcaaggaaacatgataatcttaattgaacttggattcgggactgtcggtctgacttgccacgtatctgcggtcagactgtagttcaccctccataagccggtcacacaacggcggtcagaccggcctcctcaggaaagcttcggtttgttccatatctagcccaaacttgttataaatttctcatggtgccaaaatttgttgttaaccgtaaccattcaaaattaatgttgcatagccttagactcatctttcagcagcaatactctaatactcacccgttttgccccccatgtcctgcattacaaagtttgtcacaagtcttaattgatgattaaaaaaaatgacatatacacaggaaaaattgctttatatgcactctcttggatcaggtacccacatatacaaattgcttccgttggcatgcatgtatccgcaacaaaaccatatacatgcatagattgatcgatctctggaggtatatgcccttaattttattctatcccaagaaataatcagctgtatgcatggtataaaaagaatgatgaatcttgagagtatagagtatatgctactagctagcatgccatgcgagcgatccgtgagtcggagttgtgaattgaagtaattgggaaccatatttgcattgtttgtttgtttggcgttgatgcatcatctagaggaagaagagattgttggagaaggatcgtcggaagtagccgtagttggccttccaatggtgagccttccgttgccgatgatatcgatagcgcccttcttcatcattgcgacgaactcgccgtagtcgatgcggccgtcctgcatattgtgacgaattgaatgaatgaataatggaggtagctaggtaagtgccgttgaatggaagtaggggaaagtacgttgtcttggtcgacttcgcggatgatgtcgtcgatgccaacgtcggccatgttgtggtccctgcaggcgtgctcgagctcgtcgcggtgatgtagccgctgccgtcgcggtcgaagtaggcgaaggcggcgagcagggctcctcgcgctccagcttgttgaggtggacggtggcggcgatgaactcgtcgtagtcgatggtgccgcttttgtcaacgtcggcctgcaatatatatgcgcgaattgatcaagaagaggatatagatgcaaagaagattgagagattgagagaagtgaggacggtcttacggcgtccatgagatccctgatctcagcctccctgaggttggagccgtatctgcggagtccttccttgagctcgtcgaaggtgatggcgccgctggcgtcggtgtccatggccttgaacatctccttgaggccagcgagctcctcctcggagaggttccgggcgatgacacgcagcgccatcttcttgagcctgttcatggcggagaactgcttgaggcgggagaggacggcgggggcgagggggcggtcgggggcgacgccgtcgtcgcagacccaggggtggcaaagcacctggtgggcggtgaggcgttccctgggcggggagcggagcatgcggcggatgaggtccttggcgctgtcggagatggtgggccatgggtcggagtcgaagtcgagggatccccggaggacggcgtcgaagatgccctgctgcgtctccgcccagaaggggggcaccccgctgaggaggatgtagacgatgacgcccgccgtccacacgtccgcctcggggccgtagtgcttgcacagcacctccggcgccacgtagtaggggctccccaccacgtcgctgaacacctgcccgggcttgaagaagacggagaggccgaagtcgatggccttgagcgaggaggaggaggaggattccttgaggaggaagttctcgggcttgaggtcgcggtgcatgacgcccagggagtggcacgcctccaccaccccgacgatgacgcgcgtgatctccgcggccttgcgctccgagaagtagccgcgctccacgatgcggtcgaacagctccccgccctcgcacagctccatcacgatgtgcacgtacaggttgtcctcgtacgcgccctggatggtcaccacgctcccgtgccccgccaggtggtgcattatctgtatctcccgccgcacgtcctccacgtcctccgggctcagcagcttcctcttcgcgatcgacttgcacgcgtactccgcccccgtcgacacctgcgtgcacaggtacgtcgtcccgaactgcccctgccccagcttccgccccaccgtgtacacctcccgcagcgccggcgtctcgtgccccagcaccgccgtcggggacgacagcctctgctggtggctgcggatcggcatcctccccccgctacttgttgctgtgcttgtactactgcaactgcttggataccgatgatagcagtagtagtagtcgaccaaggacggtgaggtcgggctggacgtggacgaggcgccgcacgagtagtagttgcccatgcaacgaaacgacgatcctcaagagatgctgtttctctttcagcccagccgccgccgcatcatcgtcgacgacgatcctctctcttcccctctgtttccttccgtcaagcggaggcgtcgatcggagtcgatctgcagatgaacgcatgcagatggcagggaattaaggagaaagaggtgccgggaaacagggccgcacgctccttccaaccttggcgagcgagtggtgtgcgccgcgctacccttccttggaccgacgtgcgcgcatgcctcctcccttccttccctcactggcgatcaatgattgattacacaagctttacctacctgcaaactgtaatgcaatataattcaaaggccttccacaacatactgtactcgtacaatacaaacctcaattcagcttcattcattttattcgttgcatgtcaacacccacacatgtcaaaatgctgtttctgcatctcctagctacgcctcgccaggtgatgctgcaaccactagcttattgcaattcaattgccggcacgaatcagtttgctactacatcacacaattcacaacccaactgactgacaatcgttctggtcagcccaggaattacaaaacacaccaatccccccttcttctcctcccactagtgtccatgtgagccattccaaatttgacctaccggagcagtcctcccagatctgcaacacataatacatggcataagcatgactgccctctctgttttttttttaatctcattaacacaaaatccatttaaaagtcagcatgcctataatattcaccataatgcaagcaacgtcttaagacaatacagataaaccttttctatccccagttactaccaacacctggatctaagcaaagaaatttacaaagggaaagtttcaactaaaccacacacgtagtaagaggtttcacccacagcaaatctgcgcctggaaggagtttttcacaagtaagaaagcatatctctttttgtgattggaatgagtttttcattaacataaacaaaggaaagcagcagttattgccagcacattttggaaaacagagatcgatagcaaaaggtcatatatcaaatatcgagagcataaccgccaaagtctcggtgcaaaattaattagccatgcatttcccacattcatattattgttaatgaatctagatatctagattcatttacatcaatatgaatgtggaaaatgctagaatgacttatattgttaaacggagggagtaattaatttatgatgcctacttctccttatgattcatgccatccaaaaaccgaaaaaatgttgcctgtggactaaacagatcttgcaacaactcaacataacctcaaacatggctaacatgtatgtatcgaaatgccttctaagatactgaaaagtccagatatttaggcctattaaagtttgaatcttttcattcagagtaacacaattactagaaatcatcctgagctacaaatgttactctgaaactgctgtccaaaaacatactgtactacctatagcagttgccttaaaaaaagccaacttatttatgccaatgtatcagcggagaaattggatgtggtattaacagtaaatcgatgtccaaaacccctcactctcccagcattttccattgtccaagaatattagtgacccagtagaaattagtgaaatttgtgcttgggattgaagcgatttgaggaaatgcatacatgttgtgatcaatactaggagaatatctgaggcaccgtaaggaacacataaaaaaaaaagtaccttcctactccaaagtggaggtagagataaccctggcaccaactctatcgagctgagcaacagtagctgttgctttgagattgccggcattggcgaatgcctccaccatcctccggccaacctcctcgcccttctcctccccgtcaatgacagccacagcagttggccctgctccactgatggtgcagcccaatgccccagcttccaacgccgcggccttgaccgcagccatgccaggaatcagcggcgccctggttggctccacgatgccgtcggaggacattgcggagccgatgagggtggcgtccccttgcagcacagcggcgacaagcgcggccgcttggctggagttgcggacgtgctggtggacggccacctgtttgggcagcgcggcacgcatcttgctggtgggcgcctcgaagtcgggcgtgacgaggacgaagtggaggcggagggcaggtggggaggagagcgggatgaggtggaaggggtcgtagctgcggacgaggacgaagccgccgaggatggccggggcgatgttgtcggcgtggaagccactgacggctttctcggactcgaggcccgcgaggacgaggtcatcttggtgtaggagggagccgaagagggcgtcaacggccttggcagcggcggcggcggaggcggcggaggagccgaggccggagccgagggggaggcccttggtgaggtggatggagacggcgtgggacttgacatcgagggcgcgaagggcagcgatggcggcgactccggcgcagttgcggagggggtcgcgggagaggcggtcggcgagggtggggcgggagggggaggtgacggatgcgatggcgacggtgccggggggcagggaggggtcgagggtagcggtgacggtgtcgccgagggagagggaggcgtcggcgacggcgcagccgaggaagtcgaatcccgggccgaggttggcgacggtggcgggcgcgaaggccgtgacggagttgaaggccggagcggggtcggcgatggcgacggcgactttgactctccgagagacgcggacagatacgagcccaggcagcgtgtggcgggtggaagggaagcagggagccggagagggcgccgccgccgccgccgccgccgccgccatttggtactcggtagtggtggggggtttgggtggttgacgagtgggagtcgagtcgacccgtgtggtggagtgggtttaggtaactgagactgacaagtatggcccaccaaccaatcgcaaattcaccatcccatccaatcttgacgacgatgccgccgagatcgccgcttctcgccctcgtcttcctcgccgccggcgtcctatcctcggccacctctccgcctccgccgccgtgcagccgctcgtgcgccgccctcaactgcgactgtgcgtcgtgagcgcttacctccaactgattggcgtcccccaccatctaatcctccaactctttgtctctgcagccgtagggatccggtatggcaagtactgcggcgttggctggagcggctgcgatggagaggagccctgcgatgacctcgacgcctgctgccgcgaccacgaccactgcgtcgacaagaaaggttaggagtttctttcttcctctctggatctctctaccaattacttcactcctacaataataagcatactacacatttactctaactcaattcactgtcttagacttgaatgattgcacacgaaacaatttcagattgctgcacatcaactcacatgaattcaaatcactggacaatcaaactttatctactagcagagatactatgtaggagttttttttctttaaaaagaaacactagcagagataccccacttacgcgaaaacaatcatcttcaccctcttattcacaaccattataatgcttgcttggattgcctgatcatttttcactgggctatgcatgaaacatactatccaggggtgagagacaagcactgcagttgtttctttatgaaattttcctggtcatctcatctcttactgaaccaactcatgttagttcttctttttcttggttgcaggtctgatgagtgtgaaatgccatgagaaattcaaaaactgcatgaggaaggtaaaaaaggctggcaagattggcttctctaggaaatgcccgtacgagatggctatggcaacaatgacctcagggatggacatggccatcatgctcagtcagttgggcacccagaagttggaactgtagctttaatttggcttctccttacggaggtactccatttcttagatgatggttaaccgtatttgattgcaccaaagtttgattttttttttacaggaatgtattgatttgggcagcctaaaaagatttcttttccccttgctgcacaatttgcagcatatagtattttttttgtacaagagatttggcatgtaaactgaaccaaatgttccggctcactgggtatgggtaaaaagggttttcctttcctttatgctgtaacattatccatttactttgctttgatacgttggatcagtaggggtctggatctctttaacataataatgtaacactcctgagtctctgagcatgttatggacaaactctggtgcttgtgtaatcagtggcgtctgttgattgattgatttggtgcttgaggatgaaacagtaggcagtgggcacacacaactggaaagtgtgttggaaaacaaaagacattacacataagaaatgatagtattaccgttaatttgtagtatctgagagttattgaacactcttcctacagctagtagtacatactaatgtctttttctatatctggggccagtgaacaaataattatactgaaggtgaagtttactgcagaccattgatgagtattattagtaggatgttgtctgttcatattattagtaggatgtttcctaatcaaagatgaatgttcataagaatgaacaggtgatggtatggaattttttttgaacttttgtattttttattttaaaaatagatcttccaaaacttatttccagaatccaaaccttttgattgccccgttctaggtggcaaaatatcttgccatgcgagggaaggtggtgtggccaaataatgcagccgcgctaaccagaccgatgtgaccaaataacaagcatgcttgatagcccaaattttacagctgtctagctgtgttgtacagccaatccattcagctgcacacaaactactgctctcaacacttgctagattcaacacctataggttgtagctactagtggctagttacaactgttggttggctgcgttgtggcaaacaagtcttccgaacaaggccaatggccctgtttggatccaagggttagagttagtttgagctagttagggctcaaatagccctaaaggatccaaacatgaggggttagattggggctagttgcatctaacccaccaaaaaaactagcccctccaagaggtgcttattggagctagtttgagtggggcccaccgtagaagccacttctctctctctctctctgcccgcactagatccccatctcttcccgatcccgcacgggatcctctcgctggacgctgccgcctccccgatccacgccgccgccaccacggatccgcaccgccgtccccgatccacgcctccgccgccgatccgcgcggcgcgacctcccccactacccacgccgcgccctccctccaaccgcgccgccagccaacctcagcgccgccgccagccccaagccgcgtcgcctccatccaaccgcgccgccggccaacctcagcgccgccaccgtccccgagccgcgccgcctccgaccatccacgtcgccgcctctaccgatctgcgccgccggccacgcatggacggagacggcttcgacgacctcagtgcgtgggcttcgcagccgtcggcgagcggccctgccactgcttcctctgccggcaccggcttcgacctcaactcgcaagcgccggcggcggaggggttgaaatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagggtatcccaaaccgttggggccggggttaccgcgccccggtggtaaagcacggttaccgcgcggtaaccgtgaaaaaccgtacaaaatttatcaaaaattcaaattattttttaaatttatttgaatttaaggatgttaccacgatatttatattaccgtacccctcacggtaagcccggtaaccgcgcggttaccggcggtaagagaaaccctgcacgcataaactttcaattttcccgtcacatcgttccaatttcaaccaaacttttaactttagcgtgaactaaacacaccgtaatacaggtgagagaggggggggggggggagggtgaatgacgtggcatgtcgacgatagacaagggaaggaggggtgtgggaccaggttagcatagggtgctctgcctggaacgcctctctgtgctgtgctccactcccctcgtcttcttccttcctcggcccggcctcgctcgctgcctgccagctgcagctgcaactctccatccatcgatcgatctcctcctactcccccgccgccgccccgtccaagacaagccaaggtatgccaatccattcctacctactactacctcctcctcagcttcactcactagtctatctaatctcccctagtgagactgagactcgcttgccatttctgttcctgtgctaaattgctaagctacgggtagtgtcttgtgcagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtgtgttctcttccccggcccccccctcaaacccactcatttttagctggagttttgctctactaatctgtctgattttcgacaggtctccatcactcaggaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggtcgcctgctcactttgcctcacctcccgcacttgtacaaaagcaacagtattatgtggccaatcttgctgacttagttgttttcttttcatttaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaaggtacctacgaggttcttatgccacttattatatctaacacaagacatttaagaaacagaggtttgacattttctcattttggtggttcacagatatgcgccatttggacgttccttcttttcgccttacttgggtaggaggcaaccccttggtgagggattggaaagctggcgtggattttaccagagcattcggcctactcagatgggcttatcactgaatattggtaaatctctctctctctctctctctctgatgtgtgcatgcatagctgaaatgtaagtcatattctttgttctattgcatgaacaagtgagcaagaagaaagagatagtgcataggtctcagtactttttagatttgagtgctattttttgtttcacgattgcaattacattcctattttcaactggaattgttatgtgattcacttacatcaaatttatatgtttcatttgggataaatgcatttaatgtccttgatgattcttgtgccatattgagcatttgtaccttttccagatatgtcagctacagctttcattgagccgttacctgttattgattttgttgcacaactattgaattctgacatccattcaaggccgctttctgatgccgaacgtgttaaggtgctcttactaaacttacttttcgtgtgactgtctcatctgttagcaagggccaattctcaaatgaaatttacacattcttttttttttaaaagaaagacatgtagatctcttgagctatgttctatttttccctcaaaacttgtatgtcttgtcccactttcctgtctatcttagtgggaggtttgtttctccttatagatgcaactcattaatctttatgctatttaatgagctggctaatgctcccgcattgagatatttcataaaaaaatgacgagattatatattcctaaaaaaatagcattcttattgtatttattgtgatgatcggggcattgtgatttttagttctctcatatcatccgtacttgacaataagattatatctatttctgacaatgtacatgaggattgtacaacataaaatcaccttgccttccaaaaggaaagatagagatacttgtgataccagtataccacacagtaattgtattgggcctacaatcattaattggttagcagtgtaagagtgttgcttgtctgtcccatgtaatagtactctactctatatattgcacctttgggcttttgctggaacgcatgaagtccctttttttcctggcagctcaaggaatttttttaagttcttttaaaacaagaaatgcagtagaggttacaagaagtcgggaacttcagtttgggattttttacactttattttgcttttcctggttgacattgacttctctaaagttttcctttcagaatgtatgtatgctttaacaatttaatctctatgctcccactgtattgaaacactagatcaagaaagccttgagaggagtaaaggtggaagttacccaccgtggcaacatgaggcggaagtaccggatatctggtttgacaattcagccaactcgtgagctaacgtatgatttctaatctgtgtgttttaccaagtaatctctaaggtattcatagaaaaggccctgtgatgctactttcgtatgctctgaaaaaaatatgttgttctccttgtggcagttttcctgttgatgaaggaggcacagtgaagtcagttgtacagtactttcaagagacatatggctttgccatccaacacacctaccttccatgccttacagttcagcgattaaattacctgcctatggaggtaatgtagtggtgaacctttgttgccttttgttgtaatgaatttctacaacactggcccaactttacattttccatgttcatattgaaaatataataccaaacactggtgctgttcaattttggattcacggtgattgcgactgaatttaaccaggtctgcaaaatagtggaaggacagagatactccaagagattaaatcagaatcagataagagctcttttggaggagacatgccaacacccacgtgatcgggagcgtgatattattaaggcatgaaatttgttatcacgtcttagtggtgcaatattgtgtgcgtgattaatgtttaacataattctcaatttctctggtttgggatggtacacagatggttaaacataacgcttatcaggatgatccttacgcaaaagagtttggcattaagataagtgatcgtctggcatcagtagaggcacgaattttaccggctccacgggtaggttgactatggctttgttgaggctttgttgattttgatgtactttcttgttatacccttcttgtcctttctaactgtattgtggatacagcaaaaaaaagggatgcaattaacattttctcctatatacttgtagccttacaaatatgtttttttgttatattttcttgtgatgcagcttaagtacaatgagactggtcgagagaaggattgcttaccaagagttggtcaatggaatatgatgaacaaggtaaccacatgaacattctgttgtccagcaaccatccatttattggcacaaaggcta

SEQ ID NO: 61093 - DNA, 16160 bp, Oryza sativa
catcaatatgaatgtgggaaatgctagaatgacttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtcttctctctcatctgattcctgcgtttttcctgcgctccaatcaaacgaccattcctgtgtttttcctgtgttttgcaatcctctgttttacacttcaattcctgtcagaatcctatgtttttcctattcctccattttttctaccctgcgattcaaaggggcccttacattgtgaaacggaggaagtatatgttatgtaataaggacgtccatgttggtaaagttgtcagtacaaagctatatggaatgttttgttttagaaatctctagcttctctactttttttataactttgtttatgttaattgtcattggttaatgtctctggcttctggcagctatactctgctcaagctgccttggcaaatggaggtgccactcaagtccgcttgtatgccaaggaggcagatcgtactcccgtcaatggtgatggtaagcctcttaaattttaagtgcatttaacaatttattttgtgcaaattctgtaggaatttcaaatgcttttaatcctaactgcaaaactcctttccataagaccattgtgttgagctgtagaaaaaaatgctttctgtactttacctttgtccatcgcagtatcacaagtaatgttatgtgtttttatgtcattcaaaaaatgtttttcaatgcaaaactgaagagattacatatgttcatgagttggagtttgtttgattaaactctgctgtgtagttctgattacttctgtatttaagttgcacaatttactttgtattataattttggtggtctgattttttttttgtatgtatgaagacctattgaagggcatattttttgaggtaaagaagaaatttgagactgcccttggtgtacttaagaaggaaaagatcactattgatccagatgatcctgcagcagtttctcgttatgcccaagtcatgaagactgtaagacaaaagtaagatcacttataatctgtcacatgtattcatggtccttagtttattactttcctttgatttgtcattgtttttgtgtttattttacacatatttgtggtgattgtttctattctctagcgtaaagttcttttattaaataaatcagattttttgcggtttacgaaaccttgaattcattaagcactattgtatatttcagtatctatgtagaaataactcccatttgatattacttattacctactactgtttgccggtttgccctagtacaatttttcatcttccccattgatgtaggatgccccatcgaaaataaaaaaatattttacttgtacattaatgcatccatcctatgcagcaaaacatactctggcatatatatatatatatatatatacttctatcgagataggcttccactttattgctttcattttgtaacacttattctggatgttattgatctatttactcagttatggttccattgtgtaaatgcagggcagatcttctatccgactctgagaggattaaatataccatcgacacctttacaaagggcatccctgatgcacggacttacttgaatactcttcaggagatcaggataaagtacatctattatcattttcacaattttcatcttatgtttttctcagccccaaaatacccttgtaaagaattaaatcaatgtgatatttgcctacataacaattttattgcactatttgcttgtctgaatattcttctgttcacttaatgttacataggagtggccttatagatgatatgggtgctgaggctatgatgatggaagcccttgagaaagttgagaaggagattaagaagccacttctgaggagtgacaagaagaatatgggtctcctcttggcagagtttgagaagataaacaaaaagtatttatcttcatcattttgttatcaacttaagtttgagatagttcagatcatcatttacactgctcgtctactctctagagatatactttttctgaatatttcagtgagaataaaaatccacatgatagatcaaacgtgcaattccttaagctgcttgcatgataattttctggtttcaaaggcgattcagggcatgtatagttattttatctgaccttgctcactagcaagagttttcttgttcgctaacaagggttaagggaccaaatatactctcagatgatggtgtaaccaactgtagcttgttttttactccgtacttaggtgatcgagatccattattgctggcttgcagggaaatatattgatttttcttcctcctgtgcatgctagatgtgttatatatattttttattagttggactaacctttttcatgcttttttgctttccatttcaaaatttcaaataggcttggaatccgcaaggaggatcttcccaagattgaggaagagcttgaattggaaattgccaaaagtgagctgacggagcttaagaaggaatgtgttgaagcaatggaggttcaactaaagaggtacatctctctttatatactaattggttatctgcttgagttgggacttatcagaagtaataagagttgcagcttgctgcatgcaagctaactaatatccagtgcatatcatatcatgtgtgcgtctctattgaaaaaggttaataacacgttgacgtgctttgttatcagggaggagttcaaagacgaggagatgcctgatgtcaagaagttggacatcagaaacttcctgtaggccataaatctctcaaggcattttgaaatgctcggacactccataatggttttcttttccagtgacagccggcgctgtaagcataccaatgaatgttattcttgctttttgtaataaaaactgcaccgaagtacaaagacaagtcaacggttgagttggattgcttgttaccttcctgcgtggagaattttgttttttgtattggcaatgtgaacgccaagcagcttactgtctccctgatgatgcacctgtgttggtttctctgatgatatggacacaccaggttgaggcttaggcaatggtttactgttttcgattacattttgattagaatactttgtttcctctaaaatcattatcctaattaaccgaaggatgcattattcttaagacttgatacacaaattctcagggtgaatttaaatgttagtaggaggattaatctgtgcgcagcaatagcattgccaatcggtaaactgatctggaatgttacgttaaagtggatattatgcgttgggagaattggtaagtacggcctcgggcaggtaatcaagttcaggaataagttcacttgacgtccctcaatttgtcaaaaatattagatataagttctgaaatttatctctaagccaaaatacaagtccctcaatttataaaatttacaaaatcagatcatccaacgtcctagatagtattatgcctgttttaaacttttagctcacgtggtaagccgagtcggcgtgaaacccaggacgacagatgggaccttgaacatctgaggggattgggaggatgggagaagatagtgaagaaagcgttagccactgacatgtggggtctgtgtggtgtggggcccgtgtgggtctcacgctgactcagcttgccaaatcgggcatagtactgcccaggatcttgggtgatcctgtattgtaaattgtcgggcccgttatattggtatagggatgaattcagacttgctgacaagttgagaatcctaaagtgaacttattcgtcaagtttattgcgataaggcccagtatctaatgtaaacatacttgtagggccagatcaatcaaccaatgggccagttctaatccaagaaggcaaggcccagttatagtctaaacatatctgaaggcccagatgggacaaacaatggcggcggcccagaccaatccaacaatggtccagctcaatcttagatcctggctggaaaatacttagattctgcagaaggtaggtgcaaccatcttcattttcatcagccaagatgggacgagatgatcagtagttcaggagaagatgtctagagaagttcatagttcaggagtcatgcagtctaacaaaacagcgccagttttaataggcacaccgcgcacaacagttcatatcatatcaggctggtttgtcacaaactcacaggtacactgaaaatatgaaacgagtatttgaaatgttcaaaatatgagtactgtttatatttttattcatattttgaaatgttcatacaaaaaaaaattaatactcatattttgaaataattttaagaatttttagttatgtttttttattggcaatgtagatattgtccaagaaattaatggtcatagtcaaacagtctcatagtcatcgatagagtgtcagacaatgtgtacggagtctatattattagtgagccgggctaagagtcaaccctttcccttgatccaaaacattgggcgtgagtgatcttgtctcacgacgtcatcgatcgctgcaaattttgagttcgtatacaaagacttggcgtgcgcgatccggtcatttctcgaatcactagcttctctaggactaacctagtgtgtcggtgtaacaaaatagggggtgtgtttagttcacatcaaaattgaaagtttggttaaaattagaatgatgtgatagaaaagttgaaagttaatgtgtgtaggaaagttttaatgtgatggaaaagttagaaaattaaagaaaaagttgcctaagtaattttatcatctttaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtctcgtaatttatatgcaaactgtgcaattgatttattttcatccacatttaatactacatgtgtgtgtcaaaacattcgatgtgatgtttttggtaaaaaagattgaatataaacacggccttgaggattgtaaaatttccctgataaaatacccataatatttgcattagtttgcgtgcttttgagtttacttcggcatacaaaatattcaaaacaatttggcaaaacggaatggttaaatccacatgtgttacactgacaaatttacttaaagtcaaagtaaatttcagaatagtaaattcggaggagtacacttgattacaagtacattaactaaattgttttattccttgacctgacatgactcatgcacgctagtactcctcccgagttggatcgtaattaaccacgcaactaaattaaccgaagtcgtaattaatgcatgcgattatcgttgatgatcgagattaattagcctaacccctgattaattaaggggttaattaattagctttgcgggtctcgagtccgaatccgaatgggaagagcgggtcgtagtgctcgtcgccgacgttcatcggcagctgctccaccgaccggaaccacgtcctcgccagcttcccggtgaactcgtagtcgccgaacagcacgtcgctgacgccctgcccctccgtccccggcagccacgccgccaccagcgcgtcgatggcgtccatgtacggctcgatcaccagcggccgcccggagaccaccaccaccacgcacctcacgccgccgccgcagacgttctggatcacgctcggccccggcgccgggatggtcaggttcaggttgtcgccgagcgtctcggcgtacggcggctcgccgacgacgaccacggcggcgtcgaacctccccgcgttccgccgcatgaagccggcgtcgggcgcctcggcgaagacgacctccgtggcggcatccacggcgcggcggatgccgtcgaggatggtggtgccgccggcggtgaggtcgttcccggcgaggccctgccaggtgatggtccagccgccgcactggctgccgaggtcgtcggcgtgggcgccggcgacgaggatggagcgcgcccgcttcggcagcggcagcagcggcgcgtcgccgggcttgccgttcttgaggaggacgagcgacttgcgcacggcatcgcgagcaaggtcgcggtgctcctgcttcccgagctcgccggcgaggctgaggtcggcgtaggggcgctcgaagaggcccatggtgaacttcacccggagaatccggcgaacggcgtcgtcgatccggctcatcgggatcgtgccgttcttcaccagcgccgccaggtcgtcgatgaactccgtgtacgtgaacgggatcatcacctgattgcacacaaacattcgaaaattaatcagtcaattaattatgaaatgttttgggtgtaaaggaccatttcttggatcgatatttgtctcttatttatcaatgaaatgaaaattttatgatgaaattagtttttgcatgtattaatgtgtgcactgtactgaccatgtcgatgccagccatgatacccagcttgatggacaacatgtagtctgcatgtgctggggtcgtgatcctgtcaagcccttgccaatccgagataacgaatccctgaaattgaataacacattaattaattttcaaacttaaacagatcacatcatatatgcatgaagatctcacacgtatgtactaccgtctagaaaatagaaatacaagtcgagtttgactaccaattaattttaaatctttgactaattattaaaccaataataatattttacatgcaccgatacggatgaattcatgttcaaaagcacataatctattttaaaatataaatatttctatattgtttagtggagaaaagttgccaagaaaataattgggtgcctctcattgaatgagtggtggttggggggctaaaataaaaagaaatttaaataagaggctattaggaattgcttatattttagaaaaaaataaatactagaaataattatattttaaaactgagactatttttgttatgaccatagtttatttttcataaataaaataacgaaagaggaatttactttcaaagtttatttttaaccatcaaaattaagccttatactctccatttcaaaataaaccaatttagttggagatgtgatataacctagtacgtacgacttatatccaactttagtgtattaagtttatttattttagggtgaagggaatatatatatttgtagacaaaggtatagcatatactacctccatcccaaaatgtagctatttctagcagagtgtcttgtcctaaaataaagctatttctccacatacctcctctcaaccaatcacaaccattattcttcacctactttctcttttcaaccaatcacacactttctccaattattctcatttactttcttaatacctgtgccaacctaaaaaatgactatattttgggacggaggaagtatatatatagtagtagtgcacataccctgaagcggagcttggacttgaggaaatcggtgatgaggaagtggttggcgtgcatcttgacgccattccagctggagaaggacaccatcaccgtggacaccccctgcgccacggcgctgtagtagggcggcatgtgcaccgtcatcagctcccggagcgtcgccaccgtgttgttctcgttcatgccgcgcgtcgtgccgccgtcgccgacgtagtgcttcgagcacgccgccacgctcggcctcccgccggagacgaaggggacgccgcggcggccgccgggagggatctcgccctggaagccggagatgatggaggacatgcgctgcaccaccctggggtcctcgctgaagctctcgtagcagcggccccacctcgggtccctgcacaccgccacgcatggcgcgaacacgtacgggatccccgtcgccctcacctccgccgccaccgccgcgccgatcctcttcgccagatccgggtccctggagaagaacgaaaaaaattgataatttgacactttcttcgttgcccaattgttttaattgatacttgtgatgatgatatgtgagccatctaagtaaatgaaagtgggtcagaatgtcaaataatcgaaacctattttaagaagtgttacactatcaaatctctcggagaagaacacaccatgttcatatgctctcactagctagctagcttatctttgtatattccctccctccggtgatgaataaaatccagtaaaacttttagaaaactattactattggtcttgtgttaaaataagattacgacattattgtatgatgagaaattttacgaacattttaaaacgtaactgaagataccaaagatttttacactagaaaataaaatttggtaacttaagctagctaatatttagatgtaccaaattttacaataaaaattatggtactttatttttcaaagatggtaaaattactcttatgatagtaggggttttttttcaagtcgaatctgtctttttttttccttttcaaattcagcgcgtttgagaaaccattaattagagtgacaacgtcaaaatattactagttggcgagttgggcaattagtaactctttcccttgtccaaaacgttgggacgtgagcgatcgatcgcgctaatttaaaatctcaaatcttggatctcactccatcatcatcgagcactgcaaattttgagagtttatatacaaagacttggatgattaattaatggcgtgcaatctggtcatcttcagtaaacttatcacaactagctacatatgggaatctacttaattcatgcatcattaattgagtttaattaagggggataattaatcattttattacctagtgcagccgaggccgacgttgtgggggaagatggtggccttgtagacgttgccgtggccatggacggcgtcgatgccgtagatcatggggatcccgaggcgcgtcgccatggcgccgcgctgcatctcgttcaccatcgacacccacgccgccggcgacgcctgcgccgccggcacgctgccgccgccgctcagcacgctccctgcaatttgagagatatatattcgtcttaatttaatggccggtttgagtagctagctaattttgattaattaattcattttgaatctgttttagtatttacatttatttatggagatgcatgccctcacttgtgcttgcagtgaaagctaagattcaaaccttgtatttacaaaatcattagtatcttataatatccatatttccatgaccatatcatacggattcagagtgtttgactcccaatctcaccaaactggttcgttagacatttgtctgcattacccattatcaaagtacgaattctttaagaaatgttattttgttatagctagcttaaacaaactcctggccgaatcacaatatagacattcgttcaaacttcaaactttttcttcacgaacgcgtaaaatctttgcatgtcaaaaatatatattagagaacttcagacttcaaactgttttagtttgacctgcactatattatagttttttttcaaacacgcaaaagctttcatcgatattaattagatattatatataatttcctgaggtgtttgcattcgcattctacttattatatgtgtatcttgtttttagatgcaagaatcaatatgtatctctgctgcaagaaccaagaagcaatcaagtataccaatgaagtagttgcgcatgacgtcgaaggtggcgttctcgcgctcgatctgcgacatctggccgatcttctccgccagcgtcatccgccggagtaggtcgtcgatcctcttgttcagcggctgcttcgagtccttgtacttgggacactcccctcctcctccgccgccgcccgccgccgccgccatcgccgtcgccgcaatgcagcctacacacaccaccaccacgagcacggcgccgccgccgctactacctcgccggagtagccccattgctcagctcaggctaagtgagatagagttggatatgaagtgatgagttgatcgatggaagcttaattaggtgtctatttatgggcgagtttagtgacccaagtgaccaagtgtgtgtgtcggtccaaaaatattcatcgtattaaatgtggggctaagatgaggccatcgagctagtttgaatggttttgagtttacttcgacatttaaattgctcagaacaagttggaaagcagggttgttaaatccacatgtgtattatgcagacaagttgcttaaagtcaaactgatgaacttcataattgattcgatcatggtcggtactgtagtagtttggatcctctgacagaaagaaaataaaattgctccatttaagtctctgaagctcctgcaacgcatgcacaaatccctaatttactgaaaattaagatttcttttgcttgtcagtttggacaaattcaggccacctcgcggcttgccctaaattaattatctcctagattcctaattagtctcaccggttgccattagaacatgtaaaatggtcattaacagcgatctcacctttactaattaagaatacttacttattgatacgaaggatagaaagaggagagataaaatatcgttattatgggtaacgactcttaacctctataatataaaagcatggttgcatatataaaggtgaaaaatgaaaaaaaaaagtaataaaagaattttttttagctaatggtgagagtgttttaactgttataaagatacgacttctaaataatcttgtattttctaatggatcatacacatatttactgttaaacatatacttatctcctaattaatcccacgctccttcattgcgtgcacaaatccctaaattactggtaggtttttttcgccggaggtgaagaagatccgaaccgaattacattaagatcatgagataggcttcagaagtcatttgccggttgccacaggctaagattatctcgtatgtttaggcggagctacataaaagggattagagtttctaggcacctggtcaagtggcggagctaggagctcgacacgcctagggctcaaattgaaggctaacaactatccatatcaattcgtacttggaagtgcagtacaagtacgaaaaaaaatgcaagactgaaatacaatttctaaatatgcaccaagtacagtaaaagtgtagaaaaagtacaagactagactaaaattttattagaatacctaatgcgacgtatattcatgattttcactcttcatcaacagaaggtagagaacctgaagatgaatatagaaaatgatattacataatgtaagtgatgcaaattatgagaacttaattatttgtagacaaagcaatgcatgacatacctctaggtaatttgtgcttgcgcgtcctcaaagcacgataatgttgtataatctgacgatcttcaatgctagtaaaaacatcccgctcaatatagcatatcatgcagtgattcatccattcatcattcatcttgttccgcatgtcagttttcataatgttcatagctgagaaggctttttcaacaggcaaatttaaggttaattcaattaagtgatacaccaatggaaaaattctctatcactttgaaccatcttaacagcaaggttaccaaggtcagagcaacttgagaaatccaaatcagatctcacatcagagataaatgtgttaagttggtctctaaggactatacaatcatattcagaaaaagtcatctgcataaatccttgccccgcacctgccgcaaggaggaggaatggaaaggttttttttttttttttggtaggaggaaacccattaattaattaattaattaattaactaatgagaaattaatggaggacaaatatggggccttcgtaggcctcctttctgcgcgctatggcccacacggcccacctagtatcggaaaataagaaatcgatcggaaagaaaaccctagaagcgaagcggagagaaagcaatggcgtccctgagcaagcgcggcggcggcggcggcgaaggggagggcatcctggcgtcatggatggcggcgcatgggcgcgaggcggcgagcagggcgaagaaggtggtgcggagcacggggaaggcggcgtggatcgcggggaccaccttcctggtcctcgtcgtcccgctcatcatcgagatggatcgcgagcagcagctcaacgaccttgagctccagcagcaggcgctcctcgggcccgcgcccctcaaatgatccatccatccatccttaacttctactaatagtgttcttgcctgtctagtcagacaaatcaaacttcttgttttcattaatttcaccattatgctgctctgatgagatgtcgtcgccgctttcctttcctgatgttactatttttcacgctcatcttatcatgccaactatatttcgttctgtgcgattcctgcgccttgtgccgtttattctttctcgtcatatgctgctgtgatgagatttcgatttgcatcgaccagggttacttttttttttatggattgacatctccaggtttatgaacaacagttactataataattaaggttttctttttgtaaaaaaacagtatggtctctgtaataaaaaggagaacattgtactccagtttataaagttggatcacaaatgggaacttatgaagatttcttattcataagagtatgactcgagcaaagcatatgttggtttgttacgcccccgaaactttggcaaacaacaatgtgtgatggtaaccaagcattttgatacaaacagcaccactttattgcattttgatacaaagaacactagtttttattgggtactccctcaaaattgcactcctaatttaatttgaagagtgcacttattttgagagggatgaagtatatatatgcttatctaaccaaaagaacttttacgttataaatttggattcgtcactaaccaaactgtcattgctggcttatgatagattttctggcaaaagaatgacattgctggcttgtgatagattttatgccagtattagcaacaaactgggcagcgactaattctcggttgataaattagaattaatttgagaattcatccactgacccacatatcatgggcacgactgggggcaaatcctcaatttctgatctaaacgataagtccgggtatatgataaactcggagcatcaaatcgatcagcatacctcgaggggaagcattgcaaacaatcacgcaagagaagctgagctgctgctcctgctcttaatgcaggcatggcacatcaaggacgggcatttgcatcataataaaacgtctagccaaagttggataccacacattcttcgtcaacaaactgctgctgcgacaaaacccaaaaccaaaaaaaaaaagcaacctaacggaacggaggaaacaacccagtagttcttagttatgcagctctccctcccttttgacggatcaaaacctcatgcttgcagcatatgcatatcccaccaggccaccaccatggggtggtgaaccatttagtttcttgcgttgtggctccccaaaatgcccctctcatggtgaggaacacgctggtagccatttgatggcctgccactaccacggttgcccgcatattcgttgtcgcctccccctctagcataccctcgccctcctccaccgaaacgacctctgcctccccttcctgccaatgccaaacacgcaccaggttcatatcatacttacgcaagtatatgccaccatcaactacaccatgaagctgtgtgtagtctgcaagcaaatattgcataggtgttggaaaaataaaagagcaacttacttccacctcttatgccgctgttaggcttccgctcctcaacatatatctgccgcccatttatttcaattggtgaagcctgaaaattggcaaaagatttagcatatgacctgtcaaaccatgattactaattcaagcgaaggatgaccatatagtgcattaaaaaaggggaaagcagaccaccaattaaacatcacagtaattagtaaatggtgaagtgaatatgcattaaatttgattttaaaggagtatgcacacacaaattggagaaggtatttaatgcatgtaaaaaaaagtgagttttgttgaacagtttgccaccttcaatgcattgtgaacaccactaagttcttcgaattccacgaacgcatagtagcctccggtctcctgccaatgtcatacaaacactaagtcaaaagaaaattctatcatatcacgtaataaaaaatacatataaggaaccaccttgcggcttctgatagcaacaccatcaggaatgagccgcccaaacttcttgaactcattctcaagatcagcctcagatacagaagatggcacgttcccaacatagacagatttgctctctatttttacgaacagaaatattaaaagtcagtgggtaatgtgcaactcaaatcagtgaaagggattatgatgctagctcaaactaaaggacaaccttcatcatcctggacagcaaattcaccataaacatcggtttttggcttctcggttgccacagacgaagtcataaccgaatgctgtgcagcctggtttgtctcggttgcctggtgaggtctagtcggggctggctgggctacagggaacaccagtggagcttttgcggttcttagctgcatgagttataccatcaaggttttaaatatgcatgagatgacatcacaaaaagaaaaataatcatgatcaaccaagtgaaggtgcaacatacaatggaggcataggtcttctttactggttcaccaacaggttcctctacatgaggaggtggaacaggtggagattgcactggctcctccggtgccatcgccattccatttgtaaaggaagaaattggttcttcaggaagaggctcatctccccaattgtctgactgagaaactacttgctgtggtggctcagagtaagtatagttctcaacagcatcactttcttcagatgttattgggacagcactttgattttcctcttcgtgaatgtactctggaacttgaggtagaaaatatatagttagtaactacataattgcaaaaattagaaaagcagcagcaataggcctattcatacgtgcaaggtattgacttttattttccatggcaacattacaatttgaaaccatcagtaatcaacgcatacggaacatactttttgttggtgctcatagacagccaacacagaaggcatgctagaagatataacatagttcagaacatacgaataacatggcacaacagtttagatagatcattgacagagaataagaaatatggatcgcaaataggaaaaagaaataagaaatatggctgaacagttaaaaagaaaattgcaggaaattatgaagctacaaagatatattataccaggttcgacgacggagttggatgccatgttggtctcgaagttgtcctgggcaataacaggtgcaggttgcacttgctcttcgtcaacgaaatggaaataatcattgagaacaaagtaacccttttcctggggagcaaggaaaaacatctggatgaatttcctttggtggctgtactccttggtctgtacaagaccagataccataactagcacaccatcaccccatgagttgagaaagttggctgttttgatctcgatttgggtgaaattcaaggacataatgagggagtgtatatcctgcaacagttagcacgcatgcacgcaagcattagaagaaggctatgtagagtaaatgcacatgacaggtcgacaaggaaggaaagacaacatcagatatatatgtacaattcaagtcagtaagtcagtcaagcaa

SEQ ID NO: 61094 - DNA, 17674 bp, Oryza sativa
tatatagctgccccgctggcttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgttatgtgaactttcaaagatgttgtcaactttaggttgtacgcatcatattttgccaagcagtcggtatatcacttgaatcatattattcggggattcacaccgcatatgctatatattggtatcaagtcacttggttgactataattatcaaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacatacggcttaccatccacaaactgatggccagacagaacgggtgaatcaatgtttagaaacttacttgcgttattttactcactcttgcccctctaaatggtccacttggttatacttggctgagtattggtacaacaccagttagcattccacccttggcaaaaccccttttgaggtcttatatggccacactccaaatcagttaggcatcactgtcaattcctgtgaacttccaaatgtgcagcaatggttgtctgatagaggattaatgatgcaactcctgcagcaacatctgaacagagcacaacaaattatgacggctcaagctgataaaaaacgcagtcccaggacttttgctgtgggggattgggtttatttgaagttacagccgtatgttcagacttctgtggctgccagggccaatcacaaattgagcttcaaatattttggtccttatgaggtgctgcacaaggtgagggcagttgcttatcatttagcattgcctgctgggagctctattcatccggtctttcacgtgtcacaacttaaatcagctcggggttttaagggattctcttctgcacatcttcatgttcaacttgagcagaagcaagttcctgtggctgttctggatacccgggtgcgtaagtcaggtaatgctgtcattcaacaagctttaattcattggtctgattgtccagttgaggaagcaacttgggaggacttggaggatcttcattcccattttcctcgagctttggcttgagggcaagccaattttcaaggaagggggaatgtcaggatgtctgcagtggtgatccgggcgatggcaacagctccaaggaggaggatgctggcgggaggggaagaagacataagaaagctaatactagagtatctgggccggagtgggccgtgtaagcgtgcgtgtgcgtaagggcccaaggccttgtctgtaagcaagagcaggtgagagagagagaaagagagctaaatacagaagcaaactctgtttgttcatctatcaaattagtaaaatctggaggtgattggcggcggcggcggcgacggaggaatttgtaggaatccccgtcgatctatctgttcttgagtatttggttccatttctctgttggattcttaacaggggaccacctgccgggagccctacctgctgcggttttcggctctcttcgccgagctcaccgacgacatcgtgccggtggcgacggagtgctggatgagcatgttccacggcacgacggcgaggggttgcaaggcgatggacccgttctacttcttcatgaacctgttcccggagtacaccgtcacgttcctcgacaagctgccggccgagctcacctgcggcggcagcggcggcaagtccagccacgacgtggccaaccatgtccagaagctcatagcttccacgctctcctacgagtgcaccagcctcaccaggagggacaagtaccaacactggtggagaaatgctttttagtcccggttcgtaacccccctgtagtcccggttgacgaattcgggactaaagatcgctatctttagtcctggttcaaataaccgggactaaaaatcaatcttttgtcccggttggtgttaacaaccgggactaaagatggttgttaacaccaaccgggactaaagatattttttctttttttttctgcttttaatattgaatattgatttcacaccatcccctcccatatccaaatcatcacatattacagaacatctccaaatcatcaaacaaatcatctccaaatacatcacaaactgttaaaaaaattacctcacaaggttctaaaaaatacatcacagattcacatctcacacaaaaatacatcacagattcacattaaaaaaaaaatccggccggcggccactgccgcctcccctcctcccatccgcgccagccagccggcaccgcgccgatcgccgccgagcggccacccaccgcagccgccgcctccgcgcggcccccggcgcagccgcgtggccccccgcgccgccgcgccggccgcccaccgccgccgccgcgcaggccgcctccgcgccgtcccccgtatcgccgcctccgcgccggccgcctgcactgtggtgaaggaaaaaaggaaggagaggaggggagttagagataaggaaagagataagaagttagagaggaaaaaaagagatagaggaaggagtttgttgtgtggacggaaaaagaggatcggtactatggattatacagtgtgttttgatttttattcccggttagtaacaccaaccgggactaaaaataggtttttagtcccgattggtgttactaaccgggactaaagatcatagggccctgacacggcctgacatggaatcaaccgggactaaaaatcatctttagtcctggttggtaactccaaccgggactaaagatgatttttagtctcggttggtaacaacaaccgggagtaaagatcttcctcttattaaccgggactaaaaatcatttttagtcctggtttttaatggaaccgagattattgtagatttgggttgaccgaccaaagatgatttctctaccagtgaaagcactcgccggcaacgacggcattgtcgccgtcaagacagcgaaggccaagtaatcagctcagtgatcagcctatctgccgatctcctcttgcaagaacagtaaaaatttataggaataaaaggggagtgtttgcatgtcaattatatagttatgaaattttttttaaaaaaaattggaaagatgtattaacatgttcaacttctgcatttcgcaacgaaaaaataaataaactacaactagttaacgtatatttacagtcaaatttgttttttcgttgtgagatgtacaagttgaattttaacttacatgtttgtggagtgatacaacacatattaatatatcttctcaaattttttaatcatttgagtgacatgtaagagcgatcaaaatagtttcttgaacaaaagtatatatgaaaacatggaatcaaacgataggagtaagaataaaatatgtatttattatgattattagtcgattagtagtctgaaactacgatgtacatacgttgcaactcttccggcagaagccaggggattcactggtgccgaccatgtaaccggggttcttggcacactctccagcagcagcccagctggagcagagagcatgttgatcctcgcatttgtccgaggatctccggccattttcgtcgtaggatctcacatggatccatttcgtcgccgaccacttctcgccttgtatgacagggcagcttccgtgcaggctgcctgggtcgaacgtcgcgttggggtagaggctgaagaacagcaccgcactgcctttggtaggtttcactgccaaacaaaatccaaacattgttacaagcggacaaaaagcaaaactgcatgacgagcccaacagttgcgagttcaaactcttatcttcgaaattgcacattattacatttgaacaaaccaaaatttgtaaatataattttggtttgcgagtgtcaaccatacctgcgaagccctgttctgcgcagtcggaccatgtctcgtctttaggctgtgataacctagcctgtggggagaagataaattgtaatgaaattttgcagcaaaatcaaacgaggccagaaggtgtaaaatacctctgcatcggggaagacggtctctccacccatcttgacattggacaggtacatgagcacagtagcaatccgatgacctccacgagctgaggcttgccgtccgcgaatgtaatcaaagtgtggctcgtatttctcaccttgcccataacgtagcatttgcatagattcaccgttttctgaccgttcaagaatcacaaaacgggcaaagcaatagaaggtgatgcactctgaagaacatttggagcaaggtccaattaagcagttttccagtgttctgtgcccttgcaccatacctgctggaaacatggtccaagcagcaatcctctcctctattcttgcaacgacttcatccttcagataaataaaacattagagggtcagaagcaatttttattatccacacgcgtgctgacaaatcactgcaatcagaaaattcagtataggtatatgcaacgtgcatagaacattggctattttagccctttaggaatacatgaaactcgattaattcctgcgtattcacatggtaaaagaaaaatcctataatccaaatgtggactttgacctcattttggaatgaagaattttggaagaattgcaccgatgatcagtccaaaacccctgtgaaattcttacgtttcaaatgaatccttgctcaacaaagacttgaaaattgaaattgtttggatgcttatgtgatccggacaagcgacattgcttattttccagccttaaagcgaccctcgctcgtagcctcacctgtttcctgatgaggaacatgccggagctggtcctcgtcttgctcatcacgctctcccccgacttgccgtttaccaccgtcgacctctccatcctaccctgcttcgccttcgcaattcacacacgcacacaaaaatagaaaaaataacaactcaatgaacgcacgtatcagatttcccaagaggggatttgatttgagcgcaacctaccagcgcgatgaggtgttcgcactccacatccgacaggaacccctcgtacaggaacaccctgccacctcacagaatggagagatcaacggaaagccgccggctcgccgccgcacctgagcccagagattcgcggcggtcgattaatttacctggggctccacgagacatcgactgtgcgggaggcgtcgaatcgcccgccttccccgccaccgccggtggcggacgtctcgccggtgacggagaggagaagcagtaggacgacgaggaggacgagacgagccatgcccgtgcgacggcggcggcggcagagacgagcgccgccggcctagctcccttgggcggcggaggggggtcggagacgatgaggttgatctgtggggccgacgcgccagtgagagtgagagggtgtttataccgtggggcccacgtgtcgagtgcgtcgtcgacgcgtgctccggaagctccgaaatggcggcgctctgtcagtagggcccagtggaccgaacaattgggcttgactttttttctctttcgaaaaaacggatagttgggcttggaccttaaaccctctcaacttagagttgaccttaaacttagatttgataacaccccgtcaacttgaaacggagttgctagaaatatggcgccatatgctacagtcgatttttttcagccacttacacagtagttacacctcatttacactccacttacatatgtaattagtatgtaattttcgaatttacatatgtaattttagtacttacatatgtaattttgagacttacattgtaaatacactaaaattacatatgtaatttaggaacttacaatgtaaatacatgccgactattttttgatgaaaaatatgacgtaataaatatagctacaaccacttgaaaaatagtacaactcctagaagaagggtgtagctgtatctatggcgccatatttttcatcaaaaattcccagagaagagtactcacaactcacacaatgacacaaacctaaatttcttgtaagaatagtacaaatttataggaagagaagtatatatgagagtgtagctcaattagatatgtttcttgtggtggaaccaattcacttggttttaggtttcaaacttaatatgagtgctcgattatttatttttttagtggtatcttcgtcaatattaagatatatcggtccgatcttttgaaagcgatcatattggtagggtgcgtgcgttgtgaacgttcatttttgtactgtattttttttgaaaaataattacttgtttattgtgattattagtcaattagtagtatgaaactactttgtacatacgttgcaactcttccggcagaagccagggggggagtcactggtgccgaccatgtaaccggggttcttggcacactctcctgcggcagcccagctggagcagagaacatgttcatcctcgcacttgccggcggatctccggcgatagctgtaggatctcacatgaatccacttcgtcgccgaccaccttctcgccttctatgacagggcagcttccgtgcaggctgtctgtgtccaacgtcgcgttggggtggagactgaagaacagcacagcactgcctttggcaggtttcactgccaaacaaaatccaagcattgttgcaagtgaataaatcaaaagtgcataatgagcccagctgttgccatggagggtactgtctgtgtatgccgagctaccagtttattcaagaaatcgcataaagaccgcaagaaatgatctctgctggagttgctcgtagcgaatgcattgcaatttgtaacagattttttgtctgccttggcaagtgtcaaccatacctgcgaagccctgttctgcgcagtcggaccatgtctcgtctttaggctgtgacaacctagcctgtgggagaagagaatctgtagtagttgcaatcatttcattctagtaacaaaatcaaacaatggtaaaaaggtgtaaattacacccaccgctccaggaaaaactaacttccgagaatgaatctggacaaacgctaatctaaattcatttcaaaaggtgtttttttgggtggagagagtacctctcaatcagggaagatggtctcaccacccatcttgacattggacaggtacatgagcacagtggcaacccggtcaccttcacgagttgagccttgccgtccgctaatgtaatcaaagtgtggctcgtatttctcaccttgcccgtaacgtagtatttgcatcgattcaccgttttctgacagtttgagaatcgcaaaattggcaaaacaatagaagatgatgcactctgcagaacatcgggagcaaggtccaattaagcagttttacagtgctcagtgcacctgcaccatacctgttggaagcatggtccaagccgcaatcctctcctctattcttgcaacaacttcatccttcagataaataaaaaaatttgaggggtcagaagcaattttaactacgacagatcacagatgtgctggcaaatcactgcaagtctgtaagcagaaaattcagtaggcatgcgccatgcagagaattttccggttactacgattcagaaaagagaaaatcatatgatccaaatggggaccttgggatcacttggaaagaaggaactagggatcaattttatgtagaattaatcacaccaatgctactgaaagttttaaacatatttcatctagacccacgaacttacaaagctcatatcgatgtctctaagcttggattattgtatcatcgcggtccaaaacacgtttaaccatgatcttatctacatggcataccacatgaaaaacattcttttatatgaattggactgatcgctctaaaactcctataaaattcttacgtctcaaaaggaatcctggctttacaaagacttggattatttggatgcttatgtaggacaagcgacatcgcgacaaggacatggattttccagctttacaccaaccctggtagcctcacctgcttcttgtcgaggaacatgccggagctggtcctcaccttgctcgtcacgctctcccccgactcgccgtccaccaccgtcgacttctccatcttaccctgcttcgccttcgcgattcacacacacacaagacgcaccaactcagtgaacacaccaacacagatttcccaagaatagaggatttgatttgatcccaacttacgagcgagatgaggtggtcgcactccgcatccgacaggaacccctcgtacaggaacgctctgccaacccccacgcaacagagagatcaaccgcaagtcgccgccgccagagattcgcggcggttgattcattatttacctggggcgccacgagacatcgacggcgcgggaggcgtcgaatcgccgtcctcctcccccgccgccgccgccggcggcggtggcgtacgagtcgccggcgacgaagaggaggaggagaggtagtacggcgaggaggacgagacgagccatgcccgtgcgacggcggcggagacgatcgagcccccacttcggcgacggaggataatgatggatggtcggagacgacgagatgattttgtggggccgcttcgtcagtgagagtgagagcgagagggtgtttataaacgtgggacccatgtgtcgagtgtgacgtcgacgcgtgtttcggaagattcgaaatggcggcgccgggtaggacggtaggagcgtacggtacatgacgctggttgggccttggtttttggttgagctgggggcactggcccgcgtgggccagtgggcctagcggaccgaacagttgatgggctttgagtttatcgtttgagaacggagtaagttcactctgggtccctttgtcgcccagtccaacctcgcctatgtgattgtcattcttctatttgtttcattgtgcaaatgttaatgtactaacctagttatttgtatttttaaataaaacaccttcgaaggtcgatggatgatggtgttatttataagaatggattatggtttagatattaatacatattatattataaatacaacaaatagcaacttggaataagtagtataaacaatgttgtcatataaagttcgttttctgagtaatcatatttttaaattcgtggtaaggatggtccgcgaatgatactatccaaaaataataaatagtttgccacggataatattttatggcaatacccttaatgccacatgcgagttatattcaatgtaagtaaccaatgagaacatcagttggcaacttggcataagagaaatatatgaatgcacatgctatttttcaatgaaaaggtgacctaatctattgaaaacctaaaaaaacttatttacacgggagctttaaagaaaaggagaaattccatatttccattgaagcactatcagtcaataaagcatcaaccggatgccaaaacgtgtcctgaaaaaggcaattctcgatttaacactaatcatcattatcctaataaccatagagaagcataacaatattccaaagccaaacaaagcgagacttaggctgcgttagaacaaaagggagtttgtttgtttcgttttccgcgcgtacgcttttcaaactactaaatggtgtgttttttataaaaattttctatataaaagttgttttaaaaatcatattaatccatttttgaagtttaaaatagttaatacccaattaatcatacgctaatggctcaactcgttttgtgtatattcccaatcttctcaatcacctctctctctctcaaaaacagccttatagtactaaaagaaaattaaaaaaaataaaagtacgaatctcgaggcagccgggtgatccctctccatccgttgcggctgccacccgcggatgccgttaaaccctaactccctccactcccccctatttctagggttttaagcctcacccaaaccgcctcagccgctcccctctccccttcgacaacagcagcgccgccgccgccgcaggagccgcatcgccgggggttcgccggagggagggagtagccatggatcggtaccagcgggtggagaagccgcggcccgaggccgccgtcatcagcgagaacgaaatccgcatcaccacccagggcctcatccgcaactacgtcacctacgccacctccctcctccaggtacagcgagccccctccccccagccgccgctcttcctgcttcgctcccgcgatgcccccctcttgcgggtgccccgcgcctagtagcgggttctccggttagatcttgctgtaccttgtaagaaaaaaaggtagtagtagtaatttttgggatgaggcgaatgcccgttggtgtggtgcactctacggcttggaatatatttggggaagcatgagttaggcgcgtgagtaagacgaggtgtggatttggtgcattgtgtgctgctgctgagttgctgattggaatcttggtgataagggttgtgttgagctcacaaagttcctgcctctgttagtttcgatgtgcaaaaacatgaaagatattaaagatgagttcttttttgttgcgtcaatgcctaaaggaacagcatatggggattatattggtgccgtgcaatgcattgtttttcaacagttaggtagcagggctgtgacctttgtactcacatagcaatgagtgatgagggagctgtttttctgcacggctatagtaggcacatgggatttctcttgctgtggcttgagttaaatttttgagatactcttgttattaatgtgccatgtgccaagtgccaattgacgacaagaactctctgatactaccgtttatgcatgcccgatttaagttgagcgcaatatacaagttttatgtttaatatgcaaactagcgcaacttttaatgcctctttaaagagctggttgttcctataattctgatattgaatatagtggattgtcacacgggtattatccttcaatcacgatttagtgccaaagtttagctctcatcgtaaaaaaaatgatttcctaattcagctcctgcacctgcgctccacaccgatttcaaattatagaagagcaaactaggaaacagttccctgtcctttctttctgcaggcacatcaaactgtatccctgctggccctttgccaccctgtgataagtgtatttgcattttgcccgattggatcctcctcttcaacccccagtctccaagttgactgttttgtttccttctcagccctatgcccatgctagctctattgctgtcaccgaggatctgctgcacgacgagactgatgtttgtggctgacataccttgaccaatgtatctcctgtttttatggactggggggttcacagcatttttattaaaatatgaatgcagaagatgcattcttgtaatccatatttctttttagcagtgtctatattcatcaggtagtccacatgattgttctatttataaccacttaaccagtacaaatctgagctgttatgtaacaactgctggaaatataacccattttgacaacattttgcagtatcactattcacttattttcgtgtgaagtgttatgccatttgtactgaggcatctaccaattgtcaccgtttatgtactctggtatgtgcatgctatgaatcttataacctgtttgtagcaggaaaagcgcgtgaaagaaatagtgttgaaggctatgggacaggctatcagcaagacagtggctattgctgagatcataaaggttagcctattgttatctctcttgctttaggtaccaatatttgaactgttgagcaattaactcacatctaactggcaactgcagaaacggatccctgggttgcatcaagatacatcaattagttcagtcagtattactgatgtatgggaacccattgaggaaggccttgtaccgttaagtttctgagaacaatttcatctgtcagtatattcttggactacactttttctttatgttatttattagtgttatcttgtgcagattggagatgactcgtcatgtttcaatgatatcaatttccctgtcaccgaaggagcttaacaagagttcagctgggtttgtttgatttgctcttatctcctcagtgttcaattcaaataatcacactaccatagttctgaatgaatgtagcaacattttatcgtccttttgaaggtatcaagctcccttgcatgcagagccaattaagccacaaagataccaacaaacccagcaatatcaacaacaacagcaccagtctaggccaagccaagttcaaacaggtgaatatcttttcactaatagaagtattttcgtaccattataagccggattgctaacttgttccttttgtattggagattcatatgggcgcggccgtggtagaggcagaggaagaggaaggggttggggtggtaggggaggctatggtggagggtatggtggatatgataacaaccaaggaggttatggtggatatggacaccagggtggatatggacaccaaggggggtatggcaaccagggaggatatggccacaatcaaggtggttatggagggtatggttacaaccaaggtggatatggaggatatggtaagtaatatgatgatatgctagaaatgtttattatgagataatctctcaatcaggaatttggtgtcctgaaattgtttgcaatcatttatagtaaccatttatcttttcagaaaatggtggctggaactacaaccggaacagaggtggtggtggtggcgggggccgtggaagaggcaactggggatatggtggtatgtactatttaataattgacaccttattttattcatgaccaagtaagctgttctgtgttcatgcctctcatatgtcagaggtactagtgttcttctgaactagctattatgttttacattgttttaatcggaatctgataattatttacatgctggtttactaagaataaagtcttcacaatttacttcttgtaccgtaagttcaaatccaccttcttggctcccatatatttgaacggagtaacaatttttaacacacgctgaacttaaaatagcaacagtgtctgtcatgtaacacaattacatgaaggtacttgaaatgagtggaaaatgatataatatgttgagccttttctaaattatccaggggcatttcatttccaaagttatctgctttaccttcactttagtggtatctgtttttgtttgtaccaaagaataggagacgtttcgtcatcttgcagcggcataaaacatccaattgtggaaactgttatttcaggtccaggaggatatgaacgttcaggtccggcatatgaacgtggtggcagaggtggaggtagcccaggcggcagaggctatgcccggggccgtggacgaatgggcggtggccgtgggcgaggcaaccaaaactattagatcgactttagttggatgtgccagcccggtcgttgggtgctgtatgaagaacaaaaactgtggatgcgttctccataggacggaaccctagctgtttctttgtgatcaatcgactagtcttcccagcttttcgctataatcatcaatggtgtctgccattgcttcgattctgtgggattttgacaagaatgttaagttttaccttggacatattttcctgtatttaagagtgcatttttgaatagcttgtctatcttcctccagcttctgagtttcgtgtttgatgtgaagctccttggagtgcaccagtcagactcttctcaaccggaagaaaatgaattctgcatttgttcatggaaaagcagaacagaatttccgttgaattattaagtttgttgcaggagtacttcacgatcaaaatcattaggtcatcatctaaagaaaatcaatagttcctcaacatgtcccttcaaacatttctcaagatgggtttggacggggttgtttgcagttctacgtcactgtgtttgattgacatttaaaaatggttatcatgcggtataatttctatctgaataaaaaatcaccccatttgatgcacatactatttttaggagtaacactacaggctttatccaatagttaaattctatagaaaataaaagataatccatatttacatctctactattataaaaattgaaatgtttttgctggtagtttggtacgtcatccatgtatgagtcggtttttaagttcgttcgcttttgaagtatgagtcggtttttaaattcgttcgcttttgaagtatgagtcggtttttaagttcgttcgcttttagaaaaacagacatgcatttgagtcaggttttaagttcgttcgcttttgttttggaaaaacatacatgcatttgagtcaggttttaaagtcgttcacttttcaaaatacaggaggagtcatatgagaaatctctttaaagaaacttgcatgctaagttgagatgatttgacatttaattgcagctcatgattttctagaaaaatatatatcaagtgaattctcacaataaaactattatgaagattgaagatgtttttgccggtacattggtacgccatccgtgtttgagtcggcttttaagttcgttcgcttttggaaatacagatctgtatttgagtcgggttttaagttcgtttgttttttggaaatataggagcagtcgtataaaaaaaatctctactattataaaaattgaagatgtttttatcggtactttggtacgtcatccgtgtatgagtcagtttttaatttcgttcgtttttgaaaatacatatccgtatttgagtcgatttttaagttcgtttgcttttggaaatacataaaagacttctaattgcagctcatgattttctaaaaaaaaaaatttatccaagcgaatttctacagtaaatttcctctcaactaaaccatataacaataataaaattaaaatagcctttatccgttgtaatgcacgggtattttttctagtgaatataaaaataaaagatcacatgattaaatattgaacaaaaaagaaaagaaaaatcactacaactctaagaataaggattatactatcaaactaagaactgctcactgttgagataaagatgaaactcatgtagataaggatgaagatgaagattaattgttttacacaaaacaatgtggtattaacgtatgattaattaagttttaattattataaacttgaaaaaaatatttatctgatattttagagcaacttccatataaaaagtttttgcacgaaacgcaccatttagcaatttgaaaagtgtgctattaatatcaaaattgtcatccaacttttgttggagaaaaagaatgggcatatatctttaaacacatcatcataggaaccttgactattgaagttgtgtttagctccaggggtataaagttttagcgtgtaacatcggatatacagacacacatttaaaagtattaaatgtaatctaatatcaaaacaaattatagaatccgcttgtaaaccgcgagacgaatttattgagcctaattaatccgtcattagcaaatatttactgtagcaccacattatcaaatcatagcgcaattaggcttaaaagattcgtctcgcaatttacacgtaatatgtgaaattagttatttttttcgtttatatttaatattttatgcatgtgtctaaatattcgatgtggcaggctctaaaatttgccagggatctaaaaagggcctgagtggtatagttctaagctactcactattgagtgataaatatgcctattatggggctttggcagctataagatctgtttgggaggttctgcaagctgctgtttttcataatcaaaagttctccaaacatttcagtttttcattaggattctgagaaactgaagttatagaatccataaaataaactataagtcaaaagttgagtttagcagtttctccatattcctagaaactgactgtcaaccggttgtttctatatccttaaacggaacctataattccttttagaatctcatctatagtctggatctacacccttttgtaaaaaaattctagctaggttaagaaacaacctccagtaataaatctatatataggctatgtctatattcgtattagaagtttttattttagggagtgatggaatttaaaagtcacccctacaaaatacagaaaacaaaataatatagtagctagaaactaaagaagtactccctctgtttctaaaaacttaaaattaaatgaaacacactatgaatctagacaatgttcagattaataatccttaggaaatatcctggttattatattttaggacggtagaaagttttctgaattttcattggttgtttattactagcttcgagaggccgagttgctccacgtggagagagagaggagcagagagatggggctgacgtgccgagcaattccatgggccgtgcggctacacgaaaccaggtgtagaccatttccgcttgcacagcacaacgcccatcatcctggatccccgtcacgcgaacgggttagctaagctacagtcacactagtactccctattaaaaaaattaatataaataagaattcgatatcacttaaacgaatatagataaaaaattatccagattcgttgttataggtggtggtgtcgtatccttatttcggttttttttttttttaccgaaggagaacaccgttggccagctaccggacacgacccgatgaacatgcccgtctaggcgtccatcgagtccactgctccagtacatccgaacctggacgcctctccgtccaggtgcttcgcacggccagatccatcgtcatgatagactggctagacgagctactctcgttctcccttccccccccccc

SEQ ID NO: 61095 - DNA, 537 bp, Oryza sativa
tatcgtggcagcgtgaaagcttctcctccaaaactcaaagccgcgtcacctctcattcactctcgctcttgagccgatgaaaccgagagagagagccctgcttctccgccgcccataactccatcgccggccgcaaggatgacgaccgtcgcatcgcctattgagccgcggttgtctcgatctcttgtccgttcccttgtctcctctcagtgcaggttccgttccccttaagttcagtcgatttcatgcagtggacgttcgggaacgcggacctcgccatcgctgatctggagcaagcctggagcgccgccgtggatcgcgtcgccgttcctgtcaatccggtggatctcaagccgagcttctgccccacaaacaccaccatgaactcctctgctaaagcccacaagaatccccaagaatcgtgcaccgacgagggagatcatcgccgtcttctccaactccggtcgccggccatcgtcgtcaattcctcaaacctgggagagcttcggcgcaattcctcgcatctaaagcatccta

SEQ ID NO: 61096 - DNA, 615 bp, Oryza sativa
atgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgtttcatccaatct

SEQ ID NO: 61097 - DNA, 16044 bp, Oryza sativa
atcgagatcaaaacagccaactttctcaactcatggggtgatggtgtgctagttatggtatctggtcttgtacagaccaaggagtacagccaccaaaggaaattcatccagatgtttttccttgctccccaggaaaagggttactttgttctcaatgattatttccatttcgttgacgaagagcaagtgcaacctgcacctgttattgcccaggacaacttcgagaccaacatggcatccaactccgtcgtcgaacctggtataatatatctttgtagcttcataatttcctgcaattttctttttaactgttcagccatatttcttatttctttttcctatttgcgatccatatttcttattctctgtcaatgatctatctaaactgttgtgccatgttattcgtatgttctgaactatgttatatcttctagcatgccttctgtgttggctgtctatgagcaccaacaaaaagtatgttccgtatgcgttgattactgatggtttcaaattgtaatgttgccatggaaaataaaagtcaataccttgcacgtatgaataggcctattgctgctgcttttctaatttttgcaattatgtagttactaactatatattttctacctcaagttccagagtacattcacgaagaggaaaatcaaagtgctgtcccaataacatctgaagaaagtgatgctgttgagaactatacttactctgagccaccacagcaagtagtttctcagtcagacaattggggagatgagcctcttcctgaagaaccaatttcttcctttacaaatggaatggcgatggcaccggaggagccagtgcaatctccacctgttccacctcctcatgtagaggaacctgttggtgaaccagtaaagaagacctatgcctccattgtatgttgcaccttcacttggttgatcatgattatttttctttttgtgatgtcatctcatgcatatttaaaaccttgatggtataactcatgcgctaagaaccgcaaaagctccactggtgttccctgtagcccagccagccccgactagacctcaccaggcaaccgagacaaaccaggctgcacagcattcggttatgacttcgtctgtggcaaccgagaagccaaaaaccgatgtttatggtgaatttgctgtccaggatgatgaaggttgtcctttagtttgagctagcatcataatccctttcactgatttgagttgcacattacccactgacttttaatatttctgttcgtaaaaatagagagcaaatctgtctatgttgggaacgtgccatcttctgtatctgaggctgatcttgagaatgagttcaagaagtttgggcggctcattcctgatggtgttgctatcagaagccgcaaggtggttccttatatgtattttttattacgtgatatgatagaattttcttttgacttagtgtttgtatgacattggcaggagaccggaggctactatgcgttcgtggaattcgaagaacttagtggtgttcacaatgcattgaaggtggcaaactgttcaacaaaactcacttttttttacatgcattaaataccttctccaatttgtgtgtgcatactcctttaaaatcaaatttaatgcatattcacttcaccatttactaattactgtgatgtttaattggtggtctgctttccccttttttaatgcactatatggtcatccttcgcttgaattagtaatcatggtttgacaggtcatatgctaaatcttttgccaattttcaggcttcaccaattgaaataaatgggcggcagatatatgttgaggagcggaagcctaacagcggcataagaggtggaagtaagttgctcttttatttttccaacacctatgcaatatttgcttgcagactacacacagcttcatggtgtagttgatggtggcatatacttgcgtaagtatgatatgaacctggtgcgtgtttggcattggcaggaaggggaggcagaggtcgtttcggtggaggagggcgagggtatgctagagggggaggcgacaacgaatatgcgggcaaccgtggtagtggcaggccatcaaatggctaccagcgtgttcctcaccatgagaggggcattttggggagccacaacgcaagaaactaaatggttcaccaccccatggtggtggcctggtgggatatgcatatgctgcaagcatgaggttttgatccgtcaaaagggagggagagctgcataactaagaactactgggttgtttcctccgttccgttaggttgctttttttttttggttttgggttttgtcgcagcagcagtttgttgacgaagaatgtgtggtatccaactttggctagacgttttattatgatgcaaatgcccgtccttgatgtgccatgcctgcattaagagcaggagcagcagctcagcttctcttgcgtgattgtttgcaatgcttcccctcgaggtatgctgatcgatttgatgctccgagtttatcatatacccggacttatcgtttagatcagaaattgaggatttgcccccagtcgtgcccatgatatgtgggtcagtggatgaattctcaaattaattctaatttatcaaccgagaattagtcgctgcccagtttgttgctaatactggcataaaatctatcacaagccagcaatgtcattcttttgccagaaaatctatcataagccagcaatgacagtttggttagtgacgaatccaaatttataacgtaaaagttcttttggttagataagcatatatatacttcatccctctcaaaataagtgcactcttcaaattaaattaggagtgcaattttgagggagtacccaataaaaactagtgttctttgtatcaaaatgcaataaagtggtgctgtttgtatcaaaatgcttggttaccatcacacattgttgtttgccaaagtttcgggggcgtaacaaaccaacatatgctttgctcgagtcatactcttatgaataagaaatcttcataagttcccatttgtgatccaactttataaactggagtacaatgttctcctttttattacagagaccatactgtttttttacaaaaagaaaaccttaattattatagtaactgttgttcataaacctggagatgtcaatccataaaaaaaaaagtaaccctggtcgatgcaaatcgaaatctcatcacagcagcatatgacgagaaagaataaacggcacaaggcgcaggaatcgcacagaacgaaatatagttggcatgataagatgagcgtgaaaaatagtaacatcaggaaaggaaagcggcgacgacatctcatcagagcagcataatggtgaaattaatgaaaacaagaagtttgatttgtctgactagacaggcaagaacactattagtagaagttaaggatggatggatggatcatttgaggggcgcgggcccgaggagcgcctgctgctggagctcaaggtcgttgagctgctgctcgcgatccatctcgatgatgagcgggacgacgaggaccaggaaggtggtccccgcgatccacgccgccttccccgtgctccgcaccaccttcttcgccctgctcgccgcctcgcgcccatgcgccgccatccatgacgccaggatgccctccccttcgccgccgccgccgccgcgcttgctcagggacgccattgctttctctccgcttcgcttctagggttttctttccgatcgatttcttattttccgatactaggtgggccgtgtgggccatagcgcgcagaaaggaggcctacgaaggccccatatttgtcctccattaatttctcattagttaattaattaattaattaattaatgggtttcctcctaccaaaaaaaaaaaaaaaacctttccattcctcctccttgcggcaggtgcggggcaaggatttatgcagatgactttttctgaatatgattgtatagtccttagagaccaacttaacacatttatctctgatgtgagatctgatttggatttctcaagttgctctgaccttggtaaccttgctgttaagatggttcaaagtgatagagaatttttccattggtgtatcacttaattgaattaaccttaaatttgcctgttgaaaaagccttctcagctatgaacattatgaaaactgacatgcggaacaagatgaatgatgaatggatgaatcactgcatgatatgctatattgagcgggatgtttttactagcattgaagatcgtcagattatacaacattatcgtgctttgaggacgcgcaagcacaaattacctagaggtatgtcatgcattgctttgtctacaaataattaagttctcataatttgcatcacttacattatgtaatatcattttctatattcatcttcaggttctctaccttctgttgatgaagagtgaaaatcatgaatatacgtcgcattaggtattctaataaaattttagtctagtcttgtactttttctacacttttactgtacttggtgcatatttagaaattgtatttcagtcttgcattttttttcgtacttgtactgcacttccaagtacgaattgatatggatagttgttagccttcaatttgagccctaggcgtgtcgagctcctagctccgccacttgaccaggtgcctagaaactctaatcccttttatgtagctccgcctaaacatacgagataatcttagcctgtggcaaccggcaaatgacttctgaagcctatctcatgatcttaatgtaattcggttcggatcttcttcacctccggcgaaaaaaacctaccagtaatttagggatttgtgcacgcaatgaaggagcgtgggattaattaggagataagtatatgtttaacagtaaatatgtgtatgatccattagaaaatacaagattatttagaagtcgtatctttataacagttaaaacactctcaccattagctaaaaaaaattcttttattacttttttttttcatttttcacctttatatatgcaaccatgcttttatattatagaggttaagagtcgttacccataataacgatattttatctctcctctttctatccttcgtatcaataagtaagtattcttaattagtaaaggtgagatcgctgttaatgaccattttacatgttctaatggcaaccggtgagactaattaggaatctaggagataattaatttagggcaagccgcgaggtggcctgaatttgtccaaactgacaagcaaaagaaatcttaattttcagtaaattagggatttgtgcatgcgttgcaggagcttcagagacttaaatggagcaattttattttctttctgtcagaggatccaaactactacagtaccgaccatgatcgaatcaattatgaagttcatcagtttgactttaagcaacttgtctgcataatacacatgtggatttaacaaccctgctttccaacttgttctgagcaatttaaatgtcgaagtaaactcaaaaccattcaaactagctcgatggcctcatcttagccccacatttaatacgatgaatatttttggaccgacacacacacttggtcacttgggtcactaaactcgcccataaatagacacctaattaagcttccatcgatcaactcatcacttcatatccaactctatctcacttagcctgagctgagcaatggggctactccggcgaggtagtagcggcggcggcgccgtgctcgtggtggtggtgtgtgtaggctgcattgcggcgacggcgatggcggcggcggcgggcggcggcggaggaggaggggagtgtcccaagtacaaggactcgaagcagccgctgaacaagaggatcgacgacctactccggcggatgacgctggcggagaagatcggccagatgtcgcagatcgagcgcgagaacgccaccttcgacgtcatgcgcaactacttcattggtatacttgattgcttcttggttcttgcagcagagatacatattgattcttgcatctaaaaacaagatacacatataataagtagaatgcgaatgcaaacacctcaggaaattatatataatatctaattaatatcgatgaaagcttttgcgtgtttgaaaaaaaactataatatagtgcaggtcaaactaaaacagtttgaagtctgaagttctctaatatatatttttgacatgcaaagattttacgcgttcgtgaagaaaaagtttgaagtttgaacgaatgtctatattgtgattcggccaggagtttgtttaagctagctataacaaaataacatttcttaaagaattcgtactttgataatgggtaatgcagacaaatgtctaacgaaccagtttggtgagattgggagtcaaacactctgaatccgtatgatatggtcatggaaatatggatattataagatactaatgattttgtaaatacaaggtttgaatcttagctttcactgcaagcacaagtgagggcatgcatctccataaataaatgtaaatactaaaacagattcaaaatgaattaattaatcaaaattagctagctactcaaaccggccattaaattaagacgaatatatatctctcaaattgcagggagcgtgctgagcggcggcggcagcgtgccggcggcgcaggcgtcgccggcggcgtgggtgtcgatggtgaacgagatgcagcgcggcgccatggcgacgcgcctcgggatccccatgatctacggcatcgacgccgtccatggccacggcaacgtctacaaggccaccatcttcccccacaacgtcggcctcggctgcactaggtaataaaatgattaattatcccccttaattaaactcaattaatgatgcatgaattaagtagattcccatatgtagctagttgtgataagtttactgaagatgaccagattgcacgccattaattaatcatccaagtctttgtatataaactctcaaaatttgcagtgctcgatgatgatggagtgagatccaagatttgagattttaaattagcgcgatcgatcgctcacgtcccaacgttttggacaagggaaagagttactaattgcccaactcgccaactagtaatattttgacgttgtcactctaattaatggtttctcaaacgcgctgaatttgaaaaggaaaaaaaaagacagattcgacttgaaaaaaaacccctactatcataagagtaattttaccatctttgaaaaataaagtaccataatttttattgtaaaatttggtacatctaaatattagctagcttaagttaccaaattttattttctagtgtaaaaatctttggtatcttcagttacgttttaaaatgttcgtaaaatttctcatcatacaataatgtcgtaatcttattttaacacaagaccaatagtaatagttttctaaaagttttactggattttattcatcaccggagggagggaatatacaaagataagctagctagctagtgagagcatatgaacatggtgtgttcttctccgagagatttgatagtgtaacacttcttaaaataggtttcgattatttgacattctgacccactttcatttacttagatggctcacatatcatcatcacaagtatcaattaaaacaattgggcaacgaagaaagtgtcaaattatcaatttttttcgttcttctccagggacccggatctggcgaagaggatcggcgcggcggtggcggcggaggtgagggcgacggggatcccgtacgtgttcgcgccatgcgtggcggtgtgcagggacccgaggtggggccgctgctacgagagcttcagcgaggaccccagggtggtgcagcgcatgtcctccatcatctccggcttccagggcgagatccctcccggcggccgccgcggcgtccccttcgtctccggcgggaggccgagcgtggcggcgtgctcgaagcactacgtcggcgacggcggcacgacgcgcggcatgaacgagaacaacacggtggcgacgctccgggagctgatgacggtgcacatgccgccctactacagcgccgtggcgcagggggtgtccacggtgatggtgtccttctccagctggaatggcgtcaagatgcacgccaaccacttcctcatcaccgatttcctcaagtccaagctccgcttcagggtatgtgcactactactatatatatacttcctccgtcccaaaatatagtcattttttaggttggcacaggtattaagaaagtaaatgagaataattggagaaagtgtgtgattggttgaaaagagaaagtaggtgaagaataatggttgtgattggttgagaggaggtatgtggagaaatagctttattttaggacaagacactctgctagaaatagctacattttgggatggaggtagtatatgctatacctttgtctacaaatatatatattcccttcaccctaaaataaataaacttaatacactaaagttggatataagtcgtacgtactaggttatatcacatctccaactaaattggtttattttgaaatggagagtataaggcttaattttgatggttaaaaataaactttgaaagtaaattcctctttcgttattttatttatgaaaaataaactatggtcataacaaaaatagtctcagttttaaaatataattatttctagtatttatttttttctaaaatataagcaattcctaatagcctcttatttaaatttctttttattttagccccccaaccaccactcattcaatgagaggcacccaattattttcttggcaacttttctccactaaacaatatagaaatatttatattttaaaatagattatgtgcttttgaacatgaattcatccgtatcggtgcatgtaaaatattattattggtttaataattagtcaaagatttaaaattaattggtagtcaaactcgacttgtatttctattttctagacggtagtacatacgtgtgagatcttcatgcatatatgatgtgatctgtttaagtttgaaaattaattaatgtgttattcaatttcagggattcgttatctcggattggcaagggcttgacaggatcacgaccccagcacatgcagactacatgttgtccatcaagctgggtatcatggctggcatcgacatggtcagtacagtgcacacattaatacatgcaaaaactaatttcatcataaaattttcatttcattgataaataagagacaaatatcgatccaagaaatggtcctttacacccaaaacatttcataattaattgactgattaattttcgaatgtttgtgtgcaatcaggtgatgatcccgttcacgtacacggagttcatcgacgacctggcggcgctggtgaagaacggcacgatcccgatgagccggatcgacgacgccgttcgccggattctccgggtgaagttcaccatgggcctcttcgagcgcccctacgccgacctcagcctcgccggcgagctcgggaagcaggagcaccgcgaccttgctcgcgatgccgtgcgcaagtcgctcgtcctcctcaagaacggcaagcccggcgacgcgccgctgctgccgctgccgaagcgggcgcgctccatcctcgtcgccggcgcccacgccgacgacctcggcagccagtgcggcggctggaccatcacctggcagggcctcgccgggaacgacctcaccgccggcggcaccaccatcctcgacggcatccgccgcgccgtggatgccgccacggaggtcgtcttcgccgaggcgcccgacgccggcttcatgcggcggaacgcggggaggttcgacgccgccgtggtcgtcgtcggcgagccgccgtacgccgagacgctcggcgacaacctgaacctgaccatcccggcgccggggccgagcgtgatccagaacgtctgcggcggcggcgtgaggtgcgtggtggtggtggtctccgggcggccgctggtgatcgagccgtacatggacgccatcgacgcgctggtggcggcgtggctgccggggacggaggggcagggcgtcagcgacgtgctgttcggcgactacgagttcaccgggaagctggcgaggacgtggttccggtcggtggagcagctgccgatgaacgtcggcgacgagcactacgacccgctcttcccattcggattcggactcgagacccgcaaagctaattaattaaccccttaattaatcaggggttaggctaattaatctcgatcatcaacgataatcgcatgcattaattacgacttcggttaatttagttgcgtggttaattacgatccaactcgggaggagtactagcgtgcatgagtcatgtcaggtcaaggaataaaacaatttagttaatgtacttgtaatcaagtgtactcctccgaatttactattctgaaatttactttgactttaagtaaatttgtcagtgtaacacatgtggatttaaccattccgttttgccaaattgttttgaatattttgtatgccgaagtaaactcaaaagcacgcaaactaatgcaaatattatgggtattttatcagggaaattttacaatcctcaaggccgtgtttatattcaatcttttttaccaaaaacatcacatcgaatgttttgacacacacatgtagtattaaatgtggatgaaaataaatcaattgcacagtttgcatataaattacgagacgaatattttgaacctaattacgccatgatttgacaatgtgatgctacagtaaacatttgctaataacagattaattaggcttaataaatttgtctcgtattttatatgcggaatctgtaatttgttttgttattagactacgtttaatactttaaatgtgtgtccgtatacttaaaaaaatatttggccaagaaactaaacacaacctaaatacctaaattctacataaaaaaattgatatcttgagatactctgaagtaccaagtttttatgttagaaaatatgatatctttcggtattttcttaaagatgataaaattacttaggcaactttttctttaattttctaacttttccatcacattaaaactttcctacacacattaactttcaacttttctatcacatcattctaattttaaccaaactttcaattttgatgtgaactaaacacaccccctattttgttacaccgacacactaggttagtcctagagaagctagtgattcgagaaatgaccggatcgcgcacgccaagtctttgtatacgaactcaaaatttgcagcgatcgatgacgtcgtgagacaagatcactcacgcccaatgttttggatcaagggaaagggttgactcttagcccggctcactaataatatagactccgtacacattgtctgacactctatcgatgactatgagactgtttgactatgaccattaatttcttggacaatatctacattgccaataaaaaaacataactaaaaattcttaaaattatttcaaaatatgagtattaatttttttttgtatgaacatttcaaaatatgaataaaaatataaacagtactcatattttgaacatttcaaatactcgtttcatattttcagtgtacctgtgagtttgtgacaaaccagcctgatatgatatgaactgttgtgcgcggtgtgcctattaaaactggcgctgttttgttagactgcatgactcctgaactatgaacttctctagacatcttctcctgaactactgatcatctcgtcccatcttggctgatgaaaatgaagatggttgcacctaccttctgcagaatctaagtattttccagccaggatctaagattgagctggaccattgttggattggtctgggccgccgccattgtttgtcccatctgggccttcagatatgtttagactataactgggccttgccttcttggattagaactggcccattggttgattgatctggccctacaagtatgtttacattagatactgggccttatcgcaataaacttgacgaataagttcactttaggattctcaacttgtcagcaagtctgaattcatccctataccaatataacgggcccgacaatttacaatacaggatcacccaagatcctgggcagtactatgcccgatttggcaagctgagtcagcgtgagacccacacgggccccacaccacacagaccccacatgtcagtggctaacgctttcttcactatcttctcccatcctcccaatcccctcagatgttcaaggtcccatctgtcgtcctgggtttcacgccgactcggcttaccacgtgagctaaaagtttaaaacaggcataatactatctaggacgttggatgatctgattttgtaaattttataaattgagggacttgtattttggcttagagataaatttcagaacttatatctaatatttttgacaaattgagggacgtcaagtgaacttattcctgaacttgattacctgcccgaggccgtacttaccaattctcccaacgcataatatccactttaacgtaacattccagatcagtttaccgattggcaatgctattgctgcgcacagattaatcctcctactaacatttaaattcaccctgagaatttgtgtatcaagtcttaagaataatgcatccttcggttaattaggataatgattttagaggaaacaaagtattctaatcaaaatgtaatcgaaaacagtaaaccattgcctaagcctcaacctggtgtgtccatatcatcagagaaaccaacacaggtgcatcatcagggagacagtaagctgcttggcgttcacattgccaatacaaaaaacaaaattctccacgcaggaaggtaacaagcaatccaactcaaccgttgacttgtctttgtacttcggtgcagtttttattacaaaaagcaagaataacattcattggtatgcttacagcgccggctgtcactggaaaagaaaaccattatggagtgtccgagcatttcaaaatgccttgagagatttatggcctacaggaagtttctgatgtccaacttcttgacatcaggcatctcctcgtctttgaactcctccctgataacaaagcacgtcaacgtgttattaacctttttcaatagagacgcacacatgatatgatatgcactggatattagttagcttgcatgcagcaagctgcaactcttattacttctgataagtcccaactcaagcagataaccaattagtatataaagagagatgtacctctttagttgaacctccattgcttcaacacattccttcttaagctccgtcagctcacttttggcaatttccaattcaagctcttcctcaatcttgggaagatcctccttgcggattccaagcctatttgaaattttgaaatggaaagcaaaaaagcatgaaaaaggttagtccaactaataaaaaatatatataacacatctagcatgcacaggaggaagaaaaatcaatatatttccctgcaagccagcaataatggatctcgatcacctaagtacggagtaaaaaacaagctacagttggttacaccatcatctgagagtatatttggtcccttaacccttgttagcgaacaagaaaactcttgctagtgagcaaggtcagataaaataactatacatgccctgaatcgcctttgaaaccagaaaattatcatgcaagcagcttaaggaattgcacgtttgatctatcatgtggatttttattctcactgaaatattcagaaaaagtatatctctagagagtagacgagcagtgtaaatgatgatctgaactatctcaaacttaagttgataacaaaatgatgaagataaatactttttgtttatcttctcaaactctgccaagaggagacccatattcttcttgtcactcctcagaagtggcttcttaatctccttctcaactttctcaagggcttccatcatcatagcctcagcacccatatcatctataaggccactcctatgtaacattaagtgaacagaagaatattcagacaagcaaatagtgcaataaaattgttatgtaggcaaatatcacattgatttaattctttacaagggtattttggggctgagaaaaacataagatgaaaattgtgaaaatgataatagatgtactttatcctgatctcctgaagagtattcaagtaagtccgtgcatcagggatgccctttgtaaaggtgtcgatggtatatttaatcctctcagagtcggatagaagatctgccctgcatttacacaatggaaccataactgagtaaatagatcaataacatccagaataagtgttacaaaatgaaagcaataaagtggaagcctatctcgatagaagtatatatatatatatatatatatatatatatatatatatatatatatatatatatatatatatatatatatatatatatatatatatgccagagtatgttttgctgcataggatggatgcattaatgtacaagtaaaatatttttttattttcgatggggcatcctacatcaatggggaagatgaaaaattgtactagggcaaaccggcaaacagtagtaggtaataagtaatatcaaatgggagttatttctacatatatactgaaatatacaatagtgcttaatgaattcaaggtttcgtaaaccgcaaaaaatctgatttatttaataaaagaactttacgctagagaatagaaacaatcaccacaaatatgtgtaaaataaacacaaaaacaatgacaaatcaaaggaaagtaataaactaaggaccatgaatacatgtgacagattataagtgatcttacttttgtcttacagtcttcatgacttgggcataacgagaaactgctgcaggatcatctggatcaatagtgatcttttccttcttaagtacaccaagggcagtctcaaatttcttctttacctcaaaaaatatgcccttcaataggtcttcatacatacaaaaaaaaaatcagaccaccaaaattataatacaaagtaaattgtgcaacttaaatacagaagtaatcagaactacacagcagagtttaatcaaacaaactccaactcatgaacatatgtaatctcttcagttttgcattgaaaaacattttttgaatgacataaaaacacataacattacttgtgatactgcgatggacaaaggtaaagtacagaaagcatttttttctacagctcaacacaatggtcttatggaaaggagttttgcagttaggattaaaagcatttgaaattcctacagaatttgcacaaaataaattgttaaatgcacttaaaatttaagaggcttaccatcaccattgacgggagtacgatctgcctccttggcatacaagcggacttgagtggcacctccatttgccaaggcagcttgagcagagtatagctgccagaagccagagacattaaccaatgacaattaacataaacaaagttataaaaaaagtagagaagctagagatttctaaaacaaaacattccatatagctttgtactgacaactttaccaacatggacgtccttattacataacatatacttcctccgtttcacaatgtaagggcccctttgaatcgcagggtagaaaaaatggaggaataggaaaaacataggattctgacaggaattgaagtgtaaaacagaggattgcaaaacacaggaaaaacacaggaatggtcgtttgattggagcgcaggaaaaacgcaggaatcagatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggccctaagtcattctagcatttcccacattcatat

SEQ ID NO: 61098 - DNA, 609 bp, Oryza sativa
ccatctccccctccctccccggctctctctctctctctctctctctctctctctctctctccctctcccccgctctgcccgtgtgctgcgcacgcgtgcacgtgagccgcgccgagccgagcgccctccgccctcgctgccgtttccctccgacgccgcccaaatcgccgcgccgcccgttgcttcccgcgcgcgcgcgccatggtggccgaccggccagtcgccccgccgtcagcgcctgcccgcgcctgccgcccgtgtcgtcgctccgctccaaaccgcccggccgtcatcgccgtcgtcatgacccggcccccgccactccacgcgctagcctccaagggacggaggcagagctcctcctccctctgccgcgtcgcccccgctccctcctcctttccccaaagaggcaaggggcaagctccctttctcccttcctttttccttttcccctccccgccggcgtcatccgtctctgtcgccgttttggccgcgagcgccgagcgccagctcgcgccttgaccgcccaaggtcggtttccaaatcgacatcgtcgtcctataaaccaaggcgccctcccatcaattcctcctcccgtttcgctcgccg

SEQ ID NO: 61099 - DNA, 11911 bp, Oryza sativa
aaggttgatgtggcaatgctgacaggtggggcccacgttgactcacccgccacgtcagacaaaaccagggtcaaaaccaccaaaggaccttaagcgaacggttttgttagttgagggacctccggtatctggttttgcggttgggggacgattttgtaactcgatgacaggttgagggaccttcggtgtacttttccctttcagaattggaccaaagtgacaacagggtccagggcacccaacaaccccggacacattaagttgacaagacaatcacagcagttaaatgacctcggagctacatcagtcacacaattcacaaactacattacttgtagaagttccagtccttcagataacaccgggtatgagcatgaacacaagaacggccaagattcagcaccatgaaccttgccgtcaatccctccacctgtgaccacagcttgggttgcagcagatgaagtacagtgtcaggcctttctcccccttagttggagcctgcaagttcaacgggaaaaagagtgactgattgcatccacagcttgtggcagatactaggattctgaacagagttgtaatatgtcacaatcaccaccactacgagaaaagccaattatgtaatgaaacggtttcctgaaccctgtggatacgaagcgatacatactatactaaaaactttaatatgctgacagaaatgtagatttgtatgttcatgctttcatattgctattctattcttgtatcagtgactgtatagaactatagatgatacagtagtcacatcgtatatagcaagaatcgcatagagaacaataagtaaacaacacaaatacactgacctgaaaaaaagcagcctctggatggccacagttgtaacatttaatacttctggtgcgaggcagggtgggatcagttgctgcatcttttaggatatctttgggttccccagcaggtttacggagaacccttttgtacacacaagtgtcagtggcaggctcctgcttatatgaacgatccaaataaatggaaatcattagtcaacctacaagaaaacttacacacaaattttttaaaaatgtcggaactacgaaaactataaatgcaatatagctgcaaagtatgtaagccttgagaaaaactcagcaatcacttcaataaacagaaaaaaaagagaggacattttgtggaagaatgcctaaaacaccaaggaaatctgtcttatttctatcctgattacattggttcttaatgaagttaatatgtttcagaagctacaacaagggacatatcaaacttcttttaagggacacttagttgtgatttgttacattgatacctcaggtaggttgttgcagtgtgcataattctggcatatgtttgtctctttccaatgagtaacatcttaagcatagtttgtgattacaagacaagttcctgattttctgagggcattgtatgccagataagctagaaacacttctcaaggaaagagagctaaagcccttgtaatatacaggctctatgtgggagtagatcctactttcaacagttctctgaccacagattttcagcagaaagttcatctcaaacggctagtgggaagccacttatgtaaccttaatccttaacttgaaagggaaaattggtttcataccacccgaaatatttcccttttagtcttaccaccaaaattttggggcatgctttgataccacctaataagattccgtttctttttttaaccaccagcacccattgccattcaatttttttttaacctctcctgctccgtatcgcccattacaccctcatatcccgcggtcccattcatccatcacacctctgccttctgcgctccccatactcccaactcccaagtcagcaccttccattagttgaaggaggcaactgagtttgtgaaatttattgctgaatccaccaaggatatctccttgtatatgctatttcaatgctacctcaaaatcttagtagtattaaacaaaataggcgatacttgcacggtacggaaccagccaattttgctaacatagaagccccaaatttggacaaatatgtcggcagtaatgacaaagagattctccgcctaacctttatgtatgagatcgagaacaaagcatgataagctgataactacctacaaaggaatattagccgtctaccaattcatcataaactcgccaagtcccaaccagaacccctctactctatcaatcgaacaaagcaagcatcaataacattatgggacatcaaattctttcctcagcgaaatctcccgcatgcagcaaccgtaaaaacgtgcgcaccaaacaatcataaatccatcccaaataataaagaaaaaagaaattacgatctcaacaatgcaccattaaacctagaaacctccatatacatacaccacatcactaaacccagcctaaaccctagatcaccattccccaaaatccccaatccaacctagggtcccaagagtttatttaccacacccaatccaaaaccatattaatctgagccgatgaacaaggcaaatccacctggtgctcgcaggaattgcaggcgtagagcagggtgtgcgtctccttgtcctcccgcgggtagagcatgttgctgctgcatatccaaccaaaaaaacacacaaaaaatcaaacctccaatcgaatcaaatctcggactacgaatcacaagccaagagattcctccgcctcaccattcgccgcagaacttgagggcgctcatggccatcgatggcttcctcctcctctccaattcactcgccgcagccgccgccgccttctcttctgcgctctcggctacttgtactcccgagatgcggcgccgcctggcaagcgggccccaggatcggtgtccccacacgtcagcgataagtgagggtacaggatacagtacgagatgggaaagggggtacacgtggcaccacacggtgggtcacatgccccccaacgccgcatcggatccgaccacctcctgggctcctctctccactaccaacctctcgcggagacccaaaccctagctcccaaatcccgaccagccgaagcatttccaacggaattcctctgttcggctcctcctcggggttcaaatcgagcttgaatttgtggttttttttggggagggttttttttttctttttggtgttgtttttggatgcgagtgtggcttggcagggttggtggtggtgatgccatgatgcacatgctggtggcccccgatggaggcggcggaggggagatgccgccgccgtacgggggagccgcggcggcgccgccgccgccgaggagcaggagctggagctccaccgcgacaacgccgacgacggcctcgacggccacgtgcggtgagagcttctctctgtgtgtgtgtggcaagtcacttgtgttcatgagttcatcggcggtgaggaggtgggcgaggtctcgtagcgtctcgcctttgcgtggtattcggggttcatccattctggcgtgctctggtttaagctcagaagattttgtttgtcctgttgcacgagtgaattttagtaaaagaaccttgggctttccatttgtcgtgttgatagttttactgtgtttggccaggtgcttgaggtgtggtatatccggcaacgcgacgccccatatgcgccgcggccctgatggcccaagaactctctgtaatgcgtgcggcattgcgtacagaaaggtatggctgcgctctaattttcgatacagaataccgatgagcctgttgtgtgataccatgttcagctataattcatttccgaggaaattttatagctgtctcttggccattttcctcctgttttggtgcattgatgataatctaaaatactaaatgtgtctatttctgtttatttactcaagtaatagtatgattggttttctaggggaaaatgagacgaatgatagaagctgaaccacctatagatgaagctgcacttgctaagctggttcctgaggtaggcatggaatttgagagtgaggacaaggcctatgaattctacaacaaatatgctggacatgttggttttagtgttcggaaaagtacatcacacaaatcttccggaaatattaccaaagtaaggacttttgtttgctcaagggaaggttacaacagggacaaaaaatcattggaagcaaagaagccaaggctggatacaagaattggttgtccagcgcggttgattattaaagtcacaccagagagtaaatacagagtcactgacttcaaagcggaccacaatcatcagctggcccctccttcgacaatgcatatgttaaggtcacagaggatattgacagaacttcagtctggggaagcagaattgtcagatgattctgtcatgacacctacaacaaaagcaaccggtgatcttgttgtgagacaaattggtttccttcgaagtatctctctcctcccagcagattataagaattatctccgttcaaagcgtatgaaggctatgcaactcggtgatggtggcgcaatattgaaatatttgcagacaatgcaaatggaaaatcctgctttcttttacaccatgcagattgatgaagacgacaagctaaccaacttcttttgggctgacccaaaatctagagaagacttcaactactttggtgatgtcctctgtctagacacaacttacaaaataaatggatatggcagaccattgtcattattcctcggagtgaatcatcacaaacaaacaattgtttttggtgcagctatgctttatgatgaatcatttgagtcatataggtggctgtttgagagttttaagattgctatgcatggaaaacaaccagcggtagctttagtagatcaatctattccacttgctagtgcaatggcagcagcatggccaaatactactcaaagaacttgtgcttggcatgtatatcagaactctcttaagcaccttaatcatgttttccaaggttcaaaaacatttgcaaaggattttagcagatgtgtatttggctatgaggaagaggaagaattcttgtttgcctggagaagcatgctagaaaagtatgatcttaggcataatgagtggctgtctaaattgtttgatgaaagggaaagatgggctttggcatatgagagacatatattttgtgctgacataataagtgcacttcaagctgaaagcttcagtagtgttctgaaaaagttcttgggccctcaactggatttactgtccttcttcaagcattatgaaagagccgtagatgagcaccgctatgctgagctccaagctgacttccaagctagtcaaagttatccaagaatacccccagccaagatgttaaagcaagctgcccatacatataccccagtggtgtttgagatctttcgtaaagagtttgagctgttcatggactctgttctgttcagttgtggggaagctggggcaacctctgagtacaaagtcgctccctctgaaaaacccaaggaacattttgttagatttgactcgagtgactgctcctgtatctgcacttgtaggaagtttgagtttatgggtattccatgttgccatatgttgaaggtgctcgattacagaaatatcaaagaattacctcagagatatctgttgaagcgatggagaaggactgccaagtctgcaaatgaagaaaaccaagggtatgtggcaaatggaaatggttcatcattaaattccattgtacctcctgcaaaccatcatggtctccaaggcttcagtgcaatgattcaagtaaccaatctgcaagattcattctccttgttttccccctgtatgtgctgtggctgataaagttttctatcttggttaactgcaggacactcctgtttctaatatgcatgagaattcatttcgcagaagctcatgatgcaggtatcatacatgattatgaattattaatatgccaatttgatctcttgttttgtttggactattactgagcctatctggttctatccattgcaccaaaacctagggcattgatttacaaccaaagtttcccccttctgagagatgcatgacaaattttttagggagatttagatagaatattttgtttgttgaatattgctcacttggttctggattttcctccttcgaggtacaattattaaagcagtttggcgatgacacgtggacaaacttagctctgttggatcaaacagattatttatgtgatcaatttatcatgcaggtgacttgaatctaaacattattccttctgcacggtgcctgctccacgatactggcgttgaagcagtgagaacaggccatgcggagctcccccgaataaaagtttccaacttgtaaattatgcagctgtaggaaatcccagctattgaggcgcccatcctacttaggctcttagactagattctggtatgaaatcatatgattgtgctgcccacctgcacccagggaaattttgtgcattctgtaaacagtctatttatcctagcccattcataaaagaaaaaaaaaggtgatcagatgccaatgcagagagattgctcctttgaaactttgcagggcaagcagacccatcatgatcatcaatcctaggagggtttcagttagattcagatcttggggtggtttcatttcgtttcatttcacctgcaggtgaggtgagctggacagctcatgcaataaaacgttggaagcaagacaagcccagcttggcagtgtggatctcaagcccggagagctaccggccgagctaggagctgcctttgacgctacagtggacagctgtgctttcaagcctggctttgggcgcatttgtcccatatgcacagttgcataatgcgtgcaaatgttgttcattgtcctcaatgcatcgtatatcttgggagcttcgataatgctgctaccaatgtgtccttgaaaaacacattcgaggtgctttcgtgctcgctctcttttttccaactctgtcaggtttcttttcaaacaaagttatttcagacatttttctataaaatgtctttgaaatatatacttccattcaaaggaagcctcaatgcgatcattttaacggttctaagtaaagtatcatatatttagtcttgttttgtgttacctctatggtgaagaggggcatatgtgcgctggtgcatgtgtttatcttaggccccgtttagttctctaaatttttttttccaaaaacatcacatcgaatctttaaacacatgcatgaagcattaaatatagataaattaaaaaactaattacacagttagggaggaaatcgcgagacgaatcttttgagcctaattagtccatgattagtcataagtgctacagtaatccatatgtgctaatgacggattaattaggctcaaaagattcgtatcgtggtttccatgcaagttatgaaattatttttttcattcgtgtccgaaaagccctttcgatatccggtcaaacatccgatgtgacacccaaaatttttcttttcgcgaactaaacaggccctgacttagtacctgtaaaagaaaagtcagtgttttcggcatcaacttatcgactgtaaaaataaacgatcgtgttggggccttggggattgaaaatgagatcttgaggttgaaactacacatccctggtcactttacacatccctcgtcacggtaacatctcatatccttgacaactgtaaaaatgctctctcagtaaacagtaaaattttgtgccgggcaactgtcctgatgataatgtggagcgattggctgctgtgccgtagcaatgtgtcgttcgctgttgattgctctgccgtcacgcgacgcatcaagcagctagcagagcatgtgacctgactatatgggcaacgtgctgtggctgctctctgcttttcttttcctcccctgcagccactgtactgatcgactgatatctgcttcctttgcgtgctttctccgtgtaaactcaagtaacaatgccattttttctcttcctttttttaacgaatattatgagataatgtaatatttcacattgatatagcaggaaaaagagccctaagagaccataattagaaaaagaaaaaaaacaaacagcaccacgtcacggaggaaagagtgccaatttttattcctcggtttgaaaaaatacaagagatagttcaaggagatttgtccaagtgttgcttgagtgcaaatttgacgatgcttttcagcttcagtctgaaggtgtgatgaaaattcaggagccgtcacatttgatcccggtcgttggtcggtcaatcttcgtcactgcgattcaaaacaagcaccatctgattatttctgcaatggttagtgagctaattggcatcaaaggctaaaggttaatttggatgtctcttttcatgagaagcagccaaggaaacaaagctgatttgtgcgttctctgaaaataaaaagacatgaaaaagtttgagttcaggtgcttgctccactattccctacttaactccaaagcaatgtcatgtggggagtctaatacgtgattatttcgcattaaccttaagctaagcattcttctcgccgtaatcactgacatgcagaaattcaacgtcctttcttgatggatacatcacacgaattgggtcaagtgtttgttcaagaaaaactccacatatcaagtcattttctttttctgatttagatcactgtcagtgtcaattgctagttggttagtgtttaattttgaggattacaaggggaataaatgctgaatttataccacgaatgacttgctggcagggtgtcattacttgtacccgaatttcagcaagattgtgtatttatgtgtttgtcagtaattgatttgggatgctatatgtgcatcattttcctgagtaatagtgttactagtacccaagttgttcatcattgctttatcattacttcaagtattatgaagaaacctgaataggagtagtacctgataagtatgccacccattctgttttttcctgaaactcatcattgaagcagcccctaactctgaattttcttttagacggatggtcagactaactcagaatttaatcatgatgtttaagaaaccattagctttattagtatatgtactaactcgagattatccaaacagaacaggttaagcaagcaaggaaagagagatggccccaaaatcccagataagtgacacgttttcagctttgctaatcacttctgaattctgacagggaaccaactaatcatctgatggagatggacacgaatcttaaagctcgacctgatcggattagtcgatcaaatctctggaggaaaaaagaaagaaaggtgatcagacaaatggatgatggatttgttcaatcccacgatatgcttgcaagagtacaaagcaagatacttcctaatcggagcatcaacaactttctattaaatatatgtgagaagaacactttggtcactctccatcttgtctttggcgtcggctagttaattacttttggggggcaaaatggaatcacaaatgtttttccatggaccacatgaagcacaagggtataaattttcaaatacataatatttgagggacctatttgtaattatgaattagatattatttttttttataccgcaacaaagtcaaataccagaggtgtacagttcctgtattattcagagatatgggacaagagatagagctaattaagaagttcagtcacaaggccaggctgacttgacagagggagcatacaaagcagaagactgtactgaagaatgttttaatgtgccatgcacagtatagcatgttcagattattagtttttatttgttttttcttttctttttcttgtctctttgaccattactgtgtgcagtgtgccatgctaagctcaactcctaccaattgtgtcggtttctttgttttattaatcaatcagttgcttggaatcatcagccagtgtttcattgagagatgcacccctcacatttttaatggtagatatgtactcttttcttcttgagaaactgaaccttgtgaagaagtgtgacccttattttaaccaaggaacaattggttaaatacttcaaattagttgctacatgcatgttcagattgattaaaggatttttagaagaggggggggggggggatgcagtggatgttattttctagacatagatctaattgacaaagatccaattttttctcctcataattgcctagctgtatattttgcacaatgagtccagaattgatgatcagcaatgccaccaacaaaccatgactaatcaacatctacagtactatgaggcaggtgatcaaaccctgtcctggagttgacctgctttaagaaaagctagatagggggtgaaacattgcaatcttataaacacaattagcagtaaatttatccatgcacatgcactatttgtgatgcaatactagcttacagtgtttatgataaaaattatagaccttgtatctatcaagtcaaggttgcatcttatcactgtttgttagaaccgagcacatcatgtcacctgactaggacttgacttaattttgctacgacaacgataataaagtttcatgtattatcaatttgtcatgaaaacaattgaaatttcgtgtaagcattcagtgggtcagagaaatttgtggtactgttttcttttccttaaaattaaagaaagtttccaatgttacatcacaggaacctataaacaaaaccaaagtaatggataaatcaatgtttgttagaaatcttgagccaaaatccaatgacctcatgtgaaagtgactgtgtggggtaatacatgagcctaatgttccaactactcactctattgtaccattactctgccccactgtcttttttttctctcccagtcccttcatatgatttacaaacagtactaatgcaaagacattttcattcttgagagatgttacatctgctgctaatggaggttaagatgaagatttgctataataacctagaaacaagtttgttggttctgttctaagggccatggttatgttataattattctagattaacttgattctgaaccttgttgtctgggacaagctcccttggttgcaattctcaattcctaagttgttttcaccgacagagaggtggaaaattagcatcatgttgcatcatggttatgtgagttactgtttctctcatgttttttttttgagcttcccgtactatttgcacattggattcctttttttctttcttggtcttctcgttttctcaaaaatcaatgaacatcaaatgtcggtcaacagcaagacctagatttttgggaattagttttggaaaatattgccaagagaaaattggaaaactaatccttttgcatttgttccgtactatatgcatctttttataaagaggctgagagtgttctctgtacaattctattatctttatataattaattgagtttaataaagcttcaattatcgaaacaaatctaccatacaatgcattgattaggctaatttagaagaatattagggtcacttagtcacaaataaaatgctcaaaaatcttttaacacaaggctgggctagctgtcactgtttacccctttggggcccctgttaattgtctagaacaatcggtgcatgatgcttactccaggtcagatgacctgatgtttagtgcagaaaccaagaggtgctcaattggaccaccgtttatcgtaccagcctctcttttgcctgttggaaagaagaaaagttgtggttgacactacagggatttttgggtcgagaaaataagtgtaccgatttccttcaatcctcccttgtaagttactagtagtatgttggtaggtgagtaaaaatgaaaatttctatctgttcctattatcaaattacatt

SEQ ID NO: 61100 - DNA, 9449 bp, Oryza sativa
cagtcagactgcatgcaagacagtaagagtatctatttcatggttctagtacaccaactagtcaacaaagaacagtctgacttattaaataatatggcaatgccacatgctaagccaggtggcacacctaattgaagagttttgcttctgaatctggaatgtggacatcctaactggaaaacgttgtgcctatcttagcctcttaggagccttgattaattctagaatgaatcaagattgcaggagtgtgaagtgcatatatttaagtactacttgattagttctgcaactatatgcttaggcatgcttcaagtatactttgctcacatcatgcctttgtcttacattgacacactcgactgttcatgctcactgtaactgccaatttctgattaacatttttttaccattttgtactgtttctgactgttaatgtattgctttctctatacaggtaaagtagaactatagaagtttacttttgaatgacactgttttctttttttcttcacgaaattaatgaaggaataaccaagttgggtaaaagagtactgctagtgatttttttttcgaaaataaaaggataagagtgtacaattgttatacttgctcaataggctacatattgaaaaataggatccctttaaacgaatctaacttttatgtaacaaaatcaagaaatggttaagtttgaaaagatcggcgtcttaattctgtttgctataaaccaaagcgaaacttgattactaattactgtgcgctaacctattgcatcgtttaagcccatgctttgctttttaagattgtttaggaacacaaatgaactcagtgctggcatactacatgaagagcatccatagaacccttcaaaagcaaagaacatcccatagatactatgaaggagattaacatgaagagatcatggaacaagaagtcacggtgatgattttccttgcgaactgggcatgatacatatatgctcaagaagatcatggagcaacaagtaagaaacactgatgatttaccttgcaaactggccaaagtctgttagctgatacatagagagctcatcaccattcaggtgatttctgcaacactggagctctctacgtagttttgcatatgcagaaagtatgcatgcatggaaacagaaacaagcaagttctgcacaaaactcagagactacgagaagccattggttacctggccatctgttgcttcccttgcttcttcttccgtcgccattgctccagatcaggacgggaagaagatcaggatgggaagaagaaaagaaagtgaaaacaaaagaaagaacgaaagaaagaaagagaggcttcttccctagaaagtcttgtgggtgcttgaaaagatggcggtctttataccaccctttcttctgtcgatatattttctattgctgagcagcggttaggaaagcaatggcagactgacactgctcttgattggcggttagcgctttgcttaaccataatctagattaactggtagaatgtatcgctgaaatggttgatcagtgaacatggaaacttagcattaggtgccaaaatgccaactggtacatgaggcacatggtagtggtggctggaccagtgtgtctagcattcttgcattgctggacccacagaaccttttctgtgtgaaattattgcatcgataattgctctcaagtatcatccttggatccctatctttcattcttttttccttgagtgtacctcggaagaaaagtttaattttcagtgtaaaaatactattatctgccttttcttttgttgcttggctttacatataacataacatgattgttcaatattccctacaggtgcaggtcatctcataccagttaggctgccatggcatcttccggcacattcgacgatctatacaatggggaaggtgtcacaaaaggtactgtccatcttacctcataatgcacttgtaatgccaagtggataatagtatggatgcagtcaatgtttcttcaggacatcaaaaggtttgctgaatctaatcgagtgaaaggagcaacacgatgaaagtaacttctcctctgatataatggttttgtgttaagtccaggtaaacaagcaccacaatataatatgttggttcaggtgtcattttttcttcctggacctgtgctgctgaacgccaaattgaagtgtctgttgcgattttttgtcaggtataggatcaccaacagtttgtaaacctcatatacttcaccatgagctcactgtttaaacatccagaagtatggtagccttgacacctgctgacattgctcatagagggcctagtttctgaagactgcagagccacaggtacagataaaggaggtgcatgccccctgaatattcaatcagtcaagtggctgctgatgacagtgatctgcagcaaaagaattccacatgatcaactactttggagaaggaaaataccaagttggcaaatccaaagtgccatgctggatccagcactccagctactgatcaaacaatccaaagttaatcctgtcaaagttaagaaatccaccggccgtcacctgcagtgctgctttcagagactaaaccagatgattttctgaaaaccagaggcaggtggtgtttatgtcatgtattattccatcattatcactgcgccgaaagagagaaatcaatggagatagccatgcgaagatgatgtcatggatgcttggaaatacttatcatcagcctctatcagagatgagtcagcatcgtacgcagcccatatcattggctggaaatattgttcagaggttgatgttttgtttcctggcactgttttcttttgctccctggaatatatatagccgtcaccctgtggtcccactcccaccgtctatgtacatgtcaatgtgttgctgctaattaactagcacagcaccatctccataagcttttttgcatttgtgaaaacaaaaattctgatcatgcaaaacagaaaagaaaaatgaggaaatgttaggtccagaaagaaagaaaggagctagtgtttttcttgagagaaaaaaaaaaggaaaatattggatgaaaggaacaagagtatagaatatatctgaccttgtgattggaaacaaacatgcaacagcacttagggaggcaccggccgtgcaaaagccatcttgtcatgttgtgccgccaaaatcataaccacctaaagattttttgtttttccttttttccttctcaatccatccatccatccatcagctgagcaatttgagtttggctgggaatatttgataatgacacataagacaaggaaaatatacacactaaaggcagcatttacaaataattagcactaaaattgcactaatatatatgtggagggagatagaaagcatcttgttccatggatggccagtgtttgatcagctgatgcctctacctgtttctgccatgattagtttggccagatcgacaattaaggcagctgcagttgtacgagctgtgcttttgtttcgtagctagggagagatcaatttggctcgcaaatgtttgtaccgtatacgcatccaactacgtatttgtttgcactagagactgactgatccagctacgtacgtatagctattgctttgttggcttatgatagatatttttcctcgcattttgttactctatcggttttctttcataatatcataattttattgggtctccaaatatatttctttcagtcaaaattaacggttatattggagactgattatatggtcaagaaggttggtgttcatatatgtagtataactcgttggttgtgtgtatctcgtgcagaggttgggcgggttcagttcgattatattatcttggtgtaattgactgagttttaataaaacttgaattatctaaatatagtataactctcactgtgccttttgtttcacttctgcatttccaagtatgtgtgagcaattcaaagatcaaaattccacaacatgtgtccggattggatagttggatctatggcctttcagagtgtagggtaggttggttgattggattgcaatataggtccacttactgttgtgctttccagccttgtttgactcaggaatcagaatagaacatgctctgccgtggattatttgttacacgcttttaaaaacatgttattcttaaaatagtttgttttactatgtttcttagatgacttgttgtaaactactcccttcgtttcgttttttaatagatgacaccgtttacttttaaacacatgtttaactattcgtcttattaaaattatttatgcaaatgcatgaaatataaatcatgcttaaaataattttaggataaaacaactaacataactaatgataatttcataatttttttagtaagacgaatgatcgaacatgtacccgaaagtcaacggtgtaatctattaaaaaacggaggtagtatttgttgagtttatttcttaaaatatttaatttatcgttgtaatcaagtagacaaatccactgtaacaaatctcgtgaataatctgtttcaaacacctccctaaaaaaaggaattgtcttagctttcatcatcactgcatgtttcaaatgaatgtttggattgccacaaatttttagccatacttgttgaaattctagactacaaaagttagtactatcaatacttgccaatgttttagcactaccaaacattgaaagagaaaaaattggcttcaaaccaaccaagacctttcacctgcaacacaggtgtactgaactgaatatactgctcctaccaatctcagacagatactgaagattagctgcttactacattttacagatcagacaagctactacgaagaacttgctaccaaacacggcatctaggtaggatggagaaaggggagaaaagaaggctttttggaagcaaaagcttctgcattgcaggctggctagtgctcatgtgggcacatcaaagacagctttttttcccctctttttttttcttttctttttttttaccatgatcacagagcaaaagaaagaagaaaggttgcttcaagaggcaggtgaatccagcgaagtgaggacattttcctgggccccactcttgtgctgtgtcactgacatgtgggcccccagtatctgcactcctctatccattccagaccacactagtcacttgcaatcagactaacagagtaacagtagacaacaaatagctgaccagatacatctaaagaaagaatttttctcaccagatatgcagataaacagacaagattagttgagtactcatcatctctgtatgacttcaatctcatcataattctgtttcaagttgacaagattagcactaagcagtttggtagccatacatacattgcatgcaggaaggcaggcaggcagtatcgatcaaaccttgtactgaaaactctgaaacttctgaaaactctgaaagtgaggctcgcggtcgtgtctgcctgcctgtcagtcttctcatcgtctcctcgtggttgagctgtccctacgcatatggcgctgacgtcatgtgggccccaccaaccgcccctactacaattaggtgcctaattttttttctctctctctctatcccttctaagcaaaataataatcatcattggggttctagattaagagatggattatgatctgggattatctgtattatatttgccaatttgccaaaagcccaaattaaacggtaggtacacagacagacacactcaccagaatgtgcagctatccagctgggagcccatgtcatcactcactctcatgcagctggatcatcaaggtgtccatccaattagtccaatcgaacacaagaggagcaagaacaagaagtactacacttgcatgatggtttggtttggcttgctttggcttgaatcatcagcaaagaatcaggagttcaggactaaagaaatcaaatgagcactattgtctttgcagctaattagtagacagaattaagattctgcagttggcaattgcctgtctgttaacaacagaaagctgcagaagaggctagggctagggagaaagacatcaaggcaggttcaggctcttcagaattcatgcggtttcaggatggtcacaaacagagtgttgcacatcaaggactctttggaacttaggatttttagaataggaataggaaaaacgtaggatttgaataccatcacatgtaaaatcccataggaaagaaaacagaaagaattatttaatacatatgtttggatatatcacaggaaaaccataggaattttgagagaagaagccttggaaatctcaaaggtttttgaaacaatgaggtttaacctacaaaaaggggaggaatttttcctatcttttgattttcctttgaagcaatcctacaatctaaatgactcatataggaattcctatcctttttttcaaaaagggtatcagtgtttctgccaaattgccaaaaacagtggagttagcaattgagatgtattactttgggcctgcccaaagtgcaattagtgatatatatcaccaataactactacaagcttatttgctactgggccttgaagcccatgaagacatgggcctcaacaactactgaaatctctgacaagtatcagtatgcatgcagcttcaataattaggagcctaatacacaagtacaaagcctatcttaatactaccagctttccatctcaaacccagtactgcacagttagccaccccttgcctttgacaaaagaggacaactcaaaaaaaaaagttgtaaaggctcacctatttaattagctccctttcttctgttgctctctacactgtcactctcactgcacttcctagcttagctgttcatctctcacctgactgaaagcctccattgccagtttcttcacctgctttgcttaacaccaaagcttaattcagtaattcatcagctacactagctgctgttaattaagcagcagaagaagtagcagcttagctgctgtaattcatcgcatccatggggatccaagaagtgaagaagaggctgcatctccatgtcgaagcccaaccggagagctgcaagaagaaggagcaggccgccgtgtgggtgctcgccggcggcggcggcggcggcggcggcggcggcgagatcacggtgtcgctgaagccggtcaaggtcagccggccacagctcggcgacgaggaggaggaggaggaggaggtgacgacgccgagaggggaggagtgcagattaccggcggaggcggcgacgtgcccgccggcgcccaagaagccgaggacggcggcggtggcgatcgtcgccggcggcggccggcggtgcaactgctgcgacgacgacggcggcgactcgctggagttcttccgcgtgccggcggatttggaggccgtctttgccaaccgagttgcaaaggcaaattagtagtaattaatttcatagagagataaattcgtcttgaattttaagtgtaatttgatccaagtctagctctgaagatcagtgcaattaatggtgtgtgcatgcatgggtgagtgagtgagagatcagtgcagctgtaaaaaaaagtttctctttgtagcacatgatagtgtgagtgatttccatatgattccatcccttttgattgatcatttcttcaagaattaatcaagaggcatttgtaatttgctctctcgatctcttaaattgtgtgtgctcagtgatttcccgcgtttttttttctttcatctctctttctgtatggcatttggatagagtttggatatttccaagttctttagcaaatggcaaaattttcaagtgcacttgagcttggtgattgtgaatgtttgcatggccatgcatacatcatccaccaatcattttttaatttttggattttgtagatttctttttcaatatttacacaagatatttttccaactacaatgtgtaattaagccataagtattgatgagattccagagtattggcatcagatttccttcatgctttttttaactattgctggtgacgatgaagatgtcttaaacacacacgctaaccctcaacctgggatctaaataaacaaaacttcgcaaaatgttttcgggattatttgattatgtagcaattctcaatggaaatcatggggggattcacatatcttgttgtgttttaaataaataaaattgctgcaaaatgctaacatatgtactcaggacagcccatgattcaatatagcaaagctctaacccgccaaaatttgaaaatctgacttcttagcacaaatctaattaattaaatccccgaaaacatgcaagtcacttgtacatttgatataatcggttgttcctaaagtgatttactttctcgagcttcgagaagaaaaatatactaagtatgatcccaattggaggtactatttatattttacacaagaactttagcaaagttgccaattcccgtacatgatacacaaaaatgtcatccaattcttgtacttgaaaaacctaataaaagaggacagtagtgctttttttagaggacaataatgcttagtgttggctatctcaaacaaaatttgtaagtccatcatattacaggattaatccatccaagttgtataaatcaaatcctacatgcaaacacaaatcagacactccaaaacactgaaagaaaaaagagtcaaagtgcagtggttaacaatacatgcatgcacactatcaacttctcactgatttttcttttttttacaactactactacctttgaagtgctagtagcttctggtcagtgtaggtatcccaatgttccatggaatgttctaatcctttaaacattaaaaattcagatacaactgctgctagatggatgcaggaggcacacacacagtatgtagtatatatgatcatccaacccagttggactggactgaactgttaacttggcaatatactattactgtataaacatttggatactagtgtaacggctcccactaggcctcagtgctatctactataccttttctcccttggatccctctatgcatgggcccctacattgctcaaaggcaccggccttgcaatgtctgtcttcccgcttctactggtttgaccctgcacagtgaaaaggtgtttgttattacaaccctaaaaagaaagtaaaaaaaatatacatcactgctgttaactatgtctttttactaaagatacattactagactagatgtgcccttttgtttcatatgattcttaatcagtttaagatgtgtgatgatggataaagaaattgattcatcttgtggaaatcatctacaagcatgatcactaattgctgctgtcaattattgttgaactgttactgtcttataggatcaagattcaagaggttttgttttatttccaagaattgtaatgcacatagaaaagagtaaaaggccgaataaagtcc

SEQ ID NO: 61101 - DNA, 515 bp, Oryza sativa
aaaaacaaaacgacaagtaaatatacagatcgaaacctaaataaagcgtaaaatactaatagaagaggcacttagtccccagaccgaaaagaaacaactgtgaaaaatagacgatcctagcggtgcttcagctccactccacaggcaaactcgactgggtataagccttggtcctctaacatcatctttagctcagaagcactacacttctgaaaagggggaataattagcaaggctaagtacaaccactgtactcagcaagccacacccatgatgcagacgtgcaaggggagacaaagaagggtttgtggctatttgcataaaggtggttgcaaacatattatagttgaaagcagaaaaactattgattaattaaggcaatattaaatctccactggacaatgctaccccacattgaacagacccaaccaaaccacctgaactacaccagttctttaagttaaattaattaatagaattgagtctaatcacgatggctagttgatcgcccataa

SEQ ID NO: 61102 - DNA, 10348 bp, Oryza sativa
attcctgcagccccgccaagctttccatagcttgttgaccagtaccgaatcatgaaatgttatatgtgggaggatgctgaattgggaaattgcaactgtggtgagaggatccgggatgttaacaaccaaaccgttcccttgtttgtcccctcacagaggagcattcccccttctaatctgaaggatatcgcatcatcccattcgctccaatcaacagtaacacgaaatgcaccggactcacttgcgcactaaaaaaacgccacccacccccagccaccgcatccaacccccaccattgcaaatttgcaatcgatcccaacaaaaaaaacccctcaacgcaaccaaccacagatcccacgcaaaaccgaaccaatcgtcggcgccgccgccggatcagatctacctcaaaactagggtttccgcggcggggcgcgcgtgcgcgcgcggggggacggggacggggacggggaagggagatgcgaacctgccgggagcgggagacgaggcgagcggccaacgccatggctgcggctgcctccgcttcgctgctccgatctcacccaaacctccaagctccgcggcgagagcgagagcgagagagagagagagatggggatgggtggagaggagacgaagaaatggaggcggcgccgcgctttgtgagggctcctccccctctccccgccgtccgatcccccgatcaccccgcgcgtccccgcacgaatctccaagcaatcctgaccaatgggcccatccggttcgatcttgtattttttttacttttttgttctttttaaaacttattctctcgcattttcatttatgcttatatttactgaccaaaatttttattttaatattaaatttagagtgttttttttcgaggtttatttttcaacctttgtttatatatatatatatatatatatatatatatatatatatgacactcatatggggcaccatggtgcccgggcaccatggtatctaatgcacaaaatcactcaaaattttcaaattgtgagtatatatctagttataataattcgattcatacctatacctatcaacaaaacaactcaaatttaactttatttcacaatccatgattacatacctaactaattatatgtatagatgctatatacctagaatcaaaatctaacaaaaacaagttcaaattcagttcaaacttgctttgaactagttagtaaagtggttaatgttaatacctaagtaactgaaaaagattcatactcatttaaattgggtatatactcaatttcaacaatggtgcccggacaccatggagcacaaaacaaatttactatatatatatatatatatattatttataaattattttatttgcaatcataccgaataagccatagagcccttatttataaataagtttttcggaaaggactaaaatgtaaaaaaaatatagtcgtcgtgttcctccggctcggcggctgcattgaccttgggctccgccatgaactcgatgctgctcaggccgctcccgagcgcgggggcgagcggtggtcggggctcgccggggagggggcgggtggttggctcggcggtgagtttcggcgggcgcgggagatggcggcgcggggtggcggtggtggcggcgggggcgggggcggaggcgtcgtggatggaggaggcgggggtggcggtgctggaggagggggtgaggcggaacccggcggtgtcggactcgtaccggccgccggggatgccgcggccgaacgcgacggtgctggaggcgcaggcgcgggtgtgcacggggcccgagcagacgcgcccgctcggggaggagcaggccatgcgcgtcctcgacaccatcctccgctccggtgagtgagtcaagtcaccgccatccttgccggcgggtggcctcgcactctcgccgcttcagctttggtgatttctagcatcgatcggatcctgcgttgcagccaccgtctgtgcggcaggaaattgaaattctgctgctttcactgtcactactggaatttagaactcgagtcctatgacactaatatgtagactgcggttagttttgatccacattatgatgattgcagtaacatctcatctccttttatctaggaatgcaaaattttgcttgaaatggagctttctagagtttagcacttttttgtgaaacattagctcgcgatttatgctcaattgtactccggagtgtaatactaaactttcggtgggacatttattgactttggatactgatttttacaatttgcttgtaaggttgtatttgagtgacaagtttacagtaggtctgatttgtgattggtttattttcattgactctttgccttccataacaatcttatgatatatgttacttataatctcttgtgtaggaatgggagaactcaaagatgagccagtatccagtgcacaactgggtgcattcttcgctggcatgacaataagagctaattcctttccagaagccacccaatggagtgagggtgagcgtcgtgccatgagcttattttggccacggcttgtcaatgttcttccccccgaggtgaaatttatagcagatccggaaggaacaatcatgggagcaaatggtttaactggacctcggtatgttggtcaaagcactgcagagatgagacttgtcagtgctttgagagaagttcttgctggtggccatttgggttatgaggaagttcagggtgtactaaaggatgttctaccagttgaattagccagtgcaaattcaactatggttaatgaagcactgctggcagcatttcttattggacagcggatgaatagggagactgatcgcgagctcaaaggatattgtctagcctttgatgatgaattaggtaacatcaagtcagtttctctttctcaaattgaatataaaaaaattatagtgtcattaacaccacattatatcaggtccaactccagttgctgatgtcaaatcattgacacactatggtgagccctatgatggaaatacacgctttttcaggagtactctgtttgttgcagctgttagagcctgctatggtgaggcttgtctcctccatggtgttgagtggatgccacccaaggtcagtacaaaagcatacccatcaacaatcatcatacactagtgtttttctttaatgctatggaagttttggttaggagatggacttacctatcacttaattttgaaaaccctctgtattacttaatgatcaagattttcagggaggcataacagaaggtcagatgcttaaattcatgggtgcaaacacacatttgtccacattacaggccaaaacactactggaggtgtgcatgaacttctgcctaattttcctgcaaccctttttgtgcactctcctctgactgcatctaattatatcaactgttttggttgctttcaggatgagaataccggctttgcatatttgggtctccaagaagcttgcccaccattgtaagttttgacattttcttggtaattatgtgcttcagtgaccaagtcttgttgatatagtattcctgtagacattcagataatcaggaatggcacctcagcctgattttctgaagaaaactgatcataatatctgacttaagtccatacacagccatgaagtttagcagtaaaattttcaaaatggaatcactgcctttacttttttttggaactgcaggaaacttatgctttcagtttaaatgttgccgctttataatatttgtcttcatttaaaaaacaatttattgaaagttgtaatgtatgaaaatgtgttctttttactcactattcttccagatattcgattattgggcttagggagcatattaagaaacggccaccgctagctacctctgagaaagttcagcaatttgtgagagtgagtaactcttctcatccacctgtagtcctttattgtaaggaagacagtatcataagagcaccataatgggtacaactattataacttttgtagcatcctttatgtttatatatacattgtagatcatttgtgcatattataccactgtagaacataaaattggtcacatttcactgctggcagatctttgataaactactaatttaaatatttagtacaacctactgtcttcatttcttagtaaaatgtttggcagtttagtagcttacattttcagagtgtttcctcaacataatgtatgcataaaaaactctttgactacaagtcaagaagactggagatatttcttgtaattctacattcattgaatgtaaaaatataactgttctgtatcacctactatttgggaatccttgttaatttgttgtaaatttgagatgaatgcattattattatatgtccttccttgttcaattatgtttctgttgtaaatgtcacaagttctgctcacttaaataaatactactggttgattggcttatttgtcttcaaattttccaccaggcgcgaggaagagaatcaatggttgctggattttatcatgtgggctatgaagatccattgcttatgctcatgaggaggagaactgttcatgctggactagttgtaaaggtattatcttgtgttaatgtgttatatggcgggtttaagctttatgttactgtttagatgtcttgccccatataacccagcctatgggtttatttgtgcacttgttgctaagaccacatatgtagaaattggccgccttgcgctattaacattttgagttccgtttctgacagataggtcattctcctgaacttttgaacaaacagcttctttcccttctctattattctcggaatgcaaatccaataattaaacatggtcatttctcaaatttatggtgcgcgtgtagggtgaggagggtgcgctttctatgacaaccaaagaaagatctgctcatgcatcaaaaggacttccagtgaaccattgctcagggttccggataccaaacagcacagatttctccgagactgatggtaaagatatttcgctttttattgattataaatattcctcttcatagtgatcatatgtgtttgttggtgatgatggggtatgttcagtgttttcaaaaatttaagatttatacatcttggaagttgattcatattttttttaaaaaaaaagaggttttgtgaatgactaatctggattgcttgttttgaaatgcccaataacatggttatgaaataatttcagcctgagcttgtctcaatcatctttcaggcatttctagagagggcttcagtgtcattgtgaatgctcaggaacttggttttgaatccactgagactccacgaactgatagatcagtaagccattttgcccatgcctgcggttgttctaccttagtttcatatttctatatgccgtcaacttccaatagaggctggcagtcatccatacaagtctgttaatgctttgtaaaatgttccaaattacccttgtattaacgtgtatcaccctgacatgttagtaggatattatatttttagcatagttataatgtttacttactgtatctccggactgaatcaggtcctgaaaaacttggagttgggtttggcagcgctgagtggggagaaaggaccagcctatgacagaatagtcctaaatgctgccatggttgaccacctcttaggctgcactggagctgaggatatcaagtccgcacttgacagggcaagagaagccattgacagcggtaaagccctgagcaggctcatgaattacataaaaatctcgcacaaagtgtcctagctcgcaagtgtgctggctgtacaattttggtttctggtgtcgtggtggaatactctcatcgactcatacacgagcacgagtgctttcaagttgctcagctaacatggagaacatccctgacgtgaatagtcacttgcaaggccttgtcaataaattaactgaaagtctgaaaaactgaaaatgttagcgatggggaatacttgattaatcaatctttctttagccatgttctgagagaatctggctgcgtgtaccatatgcaaattctgttcatgagatgtgtgaccgaatacctgcatcaagacacaagggatgagttatcttgattttgttcgtgaaacaaaatctgcaattctcgttgtaatgggttactccgaagtctgaatatgggtgctcgtttggaattacttgtactgtttgtttgaagtttggttgtgcaagagctttcgagaggatgcacctgttgctaccgcattttcagttttgaacccctgctctccttacatctttttttctagaaaaatgtgcatgtacttgaagctaatgtacaagctcccttttcacatgtctttttattttcaaattcaaaatttaagtcgagttttggcctcaaatggatcacccgtgcttccattttcctctctactcccttcatcccataaaaaaccaacctagtactggatgtggcatatcttgtacaactaattgtaacatatccctgtccaaattcgttgtactaggatatgtctattcgttttttggtgacggagggagtaggtaccaattcaccaaggtcagtttctggcctagctaaaagaaaatcgaacaaatttcaaacgttagtgcatgcaaaatgcaagtatatattatgaaaaatgtgaggatttaacttttgttatgttggttttgtagttattataccctactaaggccttgtttagatcccctaacaaaatttttcaccacgtcacatcaaatgtttggatacatatatggagtattaaatataaacgaaaaaataactaatttacacatattgcatgtaaattgcgagacgaatcttttgagcctaattgctctatgatttaacaatgtggtgctacagtacatatttactaatgacggattaattagacttaataaatttgtctcgcagtttacaggcagattttataatttgttttattattagactatgtttaatatttcaaatgtctatccgtatatccgatatgacacggcaaaaaatttcaccctggatctaaacgcagcctaaatatcaattgtacaagaattattgaccaaatctaatttttgaacactccgcaaatcaaaatgcatcctataatatgaaaacgaaatttgaatttatgtgcaaaacactcttgtccgtagcggcatactacgcctgacggtgacggggccatacgccgcgtcgccgtaaatggcgaacaaggttaatggggaaattgcgattggttcgccttcccggctgttcccgctctcatggctgcgccgccgccgccgccttcgccaagctcgggagaggaggggacgagcgcaatgtgaaaccgggggctaccccggggtgaagaacgagtgacggcgggcggccgccagcactgccccgtgccaaaagcgccgttgcggtagcaggtccgtgtgtctcctccacggcatgcccgccacctgctcgacgatagttctccgccgcccgctctcacatttcatgccgctgggtgtgcgcccgcgacggggatggagagcattgtgcgtggaggaccgtggtccgtggatcctgcagaatccgcgatggatgggttttctgtatgcaatgcagatgcagtgccaatccaaagttgcttcctgcgtttgggattgtcatggtgggtgggtggaatgttgagctggcaatgggaaaaattaaggtttatcgcctcacatcaggttaggttctacaatatcttctttttttcctctcttcagcatttttctactactcgtagtagtagaatgctaactgtagaggccaagtactttttctgtagcgaaggtctgtccagcattcattttgcttatccaaatgaaggcgtaggtcagcaacatgagtagttgcttctttctctaaggagtctgaactgtgatttctttgtattcattcacatgtaaaacctcatcctactatgttttagcactagctagattcagagcaaaacaccacataacatcacatggtttcatgaagaagtgtagaatatgttgcatgattaccacaaaacaacacatgcatatcaatgaggaagtaacaaaaacaatatgccatgtacatgttgttcacctcacaccaagttggtgaaacaattacaaagtttatggaaacttgaactacacactgcctgcctatatttacaagcgtccttaagaacacaacctttgaatgaatcgttcatacaaaattacagatggttcactaaacccattgcaatatcctacacctcacataaattccttacaaaaatacatattgtacaagaattacatgctctaaggtgaatcaattttatgattttggtgattcagactttgtgtgcccaggtttacctatgatggctttcttcacttttgctagttgatgcttcacctttgatccaacaccagacaaaatgttatgttttttatgtgataccttctgttctgctcctcgttcttctattttcactgttgcttcatcagtgatattattagtttcctcttcagcctttgttttctcatcacaagtattctcgtctggcttatttgattcatccgcctttggactatgttcttcatctgtgctgaattctggctttgttatctccacaaatttttcgtcggcctcagaagttgctttgggtgaaaccacattgagaccacgttcctgaacctgtgaatcaaaaagttctttctcttcattagattttatcttcactgcttgagtgttaccttcaactgtttcatgtacattctcttctttgatcacaggctctgttattgccataaattcctggtttccttcagtttcttttggtaacttctgtgcagcagtttcctgctcctcctgccgattagaatcttcaagcttgtctaacacggtgttatggtccaccacagtttggttatcagctgtttcatctttcttatcttggttaacatgcaaatttggactatctgagtgtgtctcaagggctttttcaaagttgctgacttcattgtttgagatcatactctctttcttgtccatgcatgtcgaacttgcaggaatttccttttcataagcaaaatttcgatcagtgtggctaactggttcagttatttcaggtgcctgctcatcagatatttcttcagaacatgtttctttcgacttatcatcatgtaaattttctatctgttcttcagtatgtccacctgcggtcgtatgctggtcctcctcattcgtttctattacttcactctccacttgaccctcagtagtacttctcacttcaacataggaagattcaatggactcttcttgttctgtgcaaggagggctttgaacactgtcagcctcgttaggcaatttttcagcgttgcctgtatcgggttctatcaaggagagtgtttgctcatcctttgcaccatgtctattttcatgtaaagactcatgcggaagttctgttcctacttcctccaaagcatcctcttgtgaagcctttgggcttgttatgtcatcttggtccctattcaagcttccgtcttcaatttctgttgctgcttccacgttttcctgacaaactgtatcaaatgactcttcatccaattcaaagtctctagcttccatttttttgatcggatcagctgccttggctgatatcagtttgctagaaatttcatcctgggcattatcttggtatactggtgcttccaaatcacaagtgttccttttgagctcttcatcagtttccaatgatttttggacgtccatctcgacatcataactctgttcttttactggttcttttgtttcttcagagccttctaccttttctttttcttgttcaaaggtgagtttttcatccaccgatttttctataggaaatgccaccaaattttcttcttgttgagaagcgatcaaacaacttccatccttcgttgtttcttcttgctccttttcaacctcggtttctgaatctttctttggatcatcattgtcttttcccaatattaggttcatcaggaaactagagacaggcaaataatcttgttcagcttctttgtgatcttcttcatgtgcatcaccaagttctgcatcatgcctgtcttcttcatcttgttctttggttacttgattctcttcttgctcctctggttcagcaggcagtgccttctctggtgacatggactctttttctgtatcttccaaaccaaatccctgctcagttgtgttttcatcctgtgtaggatgcacaggaagaccaagcttgtgatcttccgtctccttgttaatattttctccctctgattctgtaactacagatgaaacatca

SEQ ID NO: 61103 - DNA, 2409 bp, Oryza sativa
acccaagcacacgctcaatgcgcgtcttttgctgttaaaagaaagatcatattaacatagattacataaaaggaaaaacatttatataaatggttatgctaatttaataaggttacgcaaacctaatttgagcatatatcttcaattggcaacagtcactagtctctacttactcttaggtgagtagatgatgaaattagacatgcccaagcttcccaaaaacattcctctaaactttgttggttcttcctgaaaaataaaccaagatatttcatcatacttttatgcttgtccaattattacagagaggtttttttaaaacaagcatacaaataaaaggagcaatgctagagaacggagaagattaaattagaaaaatgcaaactctttaaataaaaataacagacctgaacttatgaaacaagaatcccccaacaacaactagtgaaaagcacgtaatcatcaaagtaatgatagacctgccaagataagtcagtataaattatgaaattgatttaccatgagctaaaaatatattatgtgtaaattaggaatagacaaacttttcaggatgtgcaaaaagtgaaagtccagtaatgcagtaatctgccaaaagaagcatgaaaaataccaaacatatatgtctaactgctcaacttacaaggcaatgttccgttcaagctgtgaattgaataggtagtacaagcgtgaaatgctccatcggatatcaggcaattgtggaaaactaacatctagcttcagaggaacaggttttttcataggatctgatatgcatgccaatggtaaacttgtaatgttgtgtgacatccaagggagaaattttgtcatcaactgcatctggccaataacaattttgtgtagaacacagaatgtgatgcttacaacagtaaccacgttgaagtttccctgaaaaattatgattatgaaacattaagcaagacaaaggtgtttttgtatatcatccgttgtgaactgcagctgaagggaatactgaatacatatggaatatatttcaattgaaatcgttgcttcaaaaggcacaaatcaactgcattatttctaattatcgattattctcataacgaggagttagatgaacacgtcatttagcagtctctaatccatattccaacaaaggaagcatggaccaatctaaacctggttggtccagaaagcagtagctcacaactgttattcgtcaatcataagggcgggatttggttattggggtctgattatgcatttatgtgtataataaaatcattcttgtggcactgccagtgcagaaccacttaattagatgctctgtcaaacaacccgacttcaccaccattgacctataaagcatgtattctaaaaaacacatgccaccttaatctaccaatcaaatttttgcattgccatcataaaattcacatgctggccctggtgtctatcatcatcacatcacaattcaaaaagaaaaagaaaatgaatgatgtaccggaaaaaaaaaatcacctcagcaggaaagcttgggttatttccggatgtggaagtggttggttgttctagattaccattagtcaccttctcattcatccccattgctgagtcgaacactcttactagtcctggccaacgcaagcatagaaataaaggcatgcgtaaaaattaaattgataaaatcagaacatggttcggtcaccaatttcgtttaaataaagagagaaaacgttagaaatccaaatagcagacaggaaacgcgtgctgcatttgccgcccacgaacctcgcttgcttgggagatggcccgcggagcggactccgactccgattccaccaccgcgataaacgcgaacctgcccggggaacgcatgaaacctaggaggaaaaagaaaaaaaatcagagacgcggattcagatcagcagaagatcaaaaaaacccttgtacacatgtagtaacagtgtgtacctgagggccagtggcagcgcggggcggaggcaccgccgggcggcgggcgcccgcggcggcgacgagacggcggcggcgtcgagctgcgatctcatccctccctcctccacctctctcgctgctccaccggcggcgaggtgctcgcgcggcgcgggcggaaggaccgaagcagttgagcgagagtggcaagcgaagcgaaggcgttttgacttgacgaaaaaagcagtggagtctcgaagcagtgtgggggagggatgagggggccagcgctgaacacacaaatattttttgtgtgtgatcagtggatcaagcggattgggttctcttttttttttctgtgcaaatattttttttcgtcttcagagttcatactgtacagaaattcagcgaaaatgaaaatgaaaaggataagaaggacgacggggctgcaggaat

SEQ ID NO: 61104 - DNA, 22388 bp, Oryza sativa
cccttcgattactgcggtaaccttgtgcgataatcattttagttttaaaatctttacagttttcttggtaatgtaattgtttttgcggttactgcaataagcctaagtagaagtaatcctaccaaaacagtaaggaaaaccctcgcagtacgtctataatttctttgtagaattcactgttcatttcaatgtatttacccgttgtgttgaagacaagactcagctgacattatttaaaatggttgtatgtgaacaagacagccttcaagggatttggtgagtgtgaagaacactgatcactacagctaactgttagttggaatttcctgtaaactaccaagaccaaggttaaaggtcattttctttacctcaacttgtgcatgactaatgacaaaagatataaataaataaataaataatcagtgggaataattgctctgctcggtgcacgtactattcgagataaagaagacgatttggtccaacaaatccatctgttaattactccttttgggaaagctagtagtgtgcttccctttgcttttataattaatttatagtatcattgatctcaagatactgcaatttgtcagatataattgttctcaccttgattttcacctcagtagtatcaccacgaacacaagtggctctatttttaaactcgccacacacgagaaacactgccattgcaacttttataaagactctgcaacttggaaaacaaaaaacacaggggattataatttttcctctgacttgactgaactagtatacgtgcaacacgagttcaactctttttttttcctgtcagacaacagcaaggctgattatttttctttatttctgttaaaactctagaaccctaattcggtcggttaattttctgttccatgcagttgcgttgccgcgccgttttaaaatcttgaattcagaattagtccagaattttttccagggagaggattgaaaaaatggcgtcgactgatcatcaaggccaaaacgagttgccactgattggccagtcgtcgtcttgtcgagcactgatgatcaatccacaaataattgccctctcgctccatgctcgtcaacactcaacgcattgtgagatgagacccgtgaagaagtgtactccctccttttcgaaatgtttgacgccgttgactttttagcacgtgtttgaccgttcgtcttattcaaaaaatttaagtaattattaattctttttctatcatttgattcattgttaaatatatttttatgtaggcatataattttacatatttcacaaaagtttttgaataagacgaacggtcaaacatgtgctaaaaaatcaactgtgtcaaacatttcgaaacggagggagtaatatataaccttttggtatctttcgactgtgattgagtatgatattgaaatttaatatttctccaaacacaatctcccctaaatctcatattgtttttatatatagaaattttcaacaaaaaacttgagcttgttttacatggatatttcaccgattcgcatatatgaagtttcaaagaaacttgagttgacttaaagcacatttcagggaggcagttttaagaccttaaatggatattgtcctgttgctcctaaagtgccatgtaaatacttgaatacgttgatacaaaatgaacctattattcccacacacacaaaaaagtgcacctatcatctgaaaaattctactccaaatttgttttaccacccaccatcaccaaaaaaaaaaaaaaccgtttcaccaactgaggaattatacataaccgattttgtttgtctatgttaatatgtatagtttcaagccttatgttagcctcccttgcttaattctacacttaagctgtgttcgttttaggaggatgggaactaatacctcccgcacggaaaatagagcgttccagtagcgcttgattaattaagtattaactatttttttaaaaaaaagaatcaatatgattttttaagcaactttcgtatagaaactttttacaaaatacgcaccgtttagcagtttaaaagcgtgtgtgcagaaaatgtgagtgggggagttgggaacgactactggaaactaacgcagccttaacaccatcccaataacctagacctctacttgatctcctatatattttacttgaatgaataaatcgctagctacactaaatggatcgatctgatagatcctacaccgacagattgattgagccctattagccatgtgtaagcaagcaaccctttgaaaatcatatatcaaggacttgcaaactgtagctaggctgttggggaaaggaacatcgatatccgacaacgatatgagatgaaagcgatgctaattgtaatttccatgaggttggaagagagcaggaagtttcagcttgacaggcaccccccccccctacatccctccaaaaaggctgttaatttaggcctcaatcacgttcatgcacttcataacttattatttcaccaaagtgttgtacttaaggttaaggacacaatttattgactaatctctctgtattatgtgttggtgttactttcctttaaagtacaatatgggatgtgtgcacacacatgcgctacactcacaccacataaatttggtgaacatgcacctagtggtaattcttaaatttgaagctacactatttagccatctggcaacaaaggcacctacacgtgatttggtgtttgattctttactattaacaactgttacatacatttgtcaataatcacacatgcataatcaaaaagttctactacctctatctcagaataattacatttatatcatttaacatttgtcccaaaaaattgtatttctgcgaacttgggatccaaccttctttttaatcaagtttaagaatggtaattatgtgggtttatggtcttaaccttctgtctgtttcacattataagtcgttttgaattctttttctaatcaaacttctttagatttgattgagtttgtaaaagaatttagcaacatctcaaaaaactcaaacctaaagaaatttaactaagaaaaagaaagtcaaaatgatttataatatgaaacaaagttatttagacttttccactctaaagtaaaaagaataggcacgcaaaaaaaattacttcatcctaacctagattcagaggcgcctactgtaaattaaaatgtccggcacatagaaaattactttgtatcctcacctaaattcaaaggcaactatttggatccgaaagtctgacagaaagtatacggcaatgtttagatacacaaaactttctagtcacttttacgatgaacacgatcaggtaagttccatcctacctaaccttttgtactctacaagtaccagtctcaaagtacattcatcctacccatgacaaccaatccaacacttacatttgttggcacttggcagcaaaacccgacctgaaaaattaaattaaagccaacccaaagctgctgctactactaaaccactatcaagaaattcaagacggatcatggattcccccccagccaggtgtaaccgggtcgggtcaaacccaaaaccaaaacccgacccgacccggatccgacacgtctcgcgctcaccgcctcgtgctgcatgtaccgacccgatcgatcgcgcacatggggggcgcgggccccacccgcaattaaggaaaagggcgaaaaatcgctataaaataaatccggagaatatttaaaagaggagggggaggggagcagtcgcggtggggcccaccaccccctcgctccgcacacgaaccacgtgcggaatccgcgcatttagtactcgcatcgtcccccccagcccgcgaaatgataccgaattgaataaaataatatttaaaagaagaaatctgttactccgttccaaaatacagttacttgtaataacaaaatattcttctatagtaaacctatttatccatcaatatccttctaacccatcacaaagttcacaaccctcgtccatttatttcattcatcttattttttatctcaacaaatcataatatttctccaataaattttacttactttcttaatacctactactatgtctaaaaaaagataaactttagctacgaatctagacacgcatatattcgtagcttacatacgtgtctaaattcgtagctagaattgaattttttttaagacgctagggtaccatctatctattttataattatttactccatctgtctcagaatataacaaccaatgattgatggtgttcatcatctatctattttataattatttactccatctgtctcagaatataacaaccaatgattgatggtgttcatcattggttgctatattatgagacagggggagtatatttctagaacagatgtaactcccttcgttctaaaacgtagtactcttattatgatataataacaaagttggatagagatgaatccagtggtaataattgagataaggtaaaaggtaatttataagtagtattttggaacgaagagagcaactattttctccattccaaattaaattatgggataaacatatcgtaataatactataaatttagacatatttgtattactacaatatgtcacattgtgttagattaacttattccagtacggagtactccctccgtcccaaaaaaaaaagacaccctggcttccatgcccaacgtttgaccgtccgtcttatttaaaaaaattatgaaaaaaattaaaaagacaagtcacacataaaatattaataatatttttttatttaaaagaattataaaaaaatttcatacaagacggacagttaaagttggacacgaaaatatatagggtttgttttttttggagggaggaagtaggtaattaggagaagaaaaaaatgggaagaaagaaaatccgcgaggttaaattgaatcgaattgagtggtgaccagaaaccgcagcggctgcgtcgtctccgtctcctctccttgcttataaacgctcgcgcacgagcctctctctctctagctctcgctctcgcagctcaaccactagcagcagcggcaggaaggcgagaggaggaatcggaggtagctggacggcggcgaggcgacgacgagccggggtggtgcagcaagaacggcgcggcgagcggcggggaggagagattggatcgacgccgggtagttaggaagggagcttggagagatggcggcttccgcgaggcccgtcggcgtcggcggggagagggcgacgagcttcgccatggcgtgcagcctgctcagccgctacgtccgccagaacggcgccgccgccgccgagctcggcctcggcatcagaggtgaggaggagaagggaaaaaaaaaagaactcatccctttttttgtgggtgtgcttcggcttggttggatcttcatcttcagcttcggtttcgtgttgagatctgatcacaaggtttggggttttggttcggttccaggtgagggtgaggctccgagggcggcgccggcgacgatgagcttgctgcccggggaggcggagaggaagaaggagaccatggagctcttcccgcagagcgccggctttggccagcaggatgccatcaccgccgattctgctgctgatgctaggtatggggccatgccacttggttctctgcttcatttttgtgcagttcctgctccttaggtgtatgtgtgtgtgtgtcctagttcttggaatcacgcagagaaatgacaaattttgcagtctacaaaacttagctgtaagtgcctcaataggttgaagccactgtttttggtatcaaatctagttgaggggagagagggttatgagtaaacattttgttgttttttgctttgggttcagatactaattggaattaggcaagcagagttactaggtcattcagacttcagggagttgttaatggatctataaaaactttacctatctttgttaatagaaaattttaaccccaaacttagggttttttttttgtttaaactggggcactgaaaacgtagtttcaaaaagaaccctttttatgcttgccggtgaaaatagagttagtcagatggtgcagaattggaggggtgatatactggtatcccaggtgttcatagtgttctctgtgcaaatgaatttcagggaacaagagcctgagaagcgtcagctgaccatcttctatggtgggaaggtgctcgtgttcaacgacttcccagccgacaaggcaaagggcttgatgcagctggctagcaagggcagcccggtggctcctcagaatgccgcggcacctgcaccagcagctgttacagacaacaccaaggcccctatggccgtgccggccccggtcagtagcttgcctacagctcaggccgatgctcagaagcctgctcgcgcgaatgcttctggtaattactctgccctttcttgatgttcatgtctgtcggggtattgaacgcataaccagttgaattttgttgtagcagttatcaagtgacctctttttttctgtgtagatatgcctattgctaggaaggcatcactccacaggttccttgagaagagaaaggatcggtaagttgttttgctgtgatgatttgcatgatgtttaagttcagtattttgatcactgcagttcatggatctaatatgcgccttttgttgtcacagtcttaatgcaaagacgccataccaggcttctccttcagatgcaaccccagtcaagaaggagcctgagagccagccatggctcggactagggccgaacgccgtcgtgaagcccatagaacgcggccaatgaggttgcatggaaacttcaccaaagctcttcaaaaatatatgaaatgcgcttgccgttagagtaccaaatcatatatgttctctcataccccatgttttagtgttttttctttagttcgtgcttctatgttgttcacttgtcacatagttctgaatgtaaaggaaaaaggtagtagcattgacgaccagtgccgagagcctgagagaagttttggcatgttaacacatggtgactctgaaaatggccatgctaaggtaaaaagttattgcaaaggaaacatatatgtatcttctgaaattctgatcatctggctttgtccttggctctagccttgctctatgcaaagcaaagtgattgtaatggattcagaatataattcatattcctattgttgatttctgttacatggcttattggcttggtcctcctccaatatgtctgcattatttggtccccattatatgtgcctgcagagtcaatttgctcttggactttcttttttccttttcttgacgcgttttcattttttcttaaatgcaaacctcattatttagcataaaataataactacatacacaaactacaaactaatggaatatttgatgttccacaaacacaattattagtgattgcctatgaatcttttctgttttgtagctatatattttatcatcatgcaaaggggatacagggcagcacaggaggcagcctggggtaggttggatggcactgtcaagctgaagataagggttttgcgaaggaaggtgcacaaggcaagacttgtcaccccatgcccaattctttaatcaaaagatatgagcacatgtgagaaattgggggtggagatgagttgataggattcttgtttgacagctaaagcaaagcaaagcatgaagagcaaaacaacaggaagctgtttggaaattgcaaagggggggggggggggggggaagaaggatgcattgaccgggattctctgcagtactgtcgatatgataatagcaactgacatgtgggatcggatccacctgtcagtgattgctactgaaccaattgtactgcggaggatccatgtccagtatgcatacatgatacggagtacatacatacaaaagacatttttcagagagagatgtttgttggacgcatgggagcccacagtgagccaagttgcctgcttttttctcctttctcaacttgtttgtattatactcctaacaaaaggacttgatgaactagtgctcacattcctgcaacttgctgtctaccaattgtcaaatcttttgattagttttttctcttacagaagattttgcatgccattctcgatcattcctttgtgacacaattttgtcagagagcttgtgtaactctctctctttactcttcactgaatcaatttcaaattcaggaatccagccaatctggtcagactacttctgttccacgaaccgataaaattaacacatcttggcagctttacaataccttttttttttcttgcaggcttctgccttgtaatttactcattgatttgcccggttgatgcatgcacgtactaccaatcgtcctttgtgtgtttgaagaattatcaaaagagaaagataacaacaaaaaggcacaccatgtgctcaagctgttcatggttacaactaacaaaatccgtgtgccgtcctctgtggtccaggagacatgctgcccttgtttccaggatgcaattgcttgtttaatccgaggcactaatgatgggtttattgggtccagtaatccattatccatccaggtcaaaattcagagcgttcttcagaccacacggccacatggggggcatgaagtggactgcaaatggcagcatggaccatttgaatcgagctagctgttcatcatctgatggatgaaccaacgacctaccgatgattcagtagctaccaaacagtgggaaaaacgaattggctgtgtgacttgcaacagaaagaatccttgcaagaaagagactgcctcaaccttgtctaagttcttggttgtgttctttaatttcttctcacgcaactgtagtgatggatttagagttcatacccgcacgcaagaatgaagaaaaagaaagagagggatcttgacaatcgtggaaaaccgaccgagaaccgctcatttttcgtgaaaccattggttatctgtcgtaaaatccgagcggttttagctggttttttacgaagttgactgaaagtggtgattttatcggtttccggtaaaccaacaggtatcggtttttacttcgaaaacgataacgtaaaccctggtgctactttggaacaccatgtgtgtaattggttttgggggaaaaacttgaaaagactgaaagacattgattcattctgaagccattttaattattttcaatctgaaaaaacagggggagcatggtagctatccggaggcagggggaggaatctgtccattgcttgctgctcctttttatttcagtaactttagcccaggtccatttcatcacatgctgattctttagaactttagtaatataataatatgcatagtatgatgatgaattgatacagtatgcttctactattctgactctcctgtttgtgtctgcaaagcaatttctgaatgcacgctgtttatttaagcagtgcacgcttccgtagactggactaaataggccgagtttagatctaaagtttttcttcaaacttctaacttttccatcacatcaaaattttcctacacacataaacttccaacttttccgtcacattgttccaatttcaaccaaacttttaattttggcgtgaaactaaacacacccataacactgcactctgctgttgtgtatcagcagtggttgtacagtgtacagttactctgaatgactgaatcattcacgtactatactgcttatccacgggcttgctgttattgtactgcctcccatcttttaatttcttggacattgttgaaaatactatatttttctttattaattggcccgattaatggaatgtggcagtgtgtggttgtggagacgaggaatactttggatatttcatcactaaagcacccttggtacttgataaatagctatatttcgatacaaaatttgaacacgcattgaaaatgagagattatatatttaataaaattatttaaaatataactatatgaaactttttcataacaaatacactaacacaaattttaagtttaaaatcctaatagtttaacattattaataattcaatattttaaggtttgactacacatattcttcatgtatatcatccatttttagaacgaattaggtgtagtaagaatataatgtactatatgacggcccatactttattgcaaaatatatatggatggatatatattaaatgttatataaatgatggatggatctgtgttaaagtattatgtaaatgatttgagaaattatgatttagcgtgcttatatgttgagttatgtctgtatgttgactcgtaagtgtttagtgggttgatgtgacatgtttgtaggttaggttttagaatatactaatgattgctatgtttgtatgtgttttttcgaaatttagtggttaaaactatatagaaataaatagaagatacggggtataatctcgtatatgtacatcttgacgtgcagagggggagataggggggcccaggttacaacccatcgcagaggcatcggttgcttacttgggctttttctgtgtggatgcatatgtgggctttgagcccaagaatggttggggcattggcgatgcatgaagatgccactgtttatgctggactaatcgcccgtacagcactacagtgtgctgcgattgttccattatttcaaaaactttatgttcagtagtacgcgacagtgagatatttcgatcaagtttttcgaggatgtttataaaggtagaggtaagtgtgtgcgtgttatgagtgttacaactatattatgttattttttaaaaaaatcgttgtcatgttccattgctccagatgatagttttttagctttcaattttttcaaagctatcagtggttgtaattctccgtaacacgatgcgctcttatccgaaccaccccgatgccgaaagctaacaatggagttcttctacattgcagctcgccaggggttgttagttggcgcgcgccagctgttcccggcccatcagcccatcagccctctttttctttttttcgtgattttttttttcgtttttcttttacgatttttttcgctttttttctgattacttttttttaatctttagcacacttatttttttaaaaaaagttttgagttgaaagttttcaaatctcgattttaaagtttttaaatctgagatgaaagttttcaaatctcgagttgaaagttttcaaatctaagatgaaagttttcaaatctaagttgaaattttttcaaatttgagatgaaaattaaaagttttcaaatctgagttgaaagtttttaaaatttaacttcaaagtttaaatctcaagttaaaaattttcaaatgtaacttaaaaattttcaatctattagtaaaaaaaatctcaaaaaaaaatatttccttaattactactattattatccttaacatagttagttacgttacttaaaaaatgccacgagaaaaaagatcgatcagcatcgatggccgcgtgggccgtgggcctgaagtgctagcccgtagcgcgtatgcacgaattaggaatctcgagctcgccagccataggagcactttattgttcagaaccgagaataaaactgattttaaacgtaggggtgtatttaaaaaaaagactcaaagctgcgagcttgctttttctaggttaggttcgagctcagcttaagctctaaatgagccaagcccaaacccaaactcacgaattttatctagccgatctcaagcttctaaccatcttgaccatgtataataacttttatggtttatataccttgttaatttgataaacttataggcactagtggagaaaccatctttgatcggtccacccaaatccacaatagtcccggttctattaaaaaccgggactaaaaagcatttttagccccggttgataactgtaaggggactatatcatcttttatcccggttcgtgttattaaccgggactaaaaatcatctttagtcccgattggtaacaccaaccggtcccggttcatgtcgtgtcagaggctgccagtccctagagatctttagtcccggttggtattaccaaccgggactaaaatcctaactttactctcggttgttgtttctaaccgggactaaaaatcaaatataccatatataatcccttgctgctatcctcaaaaatttctatctcctatttctcctcttctctctcacacttatccttatcctcttctcagtctctttctattcctctctcaacacttagccggcgaggagctcgcccccggagcgcggcgacagggacccgagcgcagtcggcggcccatgccgggaggcggtggcggccgtccatggcaggcggcggcggcggccgcgcacggcatgaggaggcggcggccgcccgcggcaggaggcaacagcggcggcggccgccctcggcgaccggatttttttttaataacttgtgattcattggatctagatctggatctgggttatttgatctgtgatgtatttgtgattgtgattgtgatgtaattttttttaagaatttgtgatgttttttttctgacaatttgtgatgtgaatattatgatttgtgatgttgctatttgatctggggatgtagggagtatctcgatttcgatttggactttgtgattgattttatgattttggagagagtggtgtgaaatcaatattcaaaagaacatgaaaaaaaactgggactaaccctttagtcccagttggtaacaagatcgatctctaccaatgagataaatatatgtttacctacacaataatttagcatgtgtcaatggtaatattttttctacctttttttaagtgtggttcactagagaaatgttatccttaccaaagaattatcattgaaatatatcgctaagcttgatcgagctcgaaacaaacttacctaaaatatgaaataggctcggctcgagcttatgttgagatctgattgttcacaactctttagaagcaagaaccaccaccccgcaattccagcaccgaaccacctccttttaaatatccacaaggtgccaaatacacattgtcttatcattactttctctgctcgtaattttatgtttacaaagcttaatgaaaatataaccgtaaaaaatatttttcatgataaatccacgtattaaattcaaataatattttaagtctattactgattcaatagtttcagatttgaatgtacctattattttctattttctacgataggatacgttaaggaaatagataataataaagagatactacacaaagaaagtacatgtggcgtttgatggtgtactcattggtgtatgactcaacccatcagaatttaaaccctatttaaaaataaacattactatttagtgtcatttcaatatgattttattgagaatagagtatgtgttataaggtgtgttcggttatatctaagtgaagtgcgtatgtgcttccaatggaaaaaaagaagagaacttgaaaaataaaaacaatatatccatctctcactccgcaagcgcggaatgcaacaaaattggttgggggtttgatgttaaggcagtcccaaacctccacctaggatggtgtctatagtattaaatacattgtcatgtaggacttttagcttatgtagcactatatattaattaagagagagagagtgaagagagtaagaaattgggtctcatgcaagacacaccttcaacacaaaaaacctatgcgctagatactatcaagttttgcattgggagagaatagtgtcttcataatagatgaagaataaatattattggtagagaagagagatgatgtatttattaatagcccactttaagaaaccatgggttgtagagtatagtttctattgtgatatcaccatagacactgcttatggacactatgggttgggactgcccttagaaaccgtcgcacccaacacgtaaaatggagcagtaaaatagcatataattaattaattaattaaacacttaaaaaaagactaacatgattttaaatcaattacctatataaatttttaataaaaaaaaataaaattactaaaacaagtataataccatttataagcaggggcaattgctcatttcaccatgttatgaagcctatactaatttgattatatttttttcaagtttgctcatttgaccttgttttttaaaattgaagatcaagactgattttatttcatgatgataagataatagtgttaactaaggggcaaattatcctttttgtccttactcagttgaccatgcttctttttttatccgaatccttgacatacttgtaataaaatctagcatagattcgatagttttgatacaagtttcatagttttggcttgaaatcgacaaaatcgataaaatcaaattagcaaaatttgatacatttatggctgaactttcaaaaggattttcgtagcatatttgtctttttcctctcctctctcctactccatccgtcccattttaagtgcatccattttctgtactcaattttgatcgtccgttttatttgaaagtttttctaaaagaaattaaaaatataagtcacgcataaagtattattcatgttttatcatctcataacaacaaaagtactagttataaaattttttttaaataaaacgaacgattaaaattaggcaaaaatgcacttaaaattggcggagggagacatggagtacttgctctataagggtggaaaataaaagaaatgcagccaaaatctctcaccaactttactagtactactctatcaacccttcttcccagtcagtccactccactccccaaaccttctcgacccttcttctcccctcccctccccccaccgtcgcgcgcggcgtcgccttcctcctccgcctccgccgcgctacaaccctaggccctcccggcgacggtggggagcgcccgcgcgatgctgccgcagcagcagcagcagcagaagcagcaggcggcggcgctgatgccgccgtccatgtacgcgatgccgccaccgccgccgctccaccaccaccaccacccgctcctcgccgccgcgccgccccagcagcaggtccgtgccgtgcccctcacacagttagctgcccgcgaaagaggctgcgggtttcgcgggagtttggtcgggtaaagcgggggagctttgctagtctcgctgattgatcgcttcgtttcctgtgccttggctctgctagcgtcgaatggtttccaactgttgggttcctagatttcgattgattgacgggtgttgtgtggggtgaaaaagtgaaagcattggtggtctctgactctgatttacgggtgttgtggaaaatgacggatcttttgagtgataccgaggtgatttgcacgaaattgaggggctttctagttgtgtttcatgcatgcttgctgcttgtggggagggtagtgcaatttggaattcaaagacaccttttttctttctcttgtttggagaatacaagtctgagaatttgagtgatccgaatttatgcagtgttctgatacttgatcagttaattttgtttgagattggtcttcaggtgatctggaagttttgtgcttctgattgtaacgagtaattaatcgataaaatcttgaaggacttagggagttttgtgtttctctttgtttgattttgcaaaggtatagcctttgggacttttgggtgatttaggtccgtttggtttgaatccttgcagggttggggattgtttgggcttaggtgcccacttttttggtgcttcttgttgtcttggttaggaatattttgattccttttggttggttaagttagttcaaccttatctagttgggaatggagatcacattactcttgttgctgtgttgcacggatcacatcattgtgatgtactgatgtctaagtaaaacatgcatcattgatgaggtctgatttccttttactcaggttaggatttgtagggcttggattttagctctcatttgtaaggttcctattttattactagctgaaatttttctatatttgacatatacgtctattctgtaccctgattgatcgggagcgccgtttttacccccttttgctggcaaataaagcatgcagctttctcccttcctctgttacatttatctcattggaactttgctgtagtatctgcaggatgccttgtgtagtttgcatgtaccaggcttctttttgctaaggcgtttcctattatttgtagatttttatttcttctttctttgtttttttacatttttatttttgcagatagagccaatccttactggaaatctgcctcctggctttgatacgagtacatgccgcagtgtgtgagtcccattagggattctttttattttttttattttcttttcttcgtatgcttgaaaatgcataagttcatgctttggactttagggcatcttttcctgtacacatgtaatgtaatttaatacatctagcaagaatcttccattagctgtgtacacaagcacatattttgttggtgaagcttttgcaagtctatctgctagccactgttttcttaattgcatgttggccatgtatacattaaaactttgacacaatggtattttggtaacatgaaattttacatactatatttatttcatagctgaaagtaaggtgaaaatttgtgccttgaatacatttacaagatctatatgcattaatccttactaaaaattgaaacatgtctaatgttttctgttcacaaaataacacggcaaatttattaatctttgtatttcttatgtaagagcatattttgcatggaagcatggtctaatgttttctgatatgctctattttcataattttagatatgttggcaatgttcatgttcaagtcacagaggcacttctccgagaggtttttcagagtactggtttagttgaaggatgcaagcttatacgaaaagagaaggtttgctttcattacctgatttttctgtttatttcagttatatttttgaaagcgtatcctttgtggggtgattcagtctgacacaactattgtcatgaggatctcatgatttacttttaaacatatgtttctgcagtcatcttatggctttgttgactactatgaccgcagatcagctgcattatcaattttgacacttaatggaaagcaaatgtaagagaaaagctattcatttctgctagtttgttgaagcttaattatgtttttttttctccccaaaaacactcattgaagaaaaatgatacagttttgggcagcttatcagagttaattgggcatatgctagtgggcagagggaggacacaacaggttgatactatgtttgctttttataccagtattctcagaattttttgatataacttttggcaagacatggtaaattttatcacttttgcagaccatttcaatatttttgttggtgatcttagcccagaggttactgattccgcattatttgcattcttctctggatattccagttgctcgtaagtatttattacctttatccactagtgttttctgccattggcccaatttggcttttcctaccccagctttataatattttgtgcgttgtcagctgtcctcttttaattcttctgttgtcacgatttcataataatcatcagttgtgtcagtagtacctctaccgccactaggatacatcctagttcacttttcataccattttctttatcttactaattaaattaaggtttatctggatcttaaattgcactactttctggtatctagtgatgcccgagttatgtgggatcaaaagactggaagatctagaggttatggctttgtttccttcaggaatcaacaggtatggtaattctaaaagcacgtgcatttgtatgggttctttgtttactcctgtcacttaaaaaaaagttttttggtgagcttacaggatgcacaaagtgccataaatgacctaaatggtatgtcatgcacaaactccaaatatttctcatttaagaatgtacaatgtttttgggttgtgtggttttggatttggttggcttggtgccttattcatctgatcttattcataggacaatggcttggaagtcggcagatacgctgcaactgggcaacaaagggtgccagcaatggcgagcagcagacttcagattcaaaaaacgtagctgatctgactaacaatttgacaggtaatctttatggatatgtaacatatttgtgttagtcatattttaatattttaaattccttccatttgctagtatgtactttcagaagacagaataaattaaagcatagtgttttagctgtgcattgcaaatgtgagaggtttggtaattaaatataaaaatatagaataatatatagagagccttcaaacatattgcttcctgcaaatggtagaggtttggtaattaaaaaccacttcctctttgagttcttctaacaaataactcaggcagtaacattacaaaacattgcctggtttaaccagaatatttttgtaacgaatgatggtgttgatctgttctactcctattttcattatgattttgctgtgtgcgtcttctttcgttgttgtgctgcgcacttgcatgatactcttagccctgctgttggaacgaagggctgcagttcattgttcttaatacgatgggcttcagtatgaatatatgatgagttgtgctgttcttttttaatcttgttcagaagacgggaaggagaaagcaaatgaagatgccccagagaacaatccacagtacagaactgtttatgttggaaaccttgctcacgaggtaattctatttcagcgttactaaatgtatggcatattgaatccttcgaacactagacgctgtgaatgttgttccggttgtcttactgataaattgacgtctttgaatttcaggttactcaagatgtgctccatcgtcttttccacgcacttggagctggggccattgaggaggtccggatccagcttggcaaaggatttggcttcgtcagatacagcaaccacgcagaagccgccctcgcaatccagatgggaaacggtcgcattctaggtggtaaaccaatcaaggtgactcacatttcccgcttcaccgttttcgcgcatgccgttatcattcctcttaactccattgaaccctaagattcacctttgacacctggttacacttgtctctccagtgttcctggggcaacaagccgacgccacccggcaccacgtcggcgcctctgccccctcccgccgctcccagcgtgacggcggccgatctcctcgagtaccagcgcagcctcgccttgagcaagatggtgtcaagccaggcgctgatgcaggctcaggcacagcagcatctgaagcaggcaatggggatgggtgcaggcgtgagccaggccatgtatgatgccagcttccccaacgttggcccctcgcagcagcagctcatgtactactgaataaaattcctgcgagctcgtcgctgtaatttgtgactcgatcagtctgatctctttttttttctggttttgttttagctaatgttactttttttacgtctatatttagagtgtttctggagctattttcgatgttgtttcgtacatggatggatggagaatgtgtaatggtatatgtgtgtgaaggatgtaagctgacaattttatataatcttagtctaatgttattgctgccagcctgccatcagtggtttgtttattgtatttttgcattagaaatgtgtttaaaaatagcaatgttgttccaggttccaaagagtgtgctctgtacaagtatcgctgctcgtgggctcgtcggacgggccttgctaccggcccgctaaagttgggcccgaacgagatagcagaaagcgtacggcccaatgaagttaggccggaacgggattcgtcgaagatgcggcccatacgagttgggtcggaaggggatttctgcttacgcgcggcccactattatttgggccggaacagatcccagcgaacgcgtggcccgttagaagcgttcaaatatttatctgaaaacgagttcgtctcgatacgaactgaattcgtagcttttgctacgaggcaacgatacacagattaaccaaaccactgcgcgcgtctttaatttgttttggacttcatagcttcgcctaatttttcttttcatttccttttgctggtgaaacctgaaaacggctgcatgctgtaatgagacaaccttgcagcctgcagtaacgtacattcggctagcagtcgtgtttcactgcttaatcacatatataatgtgtaagaagaatccatcaccctacatatgtatatgcattgtggatcgatccaaagataaggattgcatctatcactacctatagcatcatgcaagtatatcgttcttacaaattaacggacagatcagaaaagatacaaatggaaaaaaaataaaagtatttttgtctcttaagaaaaagttcctttgtttttatgcatgtcactttaaaaaatcacaaaaaaaagagcaacacaaaatactcagatatatatcgactagccatgcatggtggccttgatttgatcccctttattcatcctcattacagtacactaagtatattactattgtattatattatggtggagatcgattattattacagccaagctccgattatcatccgccatgcaatgcacgcatgatgcatcatatccatcacattcttcacaggtcgtcggcgcagatgaagaagatgctcccctccctgcactcctccccgcccttcctcgccgccgccgcctccttcttcttctccggcgacgcggcggcggcggcggcggcgcggcgcttctcctccctcgcctcgcgcagcgcctcctccaccacgtacctcgacctgcactcctccttgcagaacgccttctctccactgcatatgcattccaacaaaacacacacacaaaaaaaaaacatcaaattaatgcaatgcagtacaagctaacatactgttcagcttctttcaatctctactattttagttgagttaattactgtgcaatgcatgcttaattagttactaattgtacatgtagatgaagctggggcggccggcgagagggacgccgcagaggttgcagcacagcaagaactcggcaatggcgaacgggttattcccggtgcagatgctgcaccacggcacggtgcagtagccgcccgaggcgccgccggagctgatctgcttgtgcgtcccctccatgatggcgcgcgcgctggggcgcgcaggccgcgcgacgcggccgacgacgtcgtccatggcggcggcggccgcggccggaactgggcggtggtcatcgacggcagcgatcgccgcgttgacgccgacggcggcggcggcggcgcgctctacgaagacgaagcatcggcggcggctcgccggagcggcggccggtggcttggctacgacggcggaggccataggagttcagtgtgagtgagtgagtgaaaatggtgagattgggagggtgaggcggtgtgggtttatatagctttggggggagaagggggttgcttggtgaggaattctaaatgcctttatttgttgcttcctttaattttgttggtactttcggcgcggctaaagcaacaccaagagtgtacacaagttattatgtgcttgggaggctttgtttggcggtggcggcgctggtaggatttatggcggtcattttgtaccttttagatgaaaataaaagcatttaacacggtctactctagggaggagcgtcccatctatcttatttaagacgtaaatgttagctatttgagatccctttcttgacgattttatttatcgtctaacttatcaaattttgaaatcaaacctacccaatcctctacaattagttagtcagcacatgtttccaacctccaccaattctacaattttctcagatggtgaaagttggaaactctcaagtttttgcgattagaggagaaactcgctcgcgttgtccctcttctcctattatccttagttacataaatcaagcacgtcaccccgtacctataccaatctctctcttcttaaataaatcataaatcagtgaacaaaaagttttgtccatatatcttctttgagatgaaaggaaaaaaatgaaatatttggtagctaaattcattctcaattccttctctattttttttcatgttatttgcttttgtgtgaatgagaatctttacatgatttcctaactcatgtatatatggagagaaaaaaatttctcttaataactaaatactggtaaaaattttcccaccaggtaacaaccttataaacggagatccatttaaaacaatctagaaataacattat

SEQ ID NO: 61105 - DNA, 710 bp, Oryza sativa
tgttttgtatatgatttactttcacttacaaaccaacgaaaggaacatctgatgcttattattttcatataaatcaaatgggtattttccttgatctttgtaagtttgtaattaggatgtactatgcgcaatgcctctcataaaatggtggcttctgaaacaaaaaccaaactaggcttaagatataacacggtgtcttcttaaaaaattcgaacaatacattatgtattatttatcattgttgtcatgccatacctttggcaatctcatgctgttgatattattgctgttattattctttatattatgtcatatgcattatcatatcttttgtgcagactacttgaatcagtacatggtggaaataatagaagatatgaagggattacaccacttgatcagcaagaccagttattcactaaagctattgattttcctgtaaaggaatcacatgcatggactgaaaaggttatatcttttacctgcttatttatttatctatgtttagagcagcctgttgctttatactgtatttatacctttcctattggtttcagataaaaagacttcaccttctgctcacagtgaaggaatctgctatggatgttcctacaaacctggatgctagaaggcggatatcattctttgctaattctcttttcatggacatgccaagtgctccaaaagtccggcacatgttacccttctcg

SEQ ID NO: 61106 - DNA, 957 bp, Oryza sativa
cgcacgcacaaggaaagaaagaaatcgattgaaacaagacaagcacaagtaatgtaatgctgcaatgtggtaaagaaaatttgggggaaaattaaaggaagagaagagaagattacccctgacccacttgtagagggcgcatttgccggaggaggtggcgagatcctgcgggatcctgcaatgcaaaaccaaccacatgatatgatgagtagaagaacatcaatcatcgagaagaaaggcgtagcgtggataccataccagtgcttgacccagcgggcggcgggccgcgggggacggcgaggcttgtgctgctgcgacggcgggtagtagtagtagccccctgcccctgcccctgccggcgccgcgtactccatcgagatgacgagtgaatgccgccgatccgatccgccgccggcgaacccttctcctcctttctctctctaggcggcctagggtttttcttttcttttcttttctttttttgttcagcggtgggcgtgccggaaaagagagagagaggggaggtaaatgctcttgatttttgtttgggccgaaacaacaacattccttttcttctagccccttcttccttctctgtgatgataatggtgttgtatttctttttcttttcttttttacgattacaatgcatacatatatgcgcgcgcatactatactatatactatatatagataacaccacactcacattctcacgaatatgcttcctaatacattctctaagagcctgtttaggtcaatttgctgtggtatttttttttttgcaaaagattgatattgaagttttgctagttggtgtttagatgcatggtaaagtgttggcattttactagtaaagagagaaagagagagcacggctctaaacgtactttttggcaaaatttgctactatagacttctaaatgataaatgccaaattgctaacttttgctacag

SEQ ID NO: 61107 - DNA, 6120 bp, Oryza sativa
tcgcttcattgatatcatgacgggacctgatccaaaccagaaccaaaaccatgatgctctggtcatcgaggatccacagattgaagaagtggaagccatggcacatcacccaacgcaaacccatgatgttcagcgatggtcgacgtcaagcgttcgccctcgattccttaacattcctattgcctctgctccacttcccaccacattgaaagactatcatgacatggttgaagacctggtgaacaagcggctgaagcaaatctccatcgagcaaacaccccgaccaatggagagtgagcttgagaagccatatgaagcttggcatgatttagtacctttcctggcagggtggcacccacccaagttccgtcaattcaatggaaccggagatgcaagagaacatcttgcgtactttgaagctgcatgcggcgacactgccaacaacccctctctcctcctccgtcacttctcggggtccttgactaggccagccttccactggtacagtcgccttcccatgggatccattggaaactgggcaaccatgaaggaagtattcaagaagcactttgttgctatgaagaaagatttctctattgttgaactatcacaagttcgacaatggagagatgaagccatcgacgactatgtcatccgcttccggaatagcttcgtgcgtctcgcaagggagatgcatcttgaagacgcaatcgagatgtgcgttcatgggatgcaacaacatcggtctcttgaagtgtctcacgtgaaccaaaaacatttagcgcactcagttccgccgtggcagcaaccaagctcgagtttgagaagtcaccccagataatggagctttacaagaatgcaagcgcctttgaccctaccaaacgctttaacgcaacaaagcctagtggtagtgggaacaaacccaaagttccaaccgaagctaattccacaaaagtcttctccaccgcacctcaaggataggtgcccatgattgcaggcaacgctccacgcttcaagatcttctcaaaaagcagtatatcttccgccgggagttggtgaaagatatgttcaaccagttgatggaacaccgcgccttgaatctgcctaaaccacggagacctgaccaggtaaccatgactgacaatccattatattgtccttatcataggtatgtcggccatgctattgaagattgcatcgccttcaaagaatggctccaaagggcagtcaacgagaaaagaatcaatcttgatgcagacgccatcaacccagactaccatgccgtcaatatggtgtccgttgagcctttccctcaaaaacaaagagaaggtaggcgtgcaacatcatgggcgccgctagcccaagttgaagaccaaattgcaaaaataatactgacgaaagcacccgccactcatgtggaggctagccatggcgacaacaaccgaccatggagtgttgtgcaacggaagcctcaaccattgagctttccaccccgtcgcccacaaatgaagttgtcaccgcatactcacccaacttcaagaagatggctagacccaagtcagcgacgtcctccacctcgatttgtccccttctcagagggagacaagtcttttccccgctggggtcgtgagctacctactttggcgcaatttctgcccaagggttgggagcaatcctcaataagcacaagggaggctatggaggtggacaattccaccccgactccaaacattgctccatgcaatgtcatcctcacctacaatgactccacaagtaccggttccgatgaaacgtttacgggaagggagcgagaaatattccatgctgagttggatccagagaagacgaaggtagaagaggtcaacataagcctgcgaggggggaagaccttgccggatccccactagtccaaagctccaaatgtagacaagcctaccaaggaggcctctcctcctggagaagctccagaaacaaaaactggaagcaaagagaagcctgctgtcgactacaacgttcttgcgcatctcaaacggatcccagcactattgagtgtctatgatgctcttatgatggtgcctgatctgcgcgaagctcttataaaggcgttgcaggctccagaagtttacgaagttgatatggctaagcatcgactctacgacaaccccttgtttgtgaatgagattaccttcgctgatgaagattgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacagttggcgcgccaggtaagggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccaccggcctgcctccgtcgccgccgactggtgtccccgcctatacggtcggttggtcacaccaccgttgatgggcatcatcatctacaccgccggcctgcctccgttgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcactgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgtatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggcttgccttcgccgccaccgactggtgtttccgcctgcacggctggccttttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccgactggtgtttccgctagcacggctgtcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggttggcctattatgccgccgttgttggtgtttccgcctgcacggctggccttttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccgactggtgtttccgccagcacggctggcctattatgctgccgttgttgggcgtctacgtcttcaccgaccggccgcctcgtccgccgccgactggtgttttcgcctgcacggctggcctttatgccgctgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccaccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgttttcgcctgcacggctggcctttatgccgctgttgttgggcgtctacgtcttcaccgaccggcttgcctttgccgccgccgactggtgtttccgcctgcacggctggcctttatgaccgctgttgttgg

SEQ ID NO: 61108 - DNA, 1101 bp, Oryza sativa
ggatgctttaactttatagggaaaaatttgaagtggggggtatatttgtagacttgaatctccattgatgcctacacttcaacataaaaagtagggcacaacaactccaattagttcagtattgggcaaaggagtgacatgcactggctattatttggggatagggtggaagccttgtcaattctttgagctaacttggcactggatgagtggatgggccatgcagtcagttattagccaaagtgtgagaaaactatgtttcttttttcttaaaaaaagtgtaactgattaactgaagcatcagttagtcagactgtttgatctaatatcaaccatcatctgctgtcagtttgtcacagttttgtcactcataatgtgtcaacctcagagaatggattaagctgtgacatatgttgtttgttcagagttcaggctaatccagagagagaaataatatgccattgtgttaccatcattcagatcaacatcttgcaacaatatatcatgcatttgctgatttgctttgcatggatggatgcagataactccatcatgcatgtgacatgagcaaagctcaacaactactaattaatttacaagattatccacatgagacctctgtctacaagaccaatgtcaaagcacatcttttgacaacttcgattccttattcctctagctgtcacacattcccaggaggaaagctcaattagcatctaatcagtggatcactgtatttgtttaatctgtcagctgtaattatctgcctgctaactcagtactactccttctggtttcctaataccaaatcattaacttttaaatacacgtttaatcaacattctcatttaaaaatcttatacaaatatataaaaaatatatgtcacatttaaaatacgtttaattataaaaacaaatcacaacaaataaatggtaattacatattttttaataaaacaaatttttggataataaaaataaattacatcgtcggtttttattataagacatacaaacattaagtttttttaacaaataaccaatcttaagttaatatcatcgtatattaaaaaacaaaaaatatcatcgacgaatcggatg

SEQ ID NO: 61109 - DNA, 40255 bp, Oryza sativa
catagttactctacaaatttgtactacgggggtagagctgggtttttgctgctccacagctccactccactttaaaagacacactaccctttaaaattttagtgtatttacatgaaaatgccactgaactacctccaccaacctccccctcccgttctctctccttctccgtctccctcccgagccctaacagatgcagtaggcggcatcggcgtcggcgtcgggctgcggcgttggcggcggcgccgtcgatggcggcggcaggctgcggcgtcgttggcaggcggcggcgtcgtcgtcggcggcgacggcaggcgccacggcggcggtgcgcggcaagcacgcgggaggaagatgggcggcgcgcggccggcggagggcagagggcgcaggggatggggcggccggcggctgggatttttgtttttatttttttttattttttttctttttttaaatctgaagctgaaatgtagccaaacacttttgatgggtgtccaactccaactagagttagctcccactgtagtaggagtttggagttaggagttgtagtttggagcactaccaaacggagcctattttagcgaagtgttagcgtttgattttcatggatcgtcgccgtgatgctcgggtgctaccgggaggtgaatccggccactattatagtacttaattgaagtcatcgaactcgttgccgtcaaaaactaatctattatttaaaccgattatttatccctcgtctgatgagtaacctgctctgtcacgtgtatcatagctctgctcggccttgtttggatccaatgaaaactcccagcttctcatgggaaatgggccggaatcccggtatgttagttaaggcctcatggaagacagtatgggatcatacactgacactggccagcagggtttacaaatagcaatctcgattctccggaaataaaaaaacacaatctaagattggccagtgaaagacgagccctgttagattgtaataattggctataactctttaagcaaaggccggaatgtttttccattatctaaaaagaaagacgagccctgtgaaacattcgattttttttcgcaaatttcaaacaatatacatgttaaacaaatttcgacacattatgaaatttgaataagacgcacattttcaagatgatcgaaattcgttaaagatgatgaacctgttggccaagatatattgagatggtgttagagatgtaatcctgctataatatgtgaaataaacagttttaaaaactcggtctagccatatacccctccatcctaaattacagggtgtcccttttttttaaagaaaacttaaactcggtagcttttgattaatgactatactaaccatacatttttttttgcggggaaaagggaagtattactcaggaataatatcgtcaattacaagctttgagataaaggtgcaatcattttcacaccaaaatcccgacaagttttcactgcgacttttattagctaacatatgactaactaaaatttggcttctatgaaccttcctgagcaaacactcccgacttccagcgaggagatccttaatctctctaacggcaaaggcaagctccgagcgctcaacttctttggcttggatcatttgtaacgctaccaagcagtccgtttccacctgtactgggagcagcgtccactgaagcgccaaggcaataccctctctgcacgcgaccaactctgcttctaatgcactatgacagctgttcagggttttgcaggaagcaaaaatcaccctcccctcccagtccctcatgactatgccaatgccccccttctctgacagggcatcaaaagagccatctatattaaccttcaaccatccggtttgcggtctcacccatttttgtttgcaagctggtcttgatcctggagggacctctttcccataagccaagacagattagaacgttttttcctttctctgaaccaactacagacttttgtcggatgttgaacagtgactgaatatagctctcaaggaatcttttagaagactcgatcgttggaggggttttctcatggacgatttcattacgaacaaaccaatttcgccataacaccaagagaagggccgcccgttcagattcggatagcctgtctaacagatcaaacagccaggctttattatccatacgcacatcagtgagcacaggaaagtgcccatcaccttgcatagccatcagcaaaaatcttgactgggaacagcgaagaagagcatgctgggtgtcttcagtttctgacccacataccccacaggtagctatccgctcaagcttccttttcgttttattagccattgttgcaagggagtcagtggcaaccttccaagcaaaacttctcactttctgagggacttcacacttccagatcaggtcccatctacgatcgcctgccatattcgacggacctgtatcctcttgattcttcaaattcagagccaagtaataagcactcctgactgagaatctaccatgcaagtctggatgccaagctataaaatcttcgtcctcccaatttgaaatacatatgctaagtagtatgcatgttatattattagatttatattttaaagtactttcatgtgacgctaatttcatattcgttaggaaaacataacattaaagaattactgatcaaaataatttgggacggaagaagtagtagtgcacacttttttttctcaaacttaatttacagctaagctgcttagaaacaacaacaagaagaagaacaaaaaatcaatgacgaatcacattatatcatccagagaacacatctagttatacactgacgacgaggaataactaatgcactactcagcaagcaataatttatcaaggctacatggaagcatcggcaaggtccttcctgtacggagccggctggtcctcgtcggcggcggaggcgtccaccaccggcgtcccgccggcctccacctgcgcctgcgcccgctccggcaccggcacgtacgtcgccaccgtgtccttcctgaacgtcaggtagacgacggcgaccaggtaggcggccatgagcgcgaacaccaccacggagatgaggccattggcatacttggggaggttgttgtggacgagccagtccacgtatgtccacactaggaagtaggtgttgacgacgatgagcgcgaagctcaggatccacgcgatcaccaccgtctgcaaaaattattggatcatttgccaatttatgtatctagcatggcgaattaatcggttttcgtgtttgtgtttgtgtgggtgggtgaatgtgaatgttttttggttggagaaatggtttaaggaagcttacatagatggattccttgaggggtccaactttcttgctgctgttgcagaacttgagtagagggatgagagcgaacggcagctcaaatgacaggatcatctgtatccaaatcaagaattcaggatattgttgcttttggaggagcaaagcgaattcctacagaatgttcaattggaaaaataaagctgaaaacaggttgatgagtcttactgatgacaggatgattagcttgccggcgcctgagggaccactgacaatggagacgatgaggctaggagctatggcgatgactcgggtgatgaggttccttacccaattcttcatcttcatgtccagaaacccctggataattatcataacaaaagttggctatatttactgaaatagataatactcaagagtggacaaatgatatgcaaggtatcaaatagtttgtacaaacttgataacacctcgatcaatagtgtaaacttgacaaaccctgctccaggtttactatcaagggtgagcactacggaactgaattacctgcatgatgacctgcccagcgaacgtgcaactgatagtggtgctttgcccagaagctagcagcgcaacagcatacaccaccgagcttgatctccccaaaacattctgaaagtaagagataatcaaaataaggcttgaattcagaatgtctgacatgatcctcagtgagctctggtctgtaatttcttccatattacagaacaagatgtctataagatgcttctgaaagtactatcttttatccaggaaatgaacattcgaacagttcttaccctgagtaaaagaggtgtggattgcagagttaggtcaccacacgtgttggcatcagctggagaaagattattcgcattgcaaatggatccagcaacaacaacgactgaaacatttatgaggaaagccacgatgaatgcaagactacactcaataaggaagtatctgcaagcagcctatcggaaacaagatagggtcaaaccattagccactcaacaacaaaccatagctgatcattacatcatctattatcaatgcaacctactctgatgcttttgtctgatcgtggggtcttccttgacaggaccagagcagagtgcaagaacaagttgtatctgcatgcatgttatgaaaactcctcatctcatgaacttgtaccatggatcaagtaaaaagtagctacgatcaccaaagccctgataactgattgggtttcttacggtgtgatgatagcgccaaagagtgcgatcgcattggcagcagcgcctttcccttggagagaagggacaaacatgcccttgaccacctctcctgcagacggcctcaaatagcttagctctccgaagaagcaagctgccatagtgaacatgaatgctgctatgatgaactccagcttccgagcctggtggacatgtcatatggtaaggtcaattcgtcagtagcccattctcagtgtaattcatctgacaatcatataagtctgagaaattctttgcgcaccccaaatctctgtactccaagaagcaagagggtgctgaacactgtgagaataactccagcccacactggaatcttaagcaatatgttgaacgcaaaagctgtgcccaacactgcactaacaaaagaacgtgttactcatgctaaatctagcacagaaataaataaataaataaataaataaataaataaataaataaaacatcgatcaaccttcaggaatgtcatcagaaatcaccgccaactccgcaatgatccataagaaaatgttgacatagtgcgggtactcttccctgcacagttcagcaaggtgccttcctgtacagaactcaacaaaagcatggacaacataagatgataaggtgatgatgcatgattagcatgcaaagagcaaggttaatggttaagtgaaatatacctgttttcactccaaggttggcagctaatgtttggatcagaagtgcaaagaccatcccaactaagatgacccacagaagctgttcattgtaaaatgtaaattgatgttaccagaagaagcattttatataaagaggaggcaggaaaaacgaaatagttaattttgtttttctcctacttttctgtttcttgattgaatttgtcttctttaaatattaggaaagaaacaaattattgaccaccatttactaggcatgggagactttgtttgatttcgtgtactactgctactattatatcatatatataaggttcatgtcatgatagagtcatctcaagtcaatgattgatattccaacgttcttatatgtgtactccccaaaataatccaattttctttcttcaaataagacattgttgcttatgctagttaacggggagtccttttggtacagtccttaggatagacttaagtttaaactttgattatttaggcctttaaggaaacatatttcaatattctgtaaaggccacaccctcagtggaaggtttagaattcttcttgttcagctatgaaatcagtgcaagaaaatctcaaaatattatttatatttggaattttaaagatatttcaagtcaaaacatccaggaatacctctaaaatgtttaagagtctgttttgttcagatttgatgcccaaataagtgttttcctgacgcttatactaagtaggttctttgtaatagttaacaattttcaaaggccaaaccaggcaattttccaactaataaatggttccaagatagtctttcaatcatttattccaagattgggagcctttcaccaggtctttatttgattaaccttggttacattcaccctttccatgcgcaggcaaaaatctatgacacatggttaattagttcgtaaaagtagttcagatccaagacgaagaggcaagaactatgcagtgtacctcatacttgaagtcagctccagcttgcatgtcagtttccactgtcaaatcatgtttcagaaaaaagctataccacctcaacctcttctttttctttttttcttaatgagcgtatcaaaacaatatgaagctctaggcaaaagataggagcttacagttgctaggatctaggaagccaatggccaccagagctccaggcccaacatgagccaagaatttcctccatcttggctgttccacccagcaaaaagtaagcataggattgaaacaagcactagcttattgtggcattagaactccatgaatgcgcaaaatgtagtcgcttacctgcacccgaaactgcccatctttttcactgtcaatagtcttttctttgtactcatcagtctcactaacactctgcaccacacctccatggagagtttctcgtccaacctctctcatctcaccagtcccttccatattctatgttgctaatgcaccttgtctggaagatatgaaaaagtatgtcttgctctagttaagagccacatacatcctttgtattttatagacccagagaccagttgacgactgtcccatacagaaaccaaaacttcaagtacagtacaagagcagagtgactagctatcatgatggttcctgttgattcctcgcttattagatgcctttcagatctgctactcttgttgattgcagtaacaactgagtctgcaatattaaaatggaaattctaatcactttattttcagtattaaccacctcaatctagaatgtttaagctgctgaaaaatagcacttttagtcacatttcaacagcccccgccgcactataagttgtttagtccactgctacaactaaatgagatgcaaatatttttcatcggacaaataagtcatcacaaattctggtaaacttgggcaaacaaatgcccagtggcatgaggggcccaaggctaactgcagcataacacaatcacaattacaagctgactaccacgcataagaattcaaagctgcattacccaaacacctagacgtaaattcagcatgaccatcgatgttgtcatccgtcaaacctgaggatctacccaataggattttttaaattagaagggatttccttatctcccatacacagccacatgggtcgtatgggtcttcgctcctagatattttttggcccttatacaaagtttgatatgttcctttacagctaaacacctaggcttaggaaacaccaacgtctctacctaagatacaataaaatacatttgataaattgttaagaacattaatgccgccgatgtacctttgcttggctgttgctttccgattattttggagcctttcgggcagccatttttcggtgaaggcaaccttaagcagctcagacctggtgcagtccacatctctgtattctattgtagctattcagatgataagacttaaaaaataagcaacagatgaaaggacaataagcgtacagtcagattgtacttaaaaaacctcaaacctactctccattggaatccatattctactcaccaaattggaactagcagagaagagtgtgatgtgaccaccacctcatggaggatgaggtgcccctccatgcaccgaatggttagcttgctaacgagttgatacgcaggcgtgcgaaaatttatattgtcggccatggcttcatttggtcgaatgtggaagtcaagaactgtggatttatggcagtggacagaagaacaatgacgggaagtgggaactagacttgggaacggggaatttaaaatgctattaaaattttaaattaaaattgggaattgcattttaaaatttaaattgcaaatcgacttaggttttcagtagtactaaaatcccagaggcacaggacgatttggagtgactagcagtgatcaaattattggccacgaatcaaccagaaagctcataaacccctactacctaataatttcacaggacagtaaaacacacgagtagctcaccatcgccgagggagagaggcgcgggcggctcctcgccggggggctgcggcgacgacggggacgacgagcgcgaggcggacctcgacatggtcccccgcggcgcggcgctcgggaggggccgcggggtcgacgagcaccctcgggacggggaccctgtgggggacgggttccccggcgagcgagaaggagaggaggaggagcgagtcgtcgaggcggaggtcggcggcggagagctctgggcggaagaggtagaggcgtcgtcgccggcaacggcggccatttcggtcgcgaaggtccaggcggaggagtttgaagtcaggccgagctttaataagagaagcccagcccactctacataataaaagaagcccagcccactacctaatgaaacgagcccagccaataaaataaaagaagctcagcccactacataatgaaacgagcccagccaataaaataaaagaagcccagcccactctacataatgaagcgagcccagccaataaaataaaagaagcctagcccactaataataataattgtttaacaagcgtcagacgtgttggttacgtacgcggactcgtggagtactacacatatgtgtgcaggtgcagcacattgcgaccccgaccgcaacccaattaggcgcggccgcgatgaacgacgacgtggtggctgagatcctcttgcggttgccggcgaagagcgtcctccggtgccgcgccgtctgccggagctggcgccgcatcaccaccgccgactacttcgtcgccgcccactcccgccgccggccgctgcagctcctcggctacacggggcccaacgacgagtcgctgcgcgacgacgaattcttggtcacctccgccccggtcaccgccgtcccagccgtctacgacgggacgacacggagtgccggcgatttctgcggcgcaacgtgcgcctgtgcctccgtggatcctgcgacgggctcctgctgttcgagcaggtgaacgccgagaccatgctcatctgcaacccggcgacacggcagctcgtcaatctgccgccggtgagcactggcggcgtcgtcgtcgaccggaacgacctccggctccactcttccgccttctacttccaccggccgtccggcgagtaccgcgtgctgtgctaccggaagggcaccaactacatcctctccaccggctccggcgaggcgcggcggctcggccccgtccccgaccagcaacgcaggacttgctccttctccgccgtgaccgtcggcaagacggtcggcgagagcgtgtactgggaccgccgtgaggtcgacgatcggagccggataatggcgttcgacacggtgtcggagaggttccgggcggtcgcgccgccgccggtggagcatgccgacgaaggcccgctgctggacatgcatggacggcacgctcgccgtggcggcgatgccggcggagccgtacctggacgtgtgggccagagacggcggcggcggcgagaggtgggtgcggcgcctccgggtggagctgccggcgggatattattccaaggagttgaagcctcgggggcttggtagagctatcttggacgacgcgggtctactgcttgtcaccttgtcctgcagatggggcttggtgtacgacaccaaggagaagaggatgctcagctgctctcatcgtagcagaagcaatccgtggaatgcagcttaccgggagagcctcatcacggtgaaaccttgcacacccccgctcccgctaaactctgagccatggttaaatttctactagtggttgcagtgatatgagtagcgccccaatatctcaagttcaaatttttataggagcgaatttcagattggattatttaagagctaagttcctaatttaaaaaggctgcatatatagttggatgtaaaggctagataaaaaaaccctactaacaaaaattactgtccacgagcatactgtcgacacatcggtgacggagccgccggtgaggaagtcggcgtcgggggaggagagtacgcaggggcctctccggtgagatgccaacgtctccatggcggataccaccttgctcgtgtcgtgactcatgagggttttgtttttgttttttttccttttttgttctttttttttttaccgtggggttttgggggctaaagaagaagatggttacgtgtatgtacagctgggtccagttctaaaaaaaatacagctgggtccccgggtccaccggcagtgaaacaattccggtggaccaagtctatggcaaagctagccgtgtggcatagggcccacgaattagtagctgggttcacgtggaccagcaacagtaacccaactagagttatatctcttgaacagaggcacaagcgagaaaattgcacatctaccattccataagaatggcttcgctagaataccattatgaaaatgggcttcgctagaataccatcctcaatcagagtgtcttcgccaaaatgccatcctggacggaaatgcccctggctcttctttttcctccatcccgtgcgtgaagagctcgccggcgaccatggccagctccaccgccgcgccaccgatgctgccttgccgactgcgattggggtgttgctctccctgccatccccgccagtgccgacggcgggcgcgggctccagcggagggctgcacggtggcggcaggtgcgatcgacggcggcaagcgcgggctccggtggagggctggtcgatggcggcaggcgcggttgacggcagcgggcgtgggctccagcggagggctgcgcggtggcgacgaggaggcggcggccaggagcggcgccaccggctccccgtgcatgcgcgtcagccggatcctcgccgtcgctgccggagtccttccgtgatgacctcagctgcacgagcacaccactctaccgtcggcaaggcggcatcggtggcacggaggtgtagctggccatggtcgctggcgagctcttcacgcgtgggatggaggaagaagaagagccaggggcattttcatccaggatggcattttggcaaagacactctggttgaggatggtattccaacgaagcctgttttcataatagtattctagcgaagccattcttatgggatggtagatatgcaattttctcggcacaagttgaataacctaacctaaggctattgcttctgtagaggttagaacatttcatcacacttttctaaacctctatgatcaagcagaaccataatcccagaaggaagatgcccccaacttaaaaccaagagaatatgaaaatgcaaggcacgtttgaggtaatttgcacagatcatatgaacataatcagttgcatcgaggcacatgaatccgttgcatacagatgtaagaagaaactgacaacttatacagtatgccaacagacacccattccaaacttatgcaaagacaagagacgtgcaaatcgattcgtcatgaatcatgattcttacataggtaaaaaaaatggaatgcgatggtttcactgctactaaatgctaagtactgtgtgaagtagattgccagatggttgaaccacctaccaccggaaatatactgaaccgaattcactggtagctgggtctaccgttactccattttgatgtcacactgtcttttgacagcagaagataagctcaatgtcttgcagtttatcgagatggtcaatgtgttcactgaaagaacaataaactgtgcatggaaaggtattaggacattgggacatgatcacatgatctaagtttatcaaattttcaagtcaatgctctggagacgagaggaacattctctagagagaaaagcaacaaagtggaactttatccctacctgagcttaggcttccaataaattcatctatttggtgcctcatcatgtacaactcttcagccctacatttggatgatcactcctctattatcctgcgtgctgggaaaagcagaagttcaaaatggtggcagaataagagtaaataaacaatgtatactcatttgcacacaacagacttgcccaagtgcaacagttgccaatgaagctggccaaaattgatatcgaactatgatttagacaaagtatgacactgtgcaaataatcgaatgtactaacgttgggtttccccagaggcggcgcagatgaaggtcccaatctagcacaaatcaatgggatgtgcagctgtgcacaacattcatcatcaactgtcgcttcagttcacatcgaatccctatacaaaaataagcaagaacgattagttcagcattcagaaaaacttacattaagttgtatgaatcaagctgtattgcatatatattgttgcaaacatagtttcgaacgtctcagaatagtatagagctttaaaatcagatcaattgcatttgggcccaaaccagtaaaacttacctatgtatagcttaacacccattcacagggaatctgaaagtttagaatagagtattaaaaaccccacaatataactgaacgttgttgttttaatggcaaaagaaaacagggattgctctagtttcaaaagctgcaattcattgtagtacaccgacatctgaatgcccagtttaaaggtagatttgttttttcttatgctggattgtatgaattcgacataatttatataaagaattatcattcatttgccaatcataactattatactgttagtccaaactccaaagaagagtaaatataacagcacaatgcactgaacatgtgagatgttgagcgcaacaatagtgtggcaaacacatgctgctcatgtacttaattgcaaaacttaccagatatagggttagatcctttgacatgtctttcttgacataattgctttaatcataactctttctgaaaggtagcctaaaatagcaacactgcacagcaaaacaaaaaaaaaacctattatatgcaaaaatctactatatagtagtgctgtcatgtaacgatgatcttaaagtgccaacatacatgatatttagtgggttgtagaacaaaagaagtgcttggacagtatgaacctcagacaggtaatctagcgcatgtgttaacatatcagtggatctttcgatgaatagagagtacaacattcaaccaaagagtggttatgagttatcaatgaagatgaaatgaaatttgttgccttattatactcacctttcatatgttgcgatctacttatatgttaaccatccatattgaagcttacaacatatgtgctttcaagttgtattagctagttacaagcaagttctaaaacttattatcattcataagcttctactgtctgcatgtaatctagggtaaagagaaacttactcagccagtgttttctagtacataaatgtcatcattctgctgctgcttattctcataaacgttgcctctttgaccccatcctgtcttcactctcttggtgattttcatgactgtgcgagcactgtcatctctgttgaatcagcaacaaaatcaatccgttgcagctcaagttcgacacacaaaggtagaaagtgcagacctatttttctagacaggataaatttcatttctaggttctgagtacatatgctttatatactaaatcagttataatgctttgttgctagtctaaccaatgcaaaaacttgcacaagaaaatagactaaagaaaatgtcacaaacacatcagaactaaatttgtcatcacaatacctgtgcaaaagagcatgccaatcactttcagcatgcttgtcctgtccatgcttctgacttctaggcttaaattcgccagaaggagctgcaagaccattatcacgctctgccatttccatcattttttgtgagagcatatcaacatgttgcttctttcccctttcactcaatgcatcaatcactggcatgaatgctgctggatcaaatgaatatcctttaaccattaacagcttgagtaacctatgtccatgatccacctcatcaactttgcagagtccctcaataatctgcttatatgggaatctatggatagagatccttaattcaagcactgtttctagaatattcatggcttccaaccatctaccataagtagataactgggtgcacattaaactatagagcacttccttctgaccacatgtactcagagaagcatcaaatactctctgagctgcagagaaatctgaagttttgcagaaagccttaatcaacaactcaaaagaagttatattaggaacaatttcattctgtaacatttcatctaaaagaggcatggccttgttcaccattccccgttcacaaaatgactttatcaggctattataggtcatgacattgggacaaatccccttccccttcatttcactaatcaatttaaggatttcatctgaattgtgtttttcccgaaatccccatatcaacaagttgtatgtccttgtgcttggcttgcaacctttcttttccatgtccctcaggaccttaacagccagagaagtcttcccatgcttgcaatacccatgaataaaggtatcatatagaaccgaatcaggagagatatctttgcctatcatctcaagcaatttcttctttgcttcatcaaacctgccctctttgcacaatgcactcaccagtgtagaataagtgattcggtcaggaagacatcttttgctgctggaagaatcagtaagtaaacttaggaatgaataacctaatctgccaagagccaaactaccttcgttccacatgccatcgacaatgtccatggccatatccaatttgttgtttctacatagtccatcaataatgatattgcagcttgctgtatccaagctgtatcctttctcactcatcctctctaacaatcgttctgcctctgtaatcctaccagctttccacaaactttgcagcagaacattgtaagtaaatgaattcggggcacaccccttctgtgccatctcatcaagaatcctattggctgcagcagcatttccctctgagcaataagcgtggagcaaactagtataggtcacaacatctggtgtcatgacaccactcttcacaaaatcctccactttcctcacatcaaacgctttgccctccttgcacaacccatccacaataatattgtaggtgtagctattaggttgaacaccctcatgcgccatctccctcagcagctcctgtgcttccccaaccattccattcctcaccagccctgacaaccaacggttgtaactctcaacccgcctcaagaaaccaccgcacctcataatatccaccaggactcttgcttcatccaccataccagcctcacagaacccactcagcatcacgtcaaacgtcacctggtcaggcctcggcagacctctctcccatttttcctgcatgtcgttgaatatcctgtatgcatctagcacccgcccagctttgcagagtgcagagatcctcgcattgaatgtgaccacatttggagcaagaccctcatctctcatgcgctcaactagcctctcagcctcatccacctggccctcgcggcagaaccccgcgactactgtgttgcataccaccaaattcatcgttggcattgaatcgagcaccccaagcgcgtccatactcctccccgcacggcagtacccacgcgccaggatcccgaagctgaactcgttcctttccggcattgcgtcgaacaccctgcgggcgagctccatccggccagcggcacagagcgcctggagcaggatgttgcgcgtgaagacgtccggggcggcgccggacaagaggagatccttgtagagcgactcgacgaggtcgaatcgggcctcctggagcgcggcgaggagcaggcggttgtagacgggggtgggcggcggcggcgcggaggggagcgcgcagagggagcggaacgcggagagggagaacccgagcgggaggcgcagcggcgacgatgaggaggagaggagcgcgaggaggtgcggcgcggggtccgggagggagaggaggtggcggaggaggctcgggaggagggcggcgtcgtgggcggcggcggcggcgaggatgcgggcgaggaatgaggtggagtgcggcgacggcggggacgcggcggaggtgaggtggaggaagaggcggagcgcgacggcgggggaggcggcgttgcggcggaggagggcgaggaggtggttggcggcggtgggggaggtggacatgggaaggtggcggccgcggggcgacggcggcggagagggtttaaaccggcccgggccgactggccggtggggtacacgtctggtcaacggcccagtccactgacactgactggtgggcccggccatgttacattttttatgttacattttttgtgtccgtatttccacttgctgcttagagcagatactacagatttgtagccagctatagcacggactccaagacacaatgtgtgtatgataagtgggactagatgttaatagtgtagtacgtaactattgtatgaattggctattaagttgactatagatgatttatagctagtagttggctatactattaaacttgctcttggtatactccgtacctttttttttctgaaatttgcgcttaattagttcggtgttctgggttcctaaccctgcctcgttttccgaacacacgtttttaaactattaaacggtgtgcttttttaaacaaatctataaaaagttgcttaaaataatcaaattaatatattttttaaaaaaaaatagctaatacttaattaatcacagactattttagttcaagcttactccactccaaacattttgaaacagggtgaatatacaggaataaatttgttatttcacgcggctgtgaaattgtaagttggaaacagcagacgttacagagtatttcacgttacatgaagcagtgcagcacaaaccactgcagatttactcaacatgagatcattgccaggctatagataaagagagaaaaaaaaacataacctaacacacaacgctgactgaggtaaagatcagtaaaatgaaaaagaaaagaaaaaagaagaagcaagaaactaattccagttgtgagaagagatcagaagcaagaaacattctcggttctcatgaccaggttgcaagtcgagtagatggaagcggcagcagcttgcactgcccactcgctctcaggagtctccgagttcttcagtttcctgaaagacatcgtagtagtagtatttcagtaagatatatcacgcataaagtgaaatgacttggaaactactccctccgtcctaaaatataagcatttttagctatgaatctggacagattcatagctaaaaatacttatattttgggacggagggagtaagacatttagttgctatatatttgagtactttgttcaactaagtctcatctaacagaaaagggtggatcgaatcgaatacgttgagaggtgatgatgagctaaccataattcagccattggtcctactaatggagcctcgcaagccatgtatctgagccctttctcacaattcatttgcatttcttgcacttccttcaaccgattctcctgcaacagtaatttagcacggtgtcagtagtggaacactgcttaccagaatggatgtgcaattgcgcatgcacatatgcttttgtcataaaaggcgatattgcgagaatatgctagttttgtgcacctataatgaacactattatgaaaaaaactcaccagatgcatcccctcctcctgaagtgttctgtccatctgaagaaaaagagaccgccatcgtgccacatgcgcttctggaactgtttttccagtagatccaccatcagaagaatgtacaacggatggttcgttctcttggttatatgaaaattctgttgatattaggtagggcagttcagtctgaagggcattcctgactctcttcttgctgcgcttcaaagcttcaagaataaagaaagcatattaagcagaatgtatgggttacagctttgaattatgtttcaaactcaagaattagtaccagcaaggcgccctctgatgtcctgctgtagtagctccaaccactgagaagcaacattggccgctgatcatcaaaaaggcaaggcaactgtcaggtatagataattctacaaacagtgaacaatgcagttctggtgagagtgtatgattgacgaaataagagatcaagtataccttttactgataacacagtcatgtaatcatgattagatgcaaaatcatcggctgatgtactgcaggtcctgtctgaagccatagtgactgctgatgagagttgcagtttcagatcatcaccgtcctctggaaggaattgtgaagcagtaggcaacccttggtgaaacggcatgttgctacctttcatcaagaagtggcaattcatcatattacccccatatctctggtcctgagccttctcactaaattctctccctctttcgcctgtttgactagcatgaactgcctggttctctttctcaagattctcagagtgcaccatagcctttattatggagtaaacttgcttgctgtttctcacatggttaatgattccagggtttagcccagataataggccactcggagcagcaaccttcatgaacttgtttgtctgttccttctgagcaaaagtgttccttttggattcatcgtctcttttccttttgatgggtcgaccgcgcggcctaggacccactgcagttccttgagatgaagaaaggaacccattctgcttcatttctctccacttcctgtgtgactcactctctcctacagccccagttgtgctaccacactctgacggatcactaactttcgtctgccccaacttcttgtaaggaaagaagggattaagttctgcagcattggaagaatctactatattaagatccaatccaagaggtgcaccattcattctgttctctacatgtcttacatcaggcttaggttgcaagtctgtcctgatgttttctttatcacacaaattgttcacctctgctgcatcagaagaacggcccaaggtgaggcaggcagcctctggctgaagaaatgaaccagtctcaagcaatgagggctctccatcttcacttcttgttgcaacttcagcagtaacttgaggtgtatctttcttgtcacatggatgtagacaagattttgctcgatctgacgaatctgaaatccccactctcatatctacatgatatagaataattagtaagcattagcagtgcaaagattaagggaagtaaccagtaacacggtcaattaggataaatcatgccttggacagtgtacagtacataataggaattcagtggtgtgaattgaggctaaggatgtgtacagtacataataggaatcaggaatgcatgggtttatagccgtgtttttaaaaaaaagtgtacaaggccctgtacaaggatgcatacaaggaacgagtgacccaaccttgtaccgcttaagccgcataagttctacaaggtggggtgaccgcacgaaaccacataccgcttttcaaaacattggtttatggcaatagaaaagagtaacactcacgaattattaactttgcatggcacagaaatcaattgtcaacagcagtttcatcctgaatttatcatttgcacattctacacatccaggagtaatcttatgttggtagcggtacagaaatatgctgagtttgttatgtcaattcgctcctcaacagaagcaaacaagaattcttaattacagctacaagaaaggctaatcgaaaattcgatctactcatacgcttagatctgtagagaagcaccataatctaccgtcacatgtcgaaattctgtgctgccagcgaatgaagtactactgcatacaaagagttcaagaacaactaccacccaagaaagtaaaaaactagcatttccagatcacccccgcgccaagaatcatccaaccagcacagatcaggaaccaagacggcaagaaaagaaaatcaagaagcgccgagaaccccccacctcccaatccgaccgccgcccgcgacccgcacgacgcctccgcagccaccgcccgacccaattcctgcaagaacacacaccacaacgtcaaatccaggctccccaaatccaaaaccaagaaccaacgacaccaacatccaagaccaccccccccccaccccaccttcgtggtcgtcgtcggcggcggcggcggggacgacgcgcccgatccggcgggatccgaggccacacgcagccccgcggggtccatccgggaggccgcggcggcgcgcccgcgaagggggagggatcttggagctagggtttgggggggggggagcggggcggagggaagctttgcgtggatttgaaatggagacgggtgcggaggcgtgctgtgtggggtggggtggggtttttatggtgtgcgggttttttttgaattcgagcggaggtgggcgcggtttggatggggatggatggatggataatgagacagatggacggacggatgggtggatggatcgctagcctttaatcgcaggagcggccttgcggttgcggatgataggaggggagcccgcggatttattttcttcttctttttttcccaccttggtggtttgaaggtgattggtttgaattttggttgtatacacagctgtgggtttgaattttgaatggtgggctactgaccttgtgtgacatatggtgaacacgcttcaattctcttgatggagtaacgaggggaggaacatcaaaaggacaaaaggaacacaagccatgctataggctatagaaactagtactagacaagatgataaacattgcttgagaatgttctaacagggcacttgagacgtattttgtgtgtacatgttctttagtgtgcacctccaaagtcacatgccacatatatggttgtatgtctaacataaacgcaaaaagttgcacaagagtgcataccgtctaacaagatcatttgtgggatggaagaagtatatttttataattttgcttatgagcattgctacatatgcaagcctcaacacgagagaattcattatatggccctaggtttatcacatgtctacaatttaccactgacttgtcacgttgtacattatgctatcgacttttgcttaacttttacgatttaccatcgctatctggttagcctctgttagtattatacaatcttatccaaatgaccaaaatacccctaggataaaaactttcaaaatttgaacaaaatttttgaaatatcatattttaagtttttgccaaattttggatgtttacaatatgatattttggaaaaaaatccaaattttggaagtttttgtccttgtggtattttggtcatttagacaaaattgtataacggaggctaaccggacaacgatggtaaatcgtagaagttaagcaaaagtcgatggcatattgtagaatgtaacaaagtcagtggtaaatcgtagacttacgacaaactcaatttttttttgcggggacttacgacaaactcaatggcatatatataatagattctctctctctacaaaactcttataaacaataaccttagctgtttgatttaagtagataaaagctatagacaatctagatgtactcacgagtcacgacgtaagatgtagtgtttgtaagagtttggtatgacacaatttaggccctctttgtttaggcttaggcttattggcctagacttttaagtcagcttattggcttatatgatttataagccggtggatttaatgtcctaagtttagtagttgagtcatacatctacctcacataagccaaaaaagcttctccaacctagcttttggcttaatagtgttagagtggcttatggctttaaaaaggccaaacagaaaagctgcttgtttgtttaggcttagacttttcgacttataagttggtttataagcctaaacaaagagggccttaatatgtatagacttttcctttgcggattgacaaggtattagtccatactctcatatacaccccatattaaaacattataactcaggcaaataggatagagaccactaccaaaagtaaaattttacatcctaaaatatgattctttccgtctcatttgataccaacccttcactgaggatttatttagcaaatgggttataagaggtgagatcgggataggaaataagtgaaggaacaagaaaataaaccaactgactattttgttgtattataactatggctcgttgtatctccactagctccgactcatctagacggtcgttgttggatgaaggtctccatcttacgttatcatgactgaacttaagcattcatcgacttgtatgcagggttttacggtgccaatgcacacttgaggtaacacaaagtgccatgtgtcgatcagattgtaagttatgaataattttttcgtcacaagtgcggcgatatttggtaccaaacaaaatgtatggcatataatagttatagtaatcactttggctaacaaactgcggcaattctaagatttgatgtgacaatctttgctacaatccgaacaagcctaatattttacaaagataatccatcgcatagctagatcacaaggaaaaaaggctatcacgtgaacatgttccaacctagttctggcaacagttagagcacatttggtttttcagttcgcattacgcatcactcttccgcgccattccatccaacatttttatgagatacatgggcctcatggcccaaataggtgttgtgttttttctctttattctcaaacttgcttttctgttttcaaatacatatgtataaatttccatgcaatagttctatgtagaatatttctatgctaaaagtttctatgtgtaggtcctaattggttacacatattctctaataagtcaaaacgacttattagaaaataaaaattaatttataggtaaaattttttatatatgtattctttgcgacttaaagctaatgttaaaaaaactacgttgaaaatatcttaaaatcaaattcaaaattaaatttgaaaatataaattttggctttagctttggcttattaggacaatcaatggggctcgtaaactttctagatcaacatacttttcaaaacgtgggggcctgatttcaaatgaatatatccaaaacgaggaaggaatgcctatttctatctcatcttcattctaagtttatctgacacgaaaaaggaccatagacacatatatagttgactcgcgcaacttcagttcacgcaaacacatgttgagaaggctattgggcgatcagtcgcgcgcatccctccccgtgcgactggacacgtgtcgcgcgtggggagggagcggcggacgcgccgcgcgagagtccgacttttccttttttttttccgtgttttccgtttctgtttgtttggcttttttttttccgtttctgttccgtttggtttttccttgttctttcggtttcccttctgttttttttcggttttttaatgtatgaataccaagttttgtattcgtacatatgcaaagtttatatacacgtatgcaaactttgtatacgtgatgcaatttcttgtttttattttttaatacgtatgtatataaagtttgtatacatcgtatacaaagtttatatatatcctatataaactttgtatacattgtatataaactttgtatatgtgtatatattttttatgcgttaaaaaatattcataaatatatacacacacgtatatacatatgtatatacatatgtatatgtagtatatacacaagtatagtagtagatacagagaagagactagaggggaggcgactgaccccgcgcgcatgggggcgcgtggcttatcgtgtatcattgtatcagcgccccccaacacatgttattaaacccaacccgacacaaaacgcatcgcgacaaaataattatgacatgaacagtactgaatatcaattgtattttataattttctacttactgttaatattaggattttgacaagataaatgtttttattcgttttaataaggcacaaaactgttttgagcacttgtttaatcgcgtttgaactttgacgtgttagttttatgttcccattccattccaccatgcggtccacgccccctcgattctctctgctttccgcgctgctgctgaccgacgacggccgcgcccctgtcccggtctcctcctcgtccctcctccccgcctctccactcttccagaacatcgccaccgccaccgccgccgccgccgccgctcgccggccacgaccgcccccggcccatctacacctccgccggatctcgcagccgcgctccccccattggagggagatccgttccagcgcgtgggtaagcagcagctgccttcaacggttcaacccaacctgcgtgatagataggtggtgggtggtgtgacgcggggggtgttgcaggtgatttggttcgagagcccgcgtcgcacgcaccgatcagtttggggggagggggggggggggggtggtggtgtgtgatttggttggagaggagagtatagccttgggaggggaatcggaattgggatgtggaatccccttggattggatgaggtgatttgatgatttggtaccaggatatactagctcgagcacatgtgctgttggaattggattcccacctattgggtttggttgctgctgggttgagggagagtagcgttaatcattggtccccgtgtagtattcactgcagcggtatcagttattgcccgttgatgctcgttgttgaattcttgaacatttcaaagttttttgatgcatccaattgctaatttctagattctactcaacccaatgctgttaacagagcccgtaaatcagaggaatgttgtaggacatgcaagtggtgcagaagtaacacatactcatttattaacgtatttttctacgaatcacatcaattttgcttaaaagttcgccaaagcactagcagaaagcagccctagtgacagcacatgatcctattaccatagcttttggagtataacttatcaccttccttcccctgattgctaactgaagaggagggtactaatatccatacttcaaaccatcaggacgaaaccaattctgcgcaacttagtaatgtggcttgtacctttcttttgcgcagaaagagaactttcattaatcattaatcaatacccaaaaggagtacattcagctactattgttaatacaagtggcttgtattttatacagagtataaactgctataccctttcagctataaattgttagttattgttaggtttgttggtccttttgcccctgcaggatttaatttcaacacatgactggtgaaatgtttgcttgatgatgtccggacatgatttcagtattgttcataatgcagttggcatctcatgccactcaagcagatgaagcaacagagcttgcttccagctgtgattgtgcagaagtgccagcttcacagcagatagtttctgaatcaagtacagcaggaagctccacagagcatctagtttcatgtgaaatcaagccactgggtgttgatgaagacattgaaactattgatgctaacgaagaaacccaccttgtcattcaagactgtccacaatgccggatttgccttgataatgaaggtccattctgtgacttgaagtatctttcttatggagtgccataaaggctttcgattttttttttgataatattcatatttttatgttgagtctacatttgatctgatattttttccatatccactacaagcaggtgatgacttgattgcaccttgtcattgcaagggcacacagaaatacgtgcatcgatcctgtcttgataactggagatcaacaaaggtggattcatgaacatttgctctttatgcttcatgtacctatatttactgccatcgcagaatccagttaatcattaacctaatccagctctgacctagtttctatgttacatttccaccaggaaggttttgccttttcacattgcactgagtgtcgggctgccttcttacttcgtgcaaatgttcctccagatcgatggtggttgagattgaagtttcaacttctggttgttagagatcacacgttgattttttttattgtacaactggtacgagttccacaccttctgtaatctaattcaacaaactgttttttctttactgaaccaatactgaatacatctcagtaggatttctccaactgtttaccctaaaaaatgaacatgctacaatactgaactcaagcatgacatggttgcaccttattctgttaatgtataaagcagtaatgattttatggatttatattgatatcaccatttctttgaagagatgtggtagttagttcactgacttcttactaatacattgccatgatttctggcgtgagatccaaaagataaacgtttttgaataaatgcacaagaaagaggcctgaaaatggtcacgatgtgctgctgtaagatgcatctttgtttttgtcttacaatcttatccgttttcctgcctgataggttgttgctttattgggtatgctagtatacagattttatggagatgaactacgagaaatgtttggttatgaagagcatccatatgctttttatgcaatggcaagtaagttactttttcatagtgatatctggaaatgtcatgaactgcatcttatctagaaagctcatagagaactgaaaaacttatcgttttcttgtgtagcatctgttcatgttgatccagttcatgacatgtactgtcaacatggcctggcatttatgtctctaaagaaagtcactccattctattacatctttcatttcatacttatagctaccatttaaaaatatggtgtggaaccaaagtacagtgcaatttatgtagaattgcttttatgtattgtgaagatcatcgcgcagtttataatggcagctatagctttgggcctttgagatgaaagataacatatactacacttaatgttgggcgtccatgattatctaagtgctctctatgtaaatggaatcacggaagatgcttttcagagggatttgtttccatggttcttttagaagactgcacgaattgtaacatagtcaaaacaaaagtctatgtggtcagagggaactaaaagcaactggcagattagatgagaacgccgatagcacatatctcctttgttggcatttaactcaatgcatgtgattgcacaggtcttgatgtacatatttttgccctgtgaatgttgtctgtgtacaggaataagaactatatcctctacttctacgttaaaaacttgttgacaaaataattaacgttttaaatgttacttaaattgcagtattggctattgttttggttggtttgctgtatggattcttcatagctataatatgtgggcagaggatcacagaacggcattaccatgttcttgcaaagcaagagttaaccaaggttggttaaagaacataaagatggaaacacaattttcattgactgatcttttcattttcaagaactacactgtgtcattgaaatattaatagtagtgccatcaactgttcaatctgtatatgcacaaaaacatgcagatttcttcatcttttttttttttacttattccaaccattacatgaccttataaggttgtgaacagactctctcatctctatttgcgaaaacaaggttggtttgttttagtgaaattaaataaataagttgtgggtgtattagtaataagggtgaaaagactgcctaatcaatgatttaatggtagaccatgatggccccagcagggaacacaaaatgaggtttcttatgacataatgtagattctttcttagctgacagtttttttatgatgcgaaaagtgttctatttacattcttcccttttccttatggccaggggtgtagccgagattcttccaagcctaggactagagcattgcctttgttatagctttttttgccatgtgggacctgagctctagttgccccacacatggttcccttcctgcctatggcatattatcttcttgtataccacataaagcttgtatttaaagttctattcacacctcacagtatttgatattcctctgatggcaggagtatattgtagaggatcttgaaggaactgatggagttcctgaccttgatcctaatcatgttacagagctgaggattctggggctatattgagtactggagatatcatcaattcatcaggtaggaaatttagcacttgtgctataaaatgtctgtttagatctttttatgtggttgctacttcctcagagatctctctttgcatcctacaaatgtagcagagctcttgattaacaatagccacttaaaatgataaaatgtggcatcaagcatctcacacatccatattttgccccagacatatgtttttggtcattttctacagttttgttttgtactaatgtgcaatgcatgtgatgccaaagtatttctggataatattttatgatcactgaggttttgctactgcgtatggtcagttgaatgccacaaatagttctttcactgtgataagatgaagaaacttgtacagaagagccccgttttttaatcttttttttttaacctaggagtgcttatagctgacttatatactagtgatccaagatgaatcattgtaactcagttagatcttccacattttctgaaaacagttggattcagtccttgagagttgataaaccatgcttgatgtggcttctgatgaacagattcagacacacctcaaaatcttagtttttttttgtttcatgggaacaacacttggctaattcaagttacaatacaaagatttcccaccacaagggacgtaccaacttgatttgaatatgccatgagccatgaagagtgcatacattttgatggagaagctgtagatatatatattcatagcttcaccttcctattgagatccaaaactaaagtaactgcattgcaataaccaaatccatcaattgttgttgtgctggcataaatcaggctaatttctgattaatcttttgtactatttgcaatgctattacttggcttaagaaagagcaaataaaaaatgtgattaaaagacctgatgagatgatgagaaaacgggaaaaaattataggagaagaaaaacaatgtagtcggaagaaaaaaaaaactggaaggagaacaagagtgtgtgaaacatttttgtcaagcagaaatgtttgctgaatggaggaacaattacatggaaggtctgtggatcagctattatctttggagtagtccctagtgccttatctaaggttatgccctctattatgagattgcctcgggaacaagtttttaagctcccataagggtcggctcctctgttcatgaaagacctgctgccctgccctgctaggctgcttgcgggcccagtttcaggatgtcaaggaagttggtgaactgatgataggaaagcaaaagccctgtaaactatggccatagccataacatccaaaggtaggtttatacttttgttcctttagccgaaccttatccatgtccttagtattattttgttactgccttgattttattctatcaagtttctgctgaaaattccaaagacggataaatcttcaatattcataccttgtcactgttccagtaacatgcgggcacccaacttggcccagcaacacctgataatttgcttgccttgttggactagcccagcatatccgctgcagtggtgctagaatgttctagctatgctcaatagagcaaaaccataccaacttgcgttaaccttttggatgaagaacataagcaccattggttagctggtgtgctgtagatatacattgcatgttacaatacacgaaaaacagatttcttggaaaataaatgtccttttcttacctaccgttgggagcaatgtcagagacaatctcttggaattacaaaactactccagcacataaagactttctttgaactcacaaatcaagagcttgtccttgagctatttcagcagcacattttaaaataaaatattttgtttccattgagttcttgtgctctaatttgtaaagctgaaacagtagaggaatcgatcactgatcagtttctattggagcagctataatttctgattggatagcttaggataaaataaataaatagaaggagtttcaggatgaatttgcaagcctgttctcatcagttatcttcccagaaccaaacattctgttcccattgcccgctacttaagcgaagaatatattctcctatgcatataaatttggtagtcttgcaggcatctttctgaaagtagcagaatatatgggtagagactagagagtactgttttttgttatattgacatccactaataaagcatttctctcttagcaaacattctcttggcatttttttttaatcttgattgcgtgttcttgatcttctgtaaattcgttttacttgctttcctttgtcagttttgcctgatacagtaataccatccttcatttttccccctttttcatgctatacattttagttttcttatctgttctcctctgcttttgtttacttcagtgagcaaaactgtcaataaacgaaccatcattctgctgtagtacttgcttcaaaagattgaatttgcatttatatgtggcaacacttgcatcacctatgactagtgtacattaaatttgggcaagtcaaggctgcacttgtctgtaaattttgtcaatgtgggttgccaagttctctatgcatgttagtgtctcttgacaatggcttgaatctgcttcccatttccccacttttcaattttatatcctggctttgtcactaccagcctagactacatgggttgtggagtggagatgatttgccaattgtgagcatgtttttgccgtatcttctccaggtcacctttagcttgtttctttgtttttcagaaacacgacaaatataacaagaacactattgattgaagaaaaagaatgttagtgccatttatcaaccagacaaatgtttgattagccactagtgattactaacggaagtgcttaacaatgaccgcaaacttttggatgattcaagatctaggtatcataagttcacaacatcatatcaggatcatgccttcattgatttatggaggaaatacgccttgggtgaattacctcctctggggaccagggttcaagacaaagactcttcccttctcttggggataaaaaagagctcgatagcttgaattgtcatcatatggccagtgggatcgatttgggagttcaaaaaacaattagaacataagaacaatataacacataaaaaagggacatgcacctgagtcccttatcactcgtaactattttcagctgtgctctgtcatggtcggtgcaatgattgtgtagagaaggccatttattgctcttgagacaccgtgttgatgcatctgaaccaacaattcatgatgacatactgtttctctgttatgcaactcaatatgctatcacccagacaattgtgcaaggttgggtgtagttggtgaagttactgaaaatgtgttgggtgatagaagtggtactttgagaatcagttcatgccatgtatgtttccatcagattcatctctagtagccctaaatgttcttaccatttaaattcttgctgaatcattaacatcaattgcaatgcctaaccgctgtgtttatttcatgtgtgttacactagaaaactgtatcacaacatgtaatcaaaaggaattttgcttttggaaaaatgactgtcaatagcaatattcttagcacattttgttaagttatatggtgaattttacttttctatatgtttttcagctaaatgtcgatgctaaaatggtcatatgggaaaagctctgtttagatacaaatccataaggctgatgctgcacggacatcatccagaacttcagcacaaggcatgacaaacgggcttatctgcgttttggaagacatgtttgtctgaaggcatccaatagagtttagagctatttcccttttttccccatgtaggataaattgctctcacacaaaaaggagaataaggtgagtcccctcagactctgaatcgatgatgaggattatgatagaaatgttaggatgccatttcgaatggacattttattagatattacttgtctcttcatgttcacaataaacatgaatagttataagaaaatgaggtaaatagagacgtatgcaagctttgcttttctgccttcataatttgcaatgcacatgctgggcatgtactggatgacctttttaattgtttctcccgtttctgattttctatggtttgctagtaccttgggacttgggatatgctgctgaaatgaagggcaagcatgtagggcagtactcctgccttgctgcctgcattttcacaaattcataatgtagcaaacacctctaagtggacagccgatcattaaggatccagtggaaccatctcatgtgcaaaagtggacatgattctgatggacacatgaactggattctgaaagttcttggcagcaaccctaacttttagcttgagcattgcacattattttgcccagaaagctcttcattttccttgggtgatcagacaagctcacaagcaacataaatttgactaaacagatggcaccaatccacccatccattattagtttctaatgttaggtcaactacacacttgcagctacaactgctgaacacaactttgacatacagttgcttaactttgttcctctttgatattgacagagatgatgttttctctaacatgaacacgtgcacagcaattaaaaatatcgccttctcgttttgcacaccaccttaagcaactttctcagctttgatcctgagtaattaagctaattaatgcaagtatgcaactatacaagattcaagcttttgttggaagttgaagacccactcactaatggtgggagtctaaagttaaactgcagcagcaagagcccagaagcaagcaaccatatgtacttaatctggcaagaatcactgcaatttgttctccatggcaatgcattgatgaccaactagttgctgaatgctactctgatggtgatgtatcatgattatgctgggtgacagttacagatggagacttcagcttctctatgccaaagtgtcccattggaactgtatctccttgattaattaggtggaggaactgagacttgatttgggtattagttaataaatgctcatcatccggggtttctgttgcataattaagacttaaccaccttgcaattacatatatatgatagtattattaaatgacaagcaactaaaccaataaaatgaaggtcaagattgatggctacatagggtgcttcagtctttgctcaactgggagtaggatcctaggttcacagtgtggtgaagctgtctcttttctagtcgtgcgatcataaactgaaggtcaagattgatcgctacagtaattcatcctgtcagatacttgtaacgagaaaacaatgacaacattttccctaaaaaaaagaaatcgatgacaagctctttctctctctctctctctccccctgagaaaacaatgcatagtaaaaaaacttccagtccaatatggacaacagatagaattgcagagcattattgcaaataatgtaatcatttaacaaatatatccatggatatgccatgaaatctgtaccataagaaaacaatgcatagtaaaaattccaatccaatatggacaacagataaaattgcagagcattattgcaaataatgtaatcatttaacaaatatatccatggatatggcatgaaatctgtaccataccgtatgttcttgaaatatatatcttgtttatgcggcaagaaacagaaacctgattggtttatggatcggatcaagatttttgcaccaagccaagaaggaatgtgatgctacatcaaaccttgatatctctctgtgcctccacaggatgacagtagctctgcactcctgaatttggaatggaaaacctcatgtcaaagaatttctggagagataattatgatatcatgttatatcatatcatataatctagtagcacccttttgaccaatgtgcctcttcagccacagcatcgagttgctcaaggtttctctcaacttgagatcaagaaaattgctttcaagcactattgtttaacagtgggattcaatttctctgacaatgacatgcaattccaatttgcttaataatatgaaaaaaaaagacagagatgtccaatggaatcagaggagaggtccatctgcagagctagtgttcatacttcatacgcttggatggatcaaccagccatttgaagcagtgattcagttaagctctcctcaccctaaaaaagagagaacagattaatggagaactccactaatatcatggtagagaagaactttaccatctagataattttgtgattcttaacttagatgagctagacaaggaatcctttgcttccttcttgtaatatttctaaaactgcaaaagggattgctaaaaggtcaggagcagaaagtctgtcaagtaaagtttaaaaaagtgcactcgatcatgcagtctgatggttttaatcctttcagagcaaggcaaatgcagctttaccacacaacactgcactaactgcaatgtcaaattgagccctaattggtgcatagctggtgcctctaagctagttggtctgtatgaactggccagtcaacatccataggtgcctggaagcttcagactctcagaaagttagtacaattgtgctaaattgaactgaattatacgcaaccatgcagtgggatttcccctctatccaggatttttatctttgtacaatttctgcaattcctgcacccaatcagtggccacaatctcattggctggcctccaaatggatgtgaagagcagtcactctccctgcctgctcttcagagtaagttgctactacaaccttcaccttccatgaatgcacattgcaaatctgcaagaacttcttatggcattgcaacagcctgcttttgaggccttggttctcccttgaactccacagacccctatccttcgcctcacacggtgatcatgacgggttctttcgtcgtgcatcccgccaataataccgcctttttgccttccattttgctcacatagcgtgtcaaaaacatatactaatgtgaaagtaaaagagtaacagctaacgatgtgtataagaagagagtagtatggctactttacagagcagtatgtatgcaagttcagttacatgtagcaaacaaaagcaaagaggcagtgtgcatgtgtgagagtattgttttggttttatttttatccttttccatttgcagaaaaggtgctccaaaaataaaaataaagcaggccgaccacgcatatttccctgtggccgatggctacctgcaacatggaaatgcaagggaagcagacaaatttattcagattctgccaattgtctatgcaattctttggtagaataagatggtcctggtttcgaatttttaatccttgcgctttatgctcttcagggaagtctttgaaacgcgtcgaatttcagaatccggtgcaagtactcatgaggatcgatgatgttgcgcgattcatatcgggctcaagaacatgttcctgacctgtttctgtttcaaatgcctatcaaaatgctactttgaatcagcttgaatcaacccaatgctgacccttattaacaataaacttttaacagtttttatttctgtttcaaaataaaggatttacatttcatcatgcaaacttcaccaaaatattgaatcctctaattaacaatgactgaatctaatctggggcttgcactgttcaagtactgatggagcaatgtgactgaacatgaacacagcagcctttgtctccaacacctccatatgagtgctaagcataaggcatcaccggccacatgggattaagaaacacacaagcaggttagtgcatgcataaaccccatttgcagcaggtcataatcagtattcaattgtgcacaagtacaattctgctgaggtgattaaaaagtgggcagagccttggtttctgcaagaaggaatcaaaaagattgttatttaattccagtaagccatatctcagcgtgatagatcatgtttgcagtgcccactatgctttggtaagatctgaaatttcatccactattaagatattcttatcttcgataagtaatagttttagccacatttagtgtgctttgaataatatcattcttctctttattccctggagaattattgttaagggagacctttattccatttcttgttcggccaattaatcaaattgtatatttaaaagtgtttattctggtgtaacctttgcatctccagataagatatttctgtgtcatgtctatgtacaataatcattttgtattaaaaaaactgttggctgatttacaagctgaaaatcagtcagctcagctaagaaaaacttaaattccctagcatcctagccttgtcaagtttctgaagagagatagttcttatctcaaccaccacggcatactactcaacttcactagtctcatgtataatgcatgaaccaacctttggacccaagtgacactatgatccaaaagattctgttttttttttgtgctcttctattttccatcctctgtgacatctacatctttaaaagttaacaataattgctaaatgcaaatcagaatcacttcaaagggttaatatataatggataaatatctgactaaattatttctctcttctccacaagcacacacaaacaaacacaaaacataaagaacttttttgacacaccaagtcatgctaaagtactattaagtaatgcagtgactctagtgcaattgagtacctgaagaactttcaagataccaacaggagaaccaaggtctatagttcttttctgtaggaagcattttttactatactactatatctacaagaaccagagttttccttctgcaatcaacacctacttactttatatatatatatatatatatatatatatatatatatatatatatatatatatatatgtatatatatataaatatatacatatgtacatatcatgtagccggatcaaaacagaaatgtagttgtgtaatattcacttgaccaaagagaacaaatcttggcaacatatgtcatttaatacaagtgaaatcccaatcaattcaaaccaataatactcatatatttcaggatgtcactagacttgttagtccttgtactcacattcagagaacatcagctaaggtccccatcggttggtctagtcttattataagccataacggtttattagcgattaaaaaaatgatatgtgagtaaaacttttgtatatatattcttagtgattgaaaagccaaagttaaaaaaaaactatgttgaaaaaggatcaaattcaaattcaaaatcaagttttaaaattcaaattttggctttagcttataagccatagggcaaacgatgaggcccaaagctacatttctgcaggctctgaaacaatcaaaaccatcaagctcaactctcatctggatcgccggcgatggccgaccggagcaatggcggccggagacggagaaggagaatattcttggttggttcttggtgatatttgtttccctcttatgtatgcaatgcaatatgtgggtggtggagaggaaaggtggtggctgaggtgaggtgagaccaccttcttggcccttgattccctcccttttgcagcatgtcctctgcaatctccactggggtgagagctggctctactccatcaatgtagcaacctcccaggcaatgagtcaagcattgcagctagccaggtccattgcaccaattgcatctgcagatactgcactccactgcactgcagctgcagtggtccattccattccatttcactgcattcagtatgatgtagtgtaccctaagtatgtatagtgagactgtgtgtacatgaaccagttttttttctttagacaaagtaagtttttatttaacttagccaattacatcgaggaaatacaattgtactgagctaagcacggtctggtctctacataactaggatgcacacggtcaaaactcacgctcgcacccttacatgagctagttagcatggtgcattatgtgtatatatattttacaattgtcaatcacaagttgggagtggttggtgatctgttactccagttatacccactggaagatcagattcatgtgtggcagcagaatcaccaggaagcatgtggtttggtgggtaccaagatacatcatgtgagctggagccagatgaaaaaaaatgaatgaatgagggggtgtttagatggggctaaaactttttagcccatgtcacatcggatgtttggacgctaatttggagtattaaacctagactagtaaaaaaactaatttcataaatgagagctaatccgcgagacgaatttgaagtatttaagcctaattaatccataattatcaaaagtttactgtagcatcacattgttaaaatcatggcgtaattagactcaaaagattcgtctcgcgaatcagtccaaggttatggaatgagttttgtaattagtgtatgtttaatactctaaattagtgtccaaacatccgatgtgacaggacttggaataagtctctagaaagcagacaggcccgaatgaattgagctgaactgatgaaaaaaatctgtgtgctgctactgctgcctgtgaatgaatgagaggagctgagctacaagagttgtctgtcactgctaggctgctgctactgttggtgctgctgccattagttttcagagatgtgcaacagtgctggttggtacatgacaactagaaagtagtcttctagtacactcaaattcccaagaaaccaacagaaaaaagatgtagtagtggtagagaataggggggagaaaacaaagagggtaatttggagaatctctttctctctgcacaataaccatcagtactgtactgaacaaattctgagaaaaaaaaaaagaagagcaagcaagaaagaaaagaatactaagccagttaatacatttattcctgccataaaaagactggctgttgtcactcttattattcccactacctgtggaatattaacaagaatttcctgcagattgattgatttaatttactaccccaacatgtccatgagcatcacaaaaatgtagtactagttgcaacaatctgaggctagtagtaaagcaccaatataacattgcatctcaacacagtttagtaattcttaaaaaatataagaattactaaactgattaattcaaaagcaaacatacataccatgagtccatgagacagcagagagagagagagagagagtaatagtagtagtaattatatattgcacttccttgatttgttttgacagagaaacagaaagcttactgcctcattaatccttacatagttggagtacatgatgatgatgatgcatgcagaaggcttaacttaaccatcacttgatttaccaattacacaagataattaggccattaattagccctagcagctagcttagcttcgttaggtgcagtgcttagttgcttacccccagtggcaagtactgtaattttcttcatcttcttcttggtctctgccatggcagcttcagcttcagtgtttgagctagcaaagctggaacagctcgggggaggatctgaagaggtcgtcgaaggcggcggagtcgaaggcgaggagcgggtcggtggcggcggcgacggtgagggcggcggcggcggcggcggcggcgccgttggtgttgatgcaggagaggatgtctttgagggaggcgaggcgcgcggcgagctcggcggcctgggtgcggaggacggcgttctcg

SEQ ID NO: 61110 - DNA, 5022 bp, Oryza sativa
aaaaaaaaactttatagtactataattaccatatttgtatgtatcttggtttgacccatagcatagagggccccattgactctcctaccacaccttttcttttgggtgcctagggaagttgcctagttgcacatgtaattttatactccctccatctctaaatgtttgacgccgtgactttttttaaatatctttgaccattcatctcatccaaaaacttttatgaaatatgtaaaactatatgtatatataaaagtatatttaacaatctgacatttattacaaaattaattaatagacacttaaatttttgaataagacgaacggtcaaacatgtttaaaaaagtcaacggcgtcaaacatttagggatggagggagtagcttatagtttccatcatgaattatcattttattgtcaataatgttcgaataattccatttcaattttcttatatcattttcagttttcactttaacctttttgataggtttccaagaaaatcactattctactctgctcccctacatatatattcatatgcacgcaaacaagagttttaatcaaacagaattatgaaagtttctaattcggctaaattcattgacatggtcacatggcaactcaaaactccgtccctgaccatggcaactcaaaactccgtccctcgaaacatcgtaaacagatactcataaaggaagttgtttaggacaatgtttgactcaaaccttaggaatataaatcataaataatcctcaagttgttgagttttaaaatataaaaattatatgaatagatttgtcttgaaaaacactttcataaaaatatacatatatcacttttcaataaacatttttatagaaacaagaagttaaagttgtgttttggaaaccgtgtcgctgtcctaaatgacttcctttatgagtatggagggaggactacaacataatttagcacttcaaacacacaactgaaagaagaatcaaaagatcagaacagacttaaaactaagtctagcttgtttgtttgcttatttatttattcattcattattaatcacatctcggacggcctggtaccgattattacttcaaaaattcaaataataaatacaacaacccacaatagcttgaatacagacaatgagtataaacacagacaagaccaagcagtctataagaagaaattaacacttggaatagaatacaatggtgaaccgtgtcttgttctcccaaaaccctctaatccgctcgagattggcccgcacgagagaagaggatgataccaacaatcaggccatacagagcaagagcttctgcaaagataaggatgaggatcatgcccacgaacaactttggctgctgcgcattggccctgcagaggaggtaaaccagaaccaaatgtcaatttcctgcaaacaagagtgctttacttacaatagtaacagatagaaagaaactctatctgctattttgctcttgatcccagtttgatttgaatagatctcaatagtctgtactcaggactacaacatagatatgctgatgtaaaaaggggcaatgtgaatcctccttgactttataacagttaaatggtagcgatggtatatatgaatcaaagcagtatgggtgttgcaccgtaaatcatagaagataggagttgtaactcttgtaatcattatccacaaaattcaaggggcagtaaagtttctaaaagaagctaactttcacttgtaggcaaataggcaatcgaaaagggttatcaggatcctacgacacacaacccatgttccggagtgcccccaagacagatgcctagcacatatactcctgtggagaatatccagcctaatatttcaatagctacaaccgaactgataccataggaagaaccatgaatgacgaaccacccatacccagtctgaaatcacatctaaaagacattctacaattcggtgtgaatgtagcactagcatgccaagatatgtaatggcaacaatgctgtcgcttgcccaatccctgtaattacccttgtaatgtgacctcttatcaatggaaaattcaggtgggggaacctctcccctctggtgattatccaaaaaaaaaaaaaaaaacactagcatgcccattgtctgtcatgcatgctaggatgcccaattgaggaagttataagccaacgtacaggttgaggcacaacattgtagtgtaaatttgaagtttcagcagataaaaaaagagaggaattcttgttctgatcaaagactccaccagcatctagcaatcaacaaagaatgtagtcgcatgctattactctaatagttcagtcatcaggattcggattagtaaaatgtgggcaggctaacagcaattgaaagcttaataataataactactcccttgttgtaattagtagtagtagatgggactgaggaggggaatgagagggagggtacctgactccggcgtcgccgacgatgccgatggccatgccggcggcgagaccggcgaggccgcaggcgagaccggaggagaggtgggcgtaaccgtcgaagaggaagtagggcttggccttggggttgatgccggtggagatgatgacggcgatgatgaggccgtagataccgagcactccggccatgacgacggggacgatggacttcatcaccagttccgggcgcatcacccccatggacgccacgcccacgccgctcttggcggtgccgtaggcggcgcccatgccttgcatgcgtcgtgtgtcaacctcatctcagatcagatctggccccgagaaagtgaaggggaagattgggagcttacaggagaatacgagggcggaggcggcgccgaggaagccgaagaaaggggcggtctcatcgccgctgaaggtggaggaggacatggtggtcgctcgccgtcgtcggtgagggtgggatctctctcgccggccgccggaggccggaggagtcagagattggtattggtgccgtatctcgttgcctcgtcaacgtgtgtggacctcacttcatttatatttacttgctctcttcatattacaatcactttaattttttttataatcaaacatttttaagtttaattaagtttataaaaaaatataataatattttcaacacagaataaacgtattatatatttgtctaactctaaaactttttgggcctgttttgatctggcaacacagcccaaagagattccacgtcttgaaattcctatacattagcaaatgtgaagccaacaccattgacaaattccagcacatacaaaagcattgaatatgaaagtatatgctaccatctctattcctacaacaaaacaactaaccatcaccacgaaaaagttagcgactcaagccttaaagcgtgtcactggcttgatcatcgacaacccgacatacaaatcttactagtttttcaccgagaacctcaataaggtaactagaataaataaatagaagaaacaaaagactacacatctgatccatgaaaaatttgaaagacaaaccctagacaacctaatagacctaattctataggaacttaaataaagataaaaaaaacttgggaaagattggatcctactactggagacggagggtgaaggtgatcggatagaaactgtgcgatggaggtttagagcgccctgacggacacgagcgcctgtgagccggttactatatgctaatacctcattgatcttttggtaaaaacatagcatggagtatatttgtaagagaaaagtttgaatcttaggacattaatttcactataaacatttctattaaattcatgacaattatatgcatagaactttcctaaaaaaagtttcataatattataattttatcagaatttctacagagaaaaaatagttattaaaacaacctttgagacggattaaacttatatttcaaaaacattgtaaatatctgaaacaatttctcttaaccggaaacaagtaaatgaattaagagtcgtgaggtttcgtgggctcatgggccatcatcatgatagcacagccaattttcacaccaagcatctcaattcccaatttcgcaaagtacactgtgtcgaaattggttgaacagaagcacacagcaaacagcccgacatagctcttattactgttcattgacaagataagcccgatgagcccggcagatactagatcaactaggtgaagtgtacaaagaaaaaggttttacgatattgaaagtgtaatatataggccaattatatgcattaattacaatggggtcaattcagtgagagagccaacagacaagctttcatttcagttgacccaaattaactttctgcaaacaacctaaataagaattactatgagattttacattgttgtccatatgattcacagaatagtcccaacagtaaattcaggcaaattcgctggccatttttgaattcagggttaacgctgccatctttgaaattcaggctaaaaaataatgagaactcggggaaatcaggaaagaaaatgtagaaagtattctgcagcaacattaatgttttcgtccactgctcttcatcgtggagtgcccatgcaattaatttgttgctgcccaatttgcatccaaacgccaccgtacaactgtcaatttgatcgtggtgctacactataccactagtagtatcaatttgcatgaaaattatccatatcgtactatagtgcgcctgcctttggattggaggagacaacatatgcagccaataagcaatttgtgggaaaagaggcaccccactacccatgcattcaaccatagtatatatgcattcacttgccaaattgctagctaggactacgcgccctttgaatttgcatagcttacattaattatattatctaccaaataatgtaggatcatcaaaggctacctagctagtagagaacaacaagatgcacaagcataaatggacaattttggatagtttttttagaacagactattttggatagatggatatgcataagcatataattgataa

SEQ ID NO: 61111 - DNA, 1287 bp, Oryza sativa
ttgcggaagtttttcgctcgaaaatcatattttcctggcggccaggcatcggatttgtgattttttattttgtgatcaaaatcattttccctaacaatcagcgtaacctaactgtggtgaagttccgcctgtaaagatggttcattttcattggcctttagttgctagcggtagcgccggccgtcatagagaacgcaaagtagccgtcaggaaaaacactttgtttttaagtagtgtcggttttcttcgatgttgcatgcagtggttactttagtgttgcaattagtatttttaatgttgcatctgtttgaaatatttttagtaagtaataaattattttttactaaatgataaaactccgttcgacgtttttcttcaaatcaagcgtacaactaaataacctgcatacttttaaattacggcattataatctgatatggttgattttaacatcaaattaatcaaacgtacgcactacaatgacaaatccgacaaactcatgcagtattttatatgcgtagtatatatagacagatacatacatttcactaatcaacatcctgcctacctttactgaaagcaacgcacactgctccagagcaccaaaggttagctagctgaatcatagatggtccatgatctaaacaaagatctaaatactagccgtgttgactaattacatgtactgattacacatttatacccgtaataatgcatcatgcatgttaagccatgcaaaagctgatggttacgtgtacgcgatcgataattattgatttaagccttaacgagcaccacctgcagtgaccctgaaaacatccaactcacctacatactatacacactgtcagcacagctacctgcatccaccgaccgtctgcactgatgactgatatatatgttgactggcgaatgaagaaggagaagaagttgaatcaaacttcgtcatcaatcagcagcagcaaacctccaacagaaatgcagtcacctacatgcatccatgatccatgtaggagtaagcaattattgtcttttttttaatccttttcctttggtcgttgtataactttacttcattagcttggcccatcttgtttttgctgctactgttctctccggtttagaaggtaagatgatattctgtttttttcatactgaatttatcgaaaaatgtaatgacatctacatgacttaaatagttttattaagtccatcgtttccttcagacacttattaaataggtaatttggaaccataccattataatttttcaaagtttaagatatg

SEQ ID NO: 61112 - DNA, 584 bp, Oryza sativa
  unsure (1)..(584): unsure at all n locations
agggccggggccggggtttgtttagttcaactaagctttcgcttcaaaccagaggggaacttattacctgggtatcccactgctacatgaaacaccgacccccccttttggggttttcccaaaaaaaaatccccccccaacttagtggcttccccagtacataggctgatcctgcctttctttttatcgtaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctccccnnccccaaaagaaaaggggnggggtttaaaattntggggtatatattgggccccctcacatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacag

SEQ ID NO: 61113 - DNA, 1116 bp, Oryza sativa
tccagatcttgtcggagaggccgagggagcggaagaagttggcgtccatggcggtggctccggtgatcgccatgttcgctcccttcttgaagtcggcgctcgtcgacttcgacggcggcaggaacggcagcccgaacttactcgctgcaacaaccaccagccgccgccgtcagctcgccggagcaagcaaaccaagaagacgaaggaatcaaagaaagaatcaaagttaccgaggaagtcgacgacgacgcggccgtcgcagcagcggcaggtaggggagccgaagtaggtctcgccgtagggaggctgggtgaaggtgatctgcgacggcctgccattggtgcacaggttgccggtgtccgtgatcgagtccccgaagttgtacaccgcattgtacttctgcgccgccgccgccgccaccaccatcgccgcgcacaccaccaccaccaccctcctcgccgccgacgagctctgcctccccatcattgcaaagaaattaaaacagagcacaagccaagaaaagaagaggagaagcagagcagtggatgatgtgatgatgcgtggaaagggcaggggtggcgcgttttataggcgtgaccgcgtgagcccgtgaggaggcgtgaggcccgtctgcctggcgcatctggggacaggtgtaatgtaatgcatatcatgtagtagtagcaatgtaatgcactatcatgtgtgcactttaccttttcgtgccgtcggtattcggcaagcactgttcctcccggatccgggtcctctaccatgcaccgcccgatcggtatcggacggtcgagatcgtccgatacgtcggtcggtttgcgacgatatggatatttgttcccagcaggggtttattatcccgggagaaaaccggttctgatttcgtgaaatctggttttttcggaccatgtctaaaacataaaccgctcgggtttttgtgtgaagttaaaaaattaaaataaaaatggattattaatttttttccagatttgttcggatttcatcggttttcttttggtttatcaatggtttctacaaaatccgaagatactgctcgtgagcgatttttatctgatatcaggatagcgaaccacagtttcaagg

SEQ ID NO: 61114 - DNA, 628 bp, Oryza sativa
tgcgttgtatttatattacattgaatagcatttgtttaattaattactcatggtgacttttcttctcaaagtagctcatttaatttggtggtatgctattagttactactttcatcctgcataacttaggattacgccatttcctttttatcccctctaatcatccttgtttttcttcttgaagaaattcatccccttttagcaaggttagggatgcttcatatcacaataacagtttcttgaattaaaaagttctcaagctcttctcacttctcagcatccttatgttgacagtttaatttgtgcttgccatcacctgttaaatttcgactatacctatcatttgcagtgttactctccagattctccaatatcagatgggtatttcagtgtccttgctgaagtatacatgcgtcaggaaattccaaagtgtgagatccagagaattttgagcttgatcctctacaaggtggttgatcaaacaaaactgatccgtgatagtgcccttcaaatgttggagacactctctctccgtgaatgggcggaagatgatgctgatggtgttgggcattaccgggcttctgttgttggcaacctgccagattcctaccagcaattccagtacaag

SEQ ID NO: 61115 - DNA, 611 bp, Oryza sativa
aggtggttttggttcaatgacatatcctgatgatgttgaagagacactgatccagaagaatcttggcataattggaatgagaagagtcagcattgtcattggaaccatcatctttgattttctcaagttgatcatgtgccggctccactcgatgaacagataggtggttttggttcaataacatgtcttgatagtgtggaagagagatcgatccaaaaagatcttggtcataattggaattgggagaggcaacattagcattggaaccatcatcattataatcatcttcagtttcctcaatttgatggggtgttggctcgactcgaggaacaaatatgtgttttttgttcaatagcatatcctcataatgtggaagagagattgatccagaaggaacacaaggcttgggtattggaatttcattgcatttatgtgctatatcaagcatctcctgtccaaagtgaagatatccgtcatgttacgacaattttttcatgtgtatatggacgctatagcaaccaattaaataatgattgaacataggatcttataaaattccttaagaatagacccacaaaaagcccttaatgggctggcttattgggaaaaaa

SEQ ID NO: 61116 - DNA, 525 bp, Oryza sativa
gattagatagatgcgctcgctctggcggcgcacacaaaccacaccacatttattagctggggccaccatcaccaaggcgggcaggagtgctgcttctttgactcagatgggctccattcacttaacatctaggagaacgccatagagacagatatacagaaagagcgggagggcttggctatttgtaccattgctgtatcagctggggccggccagcccattccatctttaggagtaccaacttactaaaccttatcccatccaatccgtcatttatctatctgcatatactcacaagaactctcgatcagtcaggctatcatcttcttcatccaggcaaacaagtactagtgcacagcacatcaccattgctgcttcagttgattattatcatcgccatcgccagtaagcacagcactctctcttgtagtgcccatgcaaaacaccaccagtagcatacatatatagtacggcaataagcaactcgatgatgcatcatcataacaggtccaacagaggactact

SEQ ID NO: 61117 - DNA, 2388 bp, Oryza sativa
ggcaaaggctattgaagcaaagaaggctcaataatcccagatcagggcaggtctctgatagacataatgtctatcctgaggatgaacgccatgaccgtcatcgtcagcgtggtgaagagcaagcttccaatgacggcgtctcaagctctcgattgcgtggtagaataagacttccagcggaaacaacgtttgacagacttggcttacagcctgagaaagagagagacagagggcctcgagctagattgtcaccaccaagtcaaacagaccttagagggaagcttcatgataggctaaaggctaaaccaaatgaggatgtatctggtaatgtacaaagttctttgtcaaaagcaaatgaagatgctgaatcgttgaactttgctgggccaaagagccttgcagagctgaaagcaaaaaaggttgcaggcagtttaatgaagagtagtcgttctttaacagggccagttcgaatgacatccgaaatagttaccatcaaagactcttcggaccctgttctgtttgatggcccaaaaccattaaatgccatcctgaagagaaaaagagaggcagattctggaaatgctaccgattttggcagcaaacgggaagaacattctgggggagatgaagaaggatctcagaatgatttccgaaacatcgaggatgacatagttggaatgaacaccgaggggaatggagaagaagccttccaacctgaagacgatgtggtgtatggcgacagcctgtctcctgcggatgacattgctgctgaagctgcagacgatgcgagcagggagctggaggagcagcaagatgtagagacagcagaagagtacgactacgagatggatgacgttaatgcggcggaggaaaatgactaccaggagtatgaagacgaagacgatgatttggaggacgacgacgatttcgcgcgcaaagtgggtgtgatgatcacttgaagctgcgttgcagtaggcgtgccactatatatggtatgaccgaagaattgaaagatgtgttagtatccctcccaacaagatgttggtctgtttttcttgtggtgctagatacttttacttcactgcgccagagaattcagctaataaagttgggaggaagataaaattggctcatcggagagcttgtgtttcagccaagaggcggctgcttgtactctaatgtgtgggtgtgctctcctctgcctgcttgtgttgttgtatcattagttaaatcaaaatgacctaacaggttacacaatgtactacttctatttatattcatcagtgtataagatgataaaaggccttgaagccttttctttctggtagagaatacattgctcttacctccagatttaacatttcatttttcttgcttttgaattgtgtatctcatattgcaatttcgatctgtgtcgctttgctgggtcgaacacagcagacagttcattcgcgtatatttatgcacaagaaaactgtcaccctacaaatcgatgcctcagatagcaaacagacaagtcatggcgtctatttttccgtcttaaaaagtagagtaggagatgagctcaaaaaggaggacgagaagaaatttatcatctaaacatattatcttcgaatactcctacaaagtattacatacatatcaccgtataaaatctgccgtgcggtgtttacatcacctttgcagtggcttcaacaggtctttgagaggccctcgccgctgaacattcttggcctgctgtttctctgcgttgcagctgcagctgctggtgttgaggttttcgccgcagccaaggcagagacctttgcaggtgggactgcacagggcatcgagcgtgatctccaagtgaatgatgtccctgatgtgctttgagatatcaatctccttttctccagctgggaaatgcagccggtcatcccaatctatatcttcatcgtctccatcttcttggcttccggttagcgaaggagctttggtttgttcttcttcaaatatcgtgccgagatcaaccacatcaggttcctctactctgtcttcggtcagtaagagggaaaaattggcaaatataccttgaggcgctggctcagcacacctgaaaatgaagcacagtgcgtttcagtatagcactatcaaccttgtcttcaagttgtgccagaattaaattaaccaaaaaaaatagcctgtttctactttgtgaacaactcatgtattgtcaacaacgaaagtgatattcactgaatatatactagttgttacgtcaacaaaaaaaaaactagttgcttcatattcaatcctccataaacctttattatgcaattactagatatatattatattatttcaaggtttgcacacaagagcagcttagtcggacaataaatttggaaa

SEQ ID NO: 61118 - DNA, 1181 bp, Oryza sativa
aacttttctgtcatatcgaatgtttggacacatgcatggaacattaaatgtggatgaaaaaaccaattgcatagtttacatgtaaattgcaagacgaatcttttgagcctaattgtgccatgatttgacaatgtagtgctacagtaaatatttgctaatgatggattaattaggcttaatagatttgcctcgcagtttactggcgaaatctgtaatttgttttgttattaatctacgtttaatacttcatataggttcgtatatgttaattttttttttgaaaagtaactaaacacggcctaatactaaccagtagagaccatggtatatttacctgtttccctagtcacagtcaaaacgattgacgcagtaacttacaagttgcccaagacttagaatatgagttcatacctcactatcaagactgcaggacttttagttattccggaatcaatatccacaattcgatctctgacacacacatagtcgcctatgaacactggaaatgaatatagagagaaacatttttgaaagaaataggagggattatgctgagaaaggaacttaattattttttaaaccttttttattttttaattttaaaaataaacccttcaaaatttatttccacaatctaaaccttttggtcacgctaaaactgtcacgcacgttgcaccgttgcggatggtgtgtcagtgatgttttaccatgccaggcgggctggcgtggccaaatgattcagattctagaaataagttttgaaatggttcatttgtaaaattaaaattttaaaaagttcaaaaaaaataaaaaaaatcatgagaaagagcatttctaacctaagcactactctccttctctatcaaaagtacctccccagggcttatctagcgagtctcgcttaatcaattcatagtttcgctcccagcgtagcgtgtgttcgctgcagcctgttaccggcgttagctatccattagcacgtgattaattaagtattaactatttttttaaaaaatggatcaatatgatttttaaagcaactttcgtttaatttttttttcaaaaaacgcgccgtttaacagtttgaaaagtgtacacatagaaaacgagggagatgggtttgggaaacttggggtaaagaacacagccaagtgtggtttgcccctcctacaaccaatttg

SEQ ID NO: 61119 - DNA, 8988 bp, Oryza sativa
actagctgatctgttgttaaaagaaagtagagtgaatttcagaaaactacatatactttggttaaattatcacaaaactatagatttaaagcgttgtatcataaaactacaaattttatgtcaaaattatcactaactatagatttaagatggagtgtaaaaaataacttcaatattaaatctacagttttgttatacttagtcttaaatctgtagttgtatgataaatttactactaaatatgtagttttgtgatacggtatcttgaattagtagttttgcgatagtatggtcaatgaagtttttaaaattctactaaaaaaagtattgttttgtaaatacaactatatctttaaaagtttatttgtctatattttctctctctaattaaattccggcagtgctcctgccgttggtttcctaacaataataaataaataaaagttattcatggttaaagttgagacattgatgatcagaaatgacaagtaaatgaggacgacgggggtaatttagcacgaccgtatattgtcgattggatgcccatgctgttaggtagaggtaggcatcagcgaaacaatttatgaaggcaagaacgcggccatcaggccgactgtgacgcaggccaaggcacacagacacgggctcagtttggatgtaatcatgtaattaatcagtccgatttggaccttacaccaaaccagccttaacttaatcacgtcgatgactaataaagttttgtgttttttttggtaatgctgccaatttggacttgatatataaaagcaaattatatatataaatcctggctgattgattatatatatctatgttacccattcctttttaaatatataacgttattatcttttagacagatcatttaaattcttttgggacatatcatttatttattttgttatgacttatttattactacatcctattataagtcacattgattttcttttctaattgaacttttttaagtttgatcaagtttatagaaaaatttagcaacatttataataccaaattagtttcattagatatagcattaaatatattttgataatatgcttgttttgtgttatagatgttattatttttttataaacttgattaaacttaaaaaaactcaaaacttaaaaaatatgtcgacgcctgtggtgacttcgtcaatctcaagatatactaccctagtcattcagaggtgctcatagaggtagggtgtgcgtgtgtgcattcataggggtgagtgtgcgcgtgttgtagacgcctgcatttgtactgtgtttctaaaataaagcttaaaattgctttactatgaaaaaatgtcaaaatgacttataatatggaacggagtattataactactttaaacataacttatatcatttatatatgtataatttgttttagtaatataaatggttcaaatgtcatgtcatggaagccaacaacgctatacatagtactatatattataacggagaaaataattcataacgttgctatttaactaacaaccgatctggacaatataatgtgccacctgaacagttctgatcatacagacaacaaattttgtagccatgtgctctatcttttttctcaaagaaaaaagatagcaccaatctgaactgaaaaattgtatgttctatccaatgacagcaagataaatcaattgatctatgtgccattaaccgttttaaaattttccagagctatagattccgacataaagctgatgagaattaatctaaaacaaactccatccatctcacgaaaaacaaactaaaactgaaagtggtatatcctagtacaatgaatctagacgacggaaggagtagaccacaccttttctaggctcgaacaacttaattatttctagaatctaatctatactgtacgaggagctagagattactagggctatgatttattttacaaaaggtatatcattatagatttgttgctggaaatggattcataatattattgttgtcttataattacaattttatttatttttttttgaaaaacataccggtcaaattcatacctcgaagaccacaaaactaaaatcacaagcattaagtgaaaaagaacaagaacgaaataaagtagctagatagataagtataagataaatgtgtaggtaggtggattgaagataccttgagtatacatggagtgatgtcactagagatatacacctatataaatgttgttaatttatatgcatttatttataccactaagaacttactacaacaacaaaagggtctgatttgatatgatttaatttggtcatttcttgtccctacctagtgtatatggaattgtatcgtagattagaatcccttctgattttagcatgattccaacatttaaagatatataaactagcttttactaattaagtactactactaactaatggtgtgcaaatcagtagattaacgccgtgtttagttccagaataattctttaaacttttaactttttcatcacatcaaaacttttttatacacacaaacttttaactttttttatcacatcgttctaattttaactaaacttttaattttagtgtgaactaaacacaccctaattaacacaacacagccacacaggctacttgacccactagaccatagaccattttctgatttgcctatatcatccactgaccttctcttcttcctctctgccttcgcaaagttgacaccactcatgcatgaacacgtcgctgtctacacgacgtaattagcacgcagctgcgatctccgaaacagggagctcgccgcgcgcgacgccgacgaggtcaatgaagccgccgcccaccgccgccgctacctcggattccgacggcggcggcggcggcggcggtggcctgatccggccgtcgcggatatgctacatggccatcctctccgccgtcttctggttcttggtcttctccctcctctccggcatgccgggcggcggcgacctgtcgtccgtgctgttcaggccgtcgtcgctgtcgctcccgctcctgaacagcttcacgttcgaccagaacccttcgccggagcagcagccgccgccggcgccggcgccggcggaggatcgctgcgccgggaggtacatctacatgtacgacatgccggcgaggttcaacgaggagctcctccgcgactgccgcgcgctccggccgtggacggcggaggggatgtgccggtacgtggcgaacggcgggatgggcgagccgatgggcggcgatggcggcggcatattctccgagcgcggctggttcgacaccgaccagttcgtgctcgacatcatcttccatgggaggatgaagcggtacggctgcctgaccggcgaccccgccgccgccgccgcggtgttcgtcccgttctacggcagctgcgacctcgggaggcacatcttccaccggaacgcgtcggtgaaggacgcgctctccgaggacctcgtcgggtggctcacgcggcggtcggagtggcgcgccatgggcggccgcgaccacttcttcgtcgccggccgcaccacctgggacttccggcgagaacgcgacgagggctgggagtgggggagcaagctgctcaactaccccgccgtccagaacatgacggcgatcctcgtcgaggcgagcccgtggagccggaacaacctcgccgtcccatacccgacctacttccacccggagaccgccgccgacgtcgccgcgtggcagcgccgcgtgcgcgcggcggcgcggccgtggctcttctccttcgccggcgggccgcgcaagggcaacggcaccatccgcgccgacatcatccggcagtgcggcgcgtcgagccgctgcaacctcttccactgccacggcgcggcggcgagcgggtgcaacgcccccggcgccgtcatgcgcgtgttcgagagctcccgcttctgcctcgagccacggggggacaccatgacgcggcgctcgacgttcgacgccatcctcgccggctgcatcccggtgttcttccaccccgggtcggcctacacccagtacacgctgcacctcccgccggaacgcggcgggtggtcggtgctcatcccccacgccgacgtgaccggccggaacgtgagcatcgaggagacgctggcggcgatctcgccggagaaggtgaggagcatgcgggaggaggtgatccggctcatcccgacggtggtgtacgccgacacgaggtcgagccgcgtcgacttcagggacgcgttcgacgtcgccgtcgacgccgtcgtcggccgggtggcgaggcggcggcgcgacgagcccgacgcccggaggtgacaagatccaccgggtgattttgtatgctttgattcgatttgattgggccattggattctccatgaatctggggcaaagtgcagtttttttttaccttttgtaattttagttttatatatacttttattgcctcgatatattggcatgtaagatcttgattgattatgtatgaaacaaagcagaattcctcaaagctgggctagctgaaagattggcctgtcaaattaagaaacggggggatttttttttttggagaattaattttcttgtggatttctctaaatctcacgcttgtgaaatttctccgaaatcctttgttccaaacaactgggggattttttgtgcttgcagaatttctcaaaaatcctctgttccaaacagcgcagagcatccagggtgaactgagattcgaataggatgaacattcgaaatgtgttcggcctgcatgaatctccaatgattttggtagcatcaatgtataaacggcattattggctttaatccttgcaataaaaaagtgcaaatgcagtgacgaacaaatatatgcttgcttcgatctggtagaagtttagaacgacaacaagttgccctgacaactcgtgatggaaatgtatatattttcctttttggagaggagcaaataaattatttttgagagaacgaggaaattagaaaatcaattagctgagtaccctaacaagatagatcgcctggttagcttttttttttttctacttacaagttgaatgtccgggcattgaccccgataaaagaaaccacactacacaatcatatatcgccaattacaatatttatctttaaatatatgaaagattgtactcacctgtgaatgtgtccctgaatcacagcaaatatatggtggaaataattacaacgtaggtgaatgacaaattagaaaacaaattggtggcgaagtgagcgtagctgtagacccccgattttggaaatcggaaatcatctgtgtttatccgtaccaatccctggatcagtagttggtacacacatacatagttgaatcacaacatatcacgaatgaattcaggctaaaagagttaaatacttacattagggctagataggccaacaactatcagagaacaacaatggaagacaaaataatataagggtccagttgacatgccacaggcagtcgactagggaacgagacctagaacaggaccgcactccgatcatcttgttggatacgcaagcgtaccgacaaaggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagtctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatctcatcccccacaagttaagaatttagagtctagccaagtgtaatacatgtccctgtgctcaataaccgcgagcacggctattcgaatagacttggtttactcacactgcagtggatgtacactttacccgcactccgcgactgcccaacacatgagcctcgtcccaacacatgagacgcgtcacggcaaagcttttcgataaccttgcattggcagtacccgctccatgaactttacatcctcatgcactctaggcgtacaaggtttctagcagtgagaggagttctggcgtacccgggaagggaagactcacacatgcattaagttataattatgtttagattctcacatggcagtcctaccaatggcgacaccactgtagacacccgcctcgcggtcctatcaatggctgccccaccgtagagcccctgcctcacacatcaagaaaccactatgcatggatactgcctccgcttagctatctactccgctaggtctatacccatacgagaagtgcggttgtacggaggtcatttcatgcttaacttcatgactcggtccttaattgaccggggacggtactagccttttccggataccacccaaatcctccgtccgccccagtcgaaaacagttgtttaattttatttctcttttcacaaatcatgtcatcaacatcatggcaatgtggcgctcatgtctccacataccgcatctcaattaccttcccaaaggtaattgcccaagcatatagcatttgataaatatgagtatgcatgattctagagtagcatctctaagcatttgtcatagttgactggggactcatacgtaatcatggttacaagggaataagggtaaacaacaataatcaaggtatggcatattcaaaaataggatgttcatcattgcatgcattcttatttgtaaataaaaataatttcgcaattgggatcaacatgttcaagggatagtgatgacttgcctgctcagaattgtccttattctttatacaatcttgatcaaccttcacctcctggaagttgcagacgttgcctcacgactaactgatacacaaggtctattatatgcgagaaaaaccaatattcaaacaacaatcaaatatgcacaacaaaatatactattcggtttgctaatggatcccaatcatgctaaggctaaagtttcttaatctttctattgtcatcgtggcctatttaggagttaaccaacatagcatttatgggatacatatatatttggctaatcggtggtttagtctatcaaatggctatggaaggattatggctatgtatgcatctatctaaataggactgttatatactagaggttctgttgttagatggatttaggatcaatcaaataataaataattacagtgaatcatttgtattattattttattgatggaagctttgaacatattttacttgtcaaaataaattataaaaggttaataattatccatgctttgtatgttagagttgtttaggttaatcatattatggttacagattatcccatcacataattttacaatgaataatcctaagttacagttgaactataattataattatatgaggtcaagatttataactagcatttatctaatatacatgtttgtcatatactccctctaatttaatatatgcaacacgcaaattaatactataccgtacaactataatgggatgtatagtatatgtgtaagcaacaatatcttattattggatcatatatttgagtagttgctttttactgtaagctatacaatacatgtcgattttaagatggctctgtttggttaactaatggatatcaaccgactatatatatatattctacttcacatgacattgtatcgactaatttttaagtggtccaaatacagctagctctgtgattactctcctaaacaagttaaagattcacctatgtgtgtttatattttagttacaaaagatgaggctaaactttatgtaaataatttataagtcatggatttagttatatttggacatagactagtaaatggcactaatattttcctatacacccattaatttgaaggattgattataactaatttatttggttgctatagtgacaagacatattaaagataattatgctactgtacaatatccatttttatttattggcacactatttaggttaactattatctaatcatttgatattaattaatttataattataaatatattatattaaatagtgaattatatatcattggaaagcttatgaatttagatgaatttaggttcaagtttcactcaaatccgagctaaaacgaataagttacgctagtttaaagattcaaatttgaattaattctaataattgcgaaatggtactgttcctaattcatttatttttaatacaaccttatccacaagctatagtgactgacatgtggggtcttcctattttccttttcttttattttatttttctttctaaaagaatccatatgggtaaatgacaggtggacccggctcctttgactagggtcaaaccggccattaaacccggtagggcccgcatgtcatagactcgagaccataaaacttctataattagatttttaaccacccggacccacatgtaatagacacaactaataaagattaagaaagggattactattcaccaattaggtggggcccactctaatctctcctctcctttttctctctttctctccctcccggcttcttctcccttcctctcttcttttctctctctccctcccggctgcgacggcggtggacgcaagggggaaaaggcggcggcttaccgacagcggcggtcggcggcgacgacggcgacggcggcgcaagcctcggcgcggcacatggcgtggtgcagcggcaccgagggcggcggcgcggcggcacaatggcagcggcgctgcggcacgaaggcggcggcgcggcggtacgagaacgacggcgcggtggtgagggtagaggggaggaggagggagtggagtggggagaatgggggaagg

SEQ ID NO: 61120 - DNA, 601 bp, Oryza sativa
agcctaattacgccatgatttgtcaatgtggtgctacatggagtaattaggtttaatagattcgtctcgcaatttataggcggaatctgtaatttgttttgttattagtctacatttaatatttcaaatgtatgtctatatacgttaaattttttttgccaaaataactaaacacggccttccttagtatacgtgtaatacttcaaattagtattagtgtccatatatctaatataacacgccaaaacttttcatccctggatctaaacacagccttagtacccctgtgtctacgcacgctgtagtaaaaccggcaagatcaaccgagcagagcaagaacaatagcagagatgagttgatggcaattttctggatttctcttctcaccgaaatcaaagtgcgtgatagtcacgaatataaaatcccattacaagtttttatgagatgataatgatgatgcttcatcgtaagttagtaacagatcgacaagctactggctgtttgttccaactagagaaatttacataaatactcctaaccaccagcgcagggaaacaaacacgtttcttgcacccgaatgcaaaattgccaagacccctgt

SEQ ID NO: 61121 - DNA, 10181 bp, Oryza sativa
tatggtaacatcagaaagataagcaagaatgaagaaaaaaaaatagttgcactcaattaagtaagaacaagagtctaatttgaaggtccataagtgtattgattcttaaagcactagtgtagactttaagagtaaattgctaactccaacatgacctagctcgttccgctgagcaagtcagcttctagatatttggttataggttcaatttttccactgcacttttacaatcctttatattgccatcacttgtacatacgtagatcatagatttgacatgtgagtgacacaagggacggtatacagggctttgggaattttgtggtggcgtgtcagaatcttaccattttaagaaatgcattgctaattgactcaatctgtgatgtacctcatcaaaagcatgtagatatttagcatattattttgcgttagtcaatccaagaatattttacatgtgtgcaggaaagccatgatccattgtgaatgcaatcaatgtcagtaacgagaatgagtgattgtaagcttgaagagaaaagcatacttaagaggagcggaaagggaaagaaagtcaaccaaatgaaggattggtattgaagtaatctactagaaaaaactaactcaaggggggtagaggaagtacaaccaaacaatgtcagaatgcgcaacaacagcacggatgaagaggaaagaatacatgcaactcaagcggggcatgaagcgtgcaagaactgatggaaatgaagaaaaaggaagagctgatccaacttacatcagcaatatggagttgaaaaatacccttagctggaacatgacctggccaaaatgcatgtgccgactttgccaaggacccaacggaatttacaaaaacatcaagaatgtagtggaaccaaaatactgcaatattcaactaatgcaactcaaggaaccatcagttataaacagtgcaataatatacagccaactgaagaaagcaaggcgggcaaaagaattagcaaaaatagcaagaatgaagaggaaagaacagaacacactcaagaggagcagaaaaggaactagaaccaataaaaatgtaataacgaaagagatcatttccagtgatagtaagatatggaactttggggggccaacatgcatgtgccaacactgccatgcgcttatgtggcatgcagaaagatcactacattcaacagtcaaacagccatcctttggactctgctgcaagcaagggaaggtagcattgccaccgttaaaagaacagcccccttaccttacgagtttattgacaagagatggaggaagatcaacaaactaccaacagaacattagatcatacaattcgatgtttgcatttacatcaatgggaggaaccgttgacagaaaaataaacaacgggcatggaccttatattttccgactgaatggccagaatcaccatcacataggaactctgctaccagaaggtagcaacaagcctcgcttccaacaattgtacgtatatgacacagagaatgagatcgaaaataggattgaagcatcaaaatctggtgcaagtaatgccccattagaccaaaaaactattgccagcctactaaaaatgcttgatgagaacaacacactagcccagacattccgaatggcaagagatagatttaaagaagatgactatcacaattacactctgagattacttgataatagggatcaagatggaaggcaagacaatatgccatcagcatcagaagttgctctcttgatagtcaaagatccgaccaaaaaaagctatggacgcgacattgttcttgagtacaaagatatgagacctaaaaggatatcagaaacccatccaaaattaatggccatgcaatacccactgctcttcccttatggagaagatggttatagacctggaataaaatacagcggaaaggaaggtgtaagaaatgacaagaaatgtgtcactatgcttgaatattatgcgtatcgcctccaacagcgccaagaccaatcaatgttgccactgatgtgtggaaacctctcaatgcaatacatggtcgatgctcatgcgtgcatagaacagattaggctcaactggatcaggcaaaatcaaggagttctaagaacagaactttatggtgggctacaagatgcactcagaagaggagacacaagaacagagcaagtagggaggaggatagtacttccagcaagtttcacaggaggtcctagaaataaagagcaaaactaccaagatgcgatggcaatatgtcgttgggctggacatcctgacttgtttgtaacattcacatgcaacccaaagtggccagagatccagtgcatgctagataaagttggataccagaaaccatcagaacgccctgatattttagttcgagtgttcatgataaaactgaaggaattaatgtcagatattaaaaggaatcaacattttggaaagactaaagcaagtaagtgacgagacaaaaaaagcactcatccgtacaatttttttaatgaaaagtaattgctaacacatatattgaataaatattgcagttgtcttcacaatagaatttcagaagaggggactcccacatgcccatatcctaatcttccttgataaaagaggaaagagcctagagccctcacaaattgatgaactgatatgcgctgagattcctgacagagacaaggatcctgaaacatttgaagctgtcaagaatttcatgatgcatggaccatgtggagaagcaaacccaaagtcaccgtgcatggtagaccataaatgcaatagattcttcccaagaggattttctgatgagacaatcattgatgaagtcaacttcccaatatataggagacgagatgatgggagacagataaaaaagggacgagttaatctgaacaatggattcgttgttccatacaacaaagatctcctagcgaaattccaagtacacatgaatgtcgagtggttcaaccggtctaggtcaatcaaatacctatttaagagcatatgcaatgaagatgaccaagcaacagcagttgttgaagaaactgacgaaaagaataatgatgagattaaaaggtacctgggatgcaaatacacaacagcaactgaagcttgttggcgaatattcaaatttcctctacactaccaagagccacctgttgagaggctatcattccacgaggagaatgagcaacatgtgatttttcctgactcaacagacctacaggaaatcgtaagacgaccaagatcaggggtcactatgtttactgagtggatggaaacgaacaaaaggcatgaagatgccagagaattaacatattcagaatttcctacaaaatggacgtgggataagaatgtgaagaaatgggtaaggcgaaaaggagggatgaaaattggcaggatctacaatgcccatccagcaagtggagaaaggtattatctcagagttatcctcaacacggcaaagggttgcacaacatttgaagatatcaggactgtaaatggaaccgtgcactcatcatacaaatcagcatgccatgcactaggatttctaaacgatgatagcgaatggattgagtgcatcaaggaagcatcatgctgggcatctgggatgaaattacgacaattatttgcaactgttttatgccattgcgaggttactgacccaaagaggttgtgggaatccagctgggagaaactctccaaagatatacagcacacacaaagttgggcattgaactttcccacctcctgcctcacgccttcacacagaaggaaatgtgctttaatagaaattgagaagaacatgcgacaagctggaaaatcactaaaggaatacgctggaatagaaccgccaaatatggcaaagttaagtgaaattgagaacagtttataattgaagagatgaactatgacaaagagaagttgaagcacgagcacctgcaaatactaaacactctgaacatagagcagaaaaaggcatttgatgcaataatagaatcagcacatcaatcactaggcaagctaatatttgtggatggttatggtgggacaggcaagacatacctttggaaagcaatcacaacaaggttaagatcagagggaaagatagtgcttgcagttgcgtctagtggcgttgcggcacttctacttcaaggaggtagaacagcacattcagcattcaatatcccgatcaacctaacagatgaatatacatgcttcatcaaacaaggctcgcacatagctgatctattaatgaagacatcactaatactgtgggatgaagctccaatggcaaacagaaactgtttcgaggcactagacaagagcctaagggacgtgcagaggtgtagaaatgagaatagttgtcaaaagccctttggtggcatgacagttgttctaggaggggacttcaggcagatcctccctattgtgccaaaaggaagaagggaacacactgtaaatgcaacgatcaaatgctcatacctctggcaacatttcgaggtgttcaatttgacaaaaaatatgcgactcaattatgtgtccaaagatcaaacagagcatcagaagtctgcagaattcgctgagtggatactacaaatcggcaatggtgacacgatttcgttagatgaaaaaggttgggtgaggatgcctagtgacctgctgttacaaaagggagatgacccgaaagctcaaatcattgagagtacctatcctgacctacaagacaattgctgcaagcagaattatctagaagaaagagcaatattgtgtccagtgaatgagaatgtcaatgagcttaatgagtatattatggaccagatccaaggtgacaaggtaacctaccttagccgtgacagtgtgagcaaatcagtgtcttacagccatgagatggaaatgttatatcctacggagtttctaaacagcttgaatcactccggaattccaaaccaccaactgaagctcaaagtcggtttgccagtgatgcttcttcgtaacatcaaccaaagtgcagggctatgcaacggcactagaatgacaattacgcgactaggcaataaggttattgaggcacagattataactggaacacacagcggcgatatggtatgtatcccacaaatcatcatgtcaccaaccgaaccgaaatggccgttcatgctaaacagaaagcaatttcccctctcggtgtgttttgccatgacgatcaacaagagtcaggggcaaactctaaacaaggtcggcctctatttacctaggcaagttttcacccacgggcagctctatgtggcagtctccagagtcacaagcagagatggcctgaagatcttgatcgccgacgaagaatgcccgggtgaaggaatggtgaaaaacatagtgtacaaagagatcctccagtaatttcctagtgtttgcagttaatttatgcagtgttcttccccgaactgaagctgtaataaaattggccgcgctgttgttccggccactagctagttttcctaaagcattgctgctatgcaagtaatgctgagactatcaatcgatgtacttgctttctataagcaatcaattatgttctgttatatctaattgaatttgcatttcaatctctgcactcaaattggctgggggttagtatcacttatcactgcgtttctgcaccaaatcgaggttgcatcccaggtcccatagctaatccagtggcaggcatagcgcaacacaaactgttcgaatcggaagaacaagcagagaacgggggtggtggttcatcttaccagcgcattggacccggtccgcccggtgccgccgcccgccgcgcgccgcgcgccgcgttcgcccggagcggacggaggcggccccgacgaagaagccagcattcgcgctcgacttgggccacggcggcgagttgccgccggcatgggccgacgctgatggaggaggacggcggaccagccgttcattttgctggaagccgccgccgccgccgccgccgccgccgtcgccggagtgccgggcgacgaggcgggtgagcaaccacgtgtatgggccaaatgatgggcctaactttcgagcattcagagcatttcgtatgggctcaaaatccggcccatatacgggtatggacctaaatttcggcctattcacagcctgcttgaatgtccaaaaatcccagcccatcttggagacatacataggttcgtccgctgttttttttttttggttacagacaaagaatgcaaaatccagcttcacttttgcgaatttctcggaggtacctccaaatagggccggttgctatcacgtatcaaacattgagtattaacagactgaaacatattttcttttatcggaacatgatcatgcgatatcttgttgtgaagattaaattacaacaaacacaacggtgttatcggatcgcagattagataagtagtttaggagaaaattcattttgaaggctgctaaatccatgcatgcatgcatggataaagaggagatagtaggggcaaaaaaaattcgtccgtcaaatgttacagttgaccactagtgaaacattaagttatacacagtgaaaaaaatcagtcactgcaacatttaaatatttttttgaaacaaagtgaaaacacacgttgaaacatgttgctatcacgtatgaaacattaagtattaacagactgaaacatatttttttcatcagaacataatcatgcgagatcttattatgaagaattaatataacaaataccacggtgttatcgaatcttagattagataagtaatttaggagaaaattcattttgaaggttgttaaatccatccatgcatggatggatagaggagagagaaagttggggcaagtagtgaatgcacactttaaaacatattgctctatttaggaaacattaagttttaacagtctaaaccatatatttttcttttattaaaatataatcatttaatatctcattgtatagatttaattgtaacaaattcaatggtacgatcggatcgtaaatcgaataagtagtttagaagaaaatatttgaagtgttgagaaaaaaagaaaaagaaactagttagtactcatcttgcatgcatgcagtagcaaggagcccgattgtttctcttcaaatcgggctaccgagcaagaggattcttggaagatatacatggagtaacgagcagcagcgccctacactggagaagcttgatagagttctggtcaaaacttgagggcttcatggatgttgtaaaagaaagctggcaacaagaagtggatgccaccgacccttacttaattctgcatgtgaagctcgctaggctatgtaagaaactatcatcctggggtcagaaaagaatcagcaaatacaggcttcagctgcagatcgccaatgaaattatcctaagatttgatgttgcccaagagtcacggttactatctgatgacgaacgacatcttcgtgcagcctgcaaaggacgatgtctggctttggcgtcgttagaaagaattcggctgaggcaaagggctaagattaggaatttgagggaaggtgatgctggcacggctttcttccacatgaagataaaatcaaggcgaaggaaattactgatcccacggttggaacatgagggcagaatagcttcaacacaacatgacatgcaaaacctagacagagaatactttgaatcagtgatgagtgcggaggacagtgctacaagaaggctgctgtttgaacaaattgggctggctgctgctgatttgactgagcttgatgttcctttcactgaagaggaaatctgggcagccatccgctgcttaccgaacgaaaaatcacccggcccagacggttatacaggattgttctatcaaaagtgttgggacatcatcaaacccgagctcctcaacgcactggcaaagttttgcaccggcaatagtcagaatctagaaaaattgaacacggcaatagtcacgctcattcccaagaaggaatcgccaactctactcaaagactacaggccgattagcttggtgcatagtttctctaagctggctgcgaagattatggcacagcgactagcgacgaagctggatgttctaattccttattctcaaaccgcctccatcaaagggcgctgcattcatgagaactttgtttatgtcaaggggctcgttcagcaattccataggcaaaagaaggcaatggtactgttgaagcttgacatttccaaagcatttgacactgtatcgtggggttttctgctgtctatgatggagttcaggggatttggcccaaattggagaccgtggatctcggctattttcctcactgaacaaacaagcatcttgataaatggggcactcaccgacccaatcaagccagcaaggggaccgaggcagggagaatcgagcgaaactagctggtttgctgtcaccactaaatgcaagaaggcatttgcctcccatctcagtgtacgctgatgatgccgttctgttcttcaagccaacggctgctgaagcaagcgcgatcaagggactgttgacgttgttcggcgaggcaacaggcctcaaaacaaatttctgcaagagtgcgatcaccccgattcagtgcagtgatcaacaacgggcaatggttgagtccattctctcctgcagagtagaagatttccccatcacctacttgggcctcccgctaggaacaagacagccaacaaaagccgaagttcagccgatccttgacaaattagctaagaaagttgccgactggaaacctaagatgctctcgatcgatggcaggctatgcttgatcaagtcagtgctcatggctcttcccgtccacttcatgtcggtgctgcaattgccgagatgggcagtcaaggacatagagcgcaaatgacgcggtttcctttggaaggggcaagaggaggtgagcggcgggcattgtctagtctcatggcggaaggtgtgctctccagtggcgaaaggcggtctcggagtgaaggacctgaacttctttggtcaggctttaagattaaaatggctggcgaaatcgctggagcaaagggagagaccctggacgatggcatctttcaggcctggttgtgatgtggaggccatatttcgctcggtgacagagtacatcataggcaatggtgaagacaccgatttctggacagcaaactggactgggaagggatgctttgcatggcggtggccgatcctgcactcttatgcaggccgtgtcaggctttcggttgccaaagctctcaccaacaatcgctgggtccgcacactgcagggggcgctgtccaacgaggcgatgggcgagttcttccagctttgggacgaaattcatgatgtgttgttgctcccctcgacggatgaaatcaggtggaaactggcgaacgatgggcaattttctgtggcgtcggcctacgacatgttcttcatggctacggaaaattgtgcattcggcgagctgctgtggcactccagagctccctcgcgagtccgcttcttcatgtggcttgcgctaaaggaccgttgcctgcggacaacctcgccaagcgaaactggccacatgatgatctgtgctcactttgtcagcgagatgatgagaactgccaccacctgttcgttgcgtgtgattacacggcggcggtgtggcgttctatcaagcgatggtgcaatgcaagctttccaataccggcagatggggacgctgccctcgctgattggtggctggcaactagatgccgttttcagaagagctacagagcagattttgactgtgctttcatgctaatatgttggctgatttggaaggagcgtaatgcacgtatatttcagcacgtgtccaagctactggatcagctcgcggaggacatcaaggatgaaattgccatttggagggtggcggggattttctcccaatttcgcgagtaatccccatggatgtttgcggggtttagcctcgcctttgcttttcattcttggctggctagggaccttccttggccgccacgacattgtaatgtcgttgtaaacttttactatgtttttcctcccaatcttaatgaaattggtcggctaacctttggctgacccggcaaaagaaatcgtatgtataataaggtaattaataagacaaaggggcaggaagtaaagtgcatc

SEQ ID NO: 61122 - DNA, 10476 bp, Oryza sativa
  unsure (1)..(10476): unsure at all n locations
ctttgggccaccaacacgttacacattaaaaacttacacttgcacactccatctacctttctagacaccataagcggcaaacccttacaaaatcaaaacccaatgcgcatacctcaagtatatccttaacgtcatccttagtcagtttgttctgtcttagaagcaactctattcttgttctcatctgtgaattgctgaaaatacatggcagggtcaaaaatatgagtattgcactgcacacccgacctcctaactcaacagagcaagaaacactcaagcttcacttacccagagtgccatatatgccccagaataagtgcaattaactgaaaaaaacagccacaattattatagacacttggtaaagtaaataaactaaaggatcaaccaagaaagccatacaagtaagaaaacaacactttcaagttattactatggtacctgaagtgtgtaaagaccagcttctagcttgcgattgtagcgctcatcttcatccatctgagataatgagaatgtagctataagaatttttcatctgttcaaatctgagacaaaaaatcaccgtgggggcttcccccactgtttccgggtcaaaaaaaaatctgagacgaaggcaactaggtagataaaagcacctctagatcatctaaatcaagactgtcaagtctttcagtctcagctttcactctttctgaatacctgcaaatgaatgagcaaagcatggaggataaagccaatagcagaaaaacacaagcaattttcttagttttcttcaaacgaaatataccttgtgtaaaactccatcaaacggtctatcttttcacattcattctcaacaaattttcctagtaacctgattcttcgtgaaccttttgtaataccacctaagaaaaaaaaatgcaaaacaccaaacatgaggaaataactagattaatagggtgtctgcagcatcaacaaacctatatataagtagcacagacaggaacagagtccttaaatgcaaaaggcatcggcagtattatgttcagaaagaactccccactgaattgaataattaactacagaaagaaaacatgatttttcaatatagatgcaaacatgattgtgaattaactactatagtgtggtaaaaaccactgagtattcaagttcaatggtgatcttcccagaagtactgttagatcatttaaatagaataactgcagctgtccaaatatgcagttaaggcttgaaatttttgcatgctacgctatacacttgggttcaaccttaaaaggccagtatgattgaaacgatctgctattcaactactccctccatttcacaatgtaagtcattctagcatttcctacattcatattaatgttaataaatctagatagatatatatatgtctagattcattaacatcaatatgtatatgggaaatgctagaatgacttacattgtgaaacggaggaagtatttagaaaatcaaaggttgcatcctcacttcccctaaagaaactagtttcaacagtcaatcatgtactaatgtctgttaagctgatttatatgtatattgttgattcgcagttgcaggtatcatatacagaagcaatctggatgaagtgttataatactaaggagcaccataaaaatataaacacccatattggaaaaaacctgcttgcttaccaaacaatgaagcaattagtgaaatgacccgttcttctagtgcttcctgataactctcttttttgtttttcttgttcacaggaatctgaaaaaccatatcccgaaataactgagaagcacataggtgattacctcataaagcagttactataagttaaaaatggagacgaataaagatgtcatgtagcaaaggtctactataagctgtttttcagttgaaacaataaggtgtatgctactagttaacagcatttgtgcaatagaaaaaaaaaaggaacctcacataaatttgatcaagtggactgaaactgaaaggcaaacaggatgctctgttataatttgaaaaggcagcagcatgtgtttcaagttacttaaatcagcaatgtatgtgttttccatgtaatgttggttgaaaaggctgatgcagttgaaccactttcatccattttcagatttacttcccaatagaaactgtaactgcagaccataagaacatatggccgggttaaaggtaatagtgataaatttaattctcttgcatattactgcatcacagcattgattgatgttcacaattgaaactatataggatttgatcagtataggagtatacaagcactttcatccattttcagatttacttcacaatggaaactgtaactaaagaggatgagcatatgaggcttcaggaaatggttatcaatttagttatcttgcatgttagtgcatcacagggcaccgcattgattgatactcagcatccgaaatcttataaatgagaagagaaaaggagtagcagacacttgccttacccatgaacgcagcaaaagcggtcttcagcccaagtacatcaacaaagcgctcgcaagcaggtgggaacctagtcatggcaaaatcgagggtccggatggcagagctgtatgccagcttcttctgcttcatgatgatgatcatgagctcgacgccctccgccttgacaaatctttccttgttctccatgggccattgagtctactatcnatgtcttagtagtggggcccattaaatttccccgtaaattaaaggngaagtgtttnttctttccggaaagggcccccaatttttccatttcaccctttcctttcattncaggaaggagggntctttggtcctgacttgtacatggcaacggcctgcagcaggccgtcgactccattgatgttgcccaggcgcttctggttggcggggctgtcctgtacgatgatggcgaggatctcggaggcgtactgcttgttggcatcgaactcgctggccttgaggcgggcgaggagccagcggagaagcttggtgcggtcgcagacaatgtcggcgagttgggggcggagctcgaggaggttttcaacgacagagagggggtgggggacagcctcggcttcgtcggggtcggcctcggagaagcgggagagattgtggacgaggaggtcgagggcgttggcttcgacgagggcgtcggcgagggagtggaggccggcgaggtcgtcggggtcgtcggagtcggtgaggtcggcgaggagggaggcagcggcggcggcgaggtcggcgttgtcgtgggtgaggagggaggagagggaggaggcgaggcctagggggacgaggtccgggaagaggtccggggcgccggcgaggaggcggaggcggtcggtctcggcgtggagggcgatctcggagtcggcgaagcgggcggggtcgtcggggtgcttcatgcgggcctcgaggttgtcgcgcaggcggcgctcgaaggcgagcaggaggcgcttggcggcgcggaggtcgagcacctccacgtcgtcggcgccctccagggaggagaggtccaccgcccccgcagcgccgtcgtcgtcggcgtccggccgcttgcgcttgtgcgccgcatccatcgaaaggaatagggggagggggagaggctaaaccctaaccctagccagcgagcgcggggccggaggcggaggcggctgccgctgcggaagaagaagagtagtagagctctaagattcgtgcagtgccggatgactagatgatatgaggctctcagtatactcgcagcagctactgatgacatacagtatgttaaaaaacagcagcagattgagtactttgatcaatttctgggctggattatcatcaacatgttgcaatgcaactacaaatgagatctacaaatagataaatgctttcatcaattgattgataaccagatgatcgagatgaggcattcatttcatacatgacaagcagattagaggtcagaggagagaccagcacatcacatacgtagctccataatactaatactctaccaagaattaataataagaagaagagtaagccgttacattcatgaaaatgaacagagagaccagtcacaggccaagaaaaagctattactagtacttgccttaggaaggtacagtaagttaaaagttgttttctgaccaaaggatgactctacaaccagaacgagtagcattcaggtaggctttgtcatgccttggggggttcttcgttctatccactggagtagaacccagcagcaagtttttatattagcaggatcagatgagcagcacgcctgccataagcagcggatgatggtcgctttcattttcatttcttgtgcgccctgtagtctggggagtttggtggcaatggtgaaagcgggtgcctcgatgatgaatctgcaccattgaaatcgatggtccgacccactgggctcgtatccttcaaacttgatgatttgcgcttgtgctgcaacaaacatatacatgatgacatcaaacttctttccaaccaacattttcaacaagagacaaattttccttgccagtttataccttggtggtggacgcactggaggaatgctttctctcagaccggtgctgtcgctctttctccaacagagccaacagttttttgttctcttcgtcaagaatcttgttttcctcgaatagcagcttgaccttcaattgaacacaagaaaattttctagccatcagccaggcggcacaggtttcttaatgatgcagaaatgaatgcaaggacaagagtgtttcactatcttacctcctcctctgctttattaagattgatccttaggttttccttgtccttgtgcagagcttcaacttgagtggtcaatgcagaaagctgcatatggaattagaatcagaatagatcaagcagggggcagacggtgctatagcatttgttactaacatctcaacacacgagcttagatgatcaaatagttaaagcagaatattcaacaacagttgatcaaatttttactagtttttttttgggatcaaagaggaacgaagccgtttccctcatttacattaatagaacggcagggtttactacatactagtaacagagaacaaaattaaaaagaaaatgcaggcctccgctctactggtgccatcccagcaacttgaggctatcctgaagaaaaccatctactggcagcaaaattttacgacattaaagcgaaacatgtactgaagagttctcaatccaacaagaccacatcacatctagtagagggaatattaattaatattcatactagggtaaaagaaaagaaattcacacacatgccgcgccaagaatgaaagaaaggggatgcgaaggaggaagggtactgacggtggtgtggtcattgaggcgtgcgcgcatttcgtcgttctccttagcgaggtcgtcgcaggactccatggcgcgttcgaggtcccgctcgtagagggtgcactcccgctcaagcttggtggagtgggaggagaggtcgttgtaggcggagaccatggtctccttctcctcgatgcagcggcgcaggcccgcggcgttcatggtggactccgcctgtgcaccagatccagcagagcaagagcagttgcagttaggggaaagggaaagggaaagcagattggtattggtattggtactagattagagattagttaccttgagctgttcgatgcggcgtgcggctgcgcggaggtcctcctcgaggacgaagacgtggtcctggaggcggcggcgatggtcctcggaggcgagcagcttgaggcggagggagcggtcggagacggggaggccgagcgagtcgtggatggagtcgcggatgtagtcatcggcgccgccggggagaggggtagaagaagcatcctcctctcgctccatggatgatcgccttcttctcttctcttcttccggcggcggcgggggcggcggcgccgacgaggagaggagaggagaggaggcggcggatgagggtgagggttggttgatcgatctggaatttcttggggaagagaatgtgggatccggatggattttgaactgaacccgctggataaggccggggtgaccgttgctgctattattgggccgggccttctctttcgatcttttccttccctatttcggcctattgcaggttctctttatttagacttaactttattgacttagacttttaataagtcagcttattagtttatatgatttatatatataaaccgatggatttaatgttttaagtttagtggtgaagtcacatctctacttcacataagaaaaaaaaaatctccaaactagtttttggcttgatgtgttgagcggcttatggcttcaaaataagccaaaaaaaaaaaactgtttgattaggcttagactttttggctcgtaaactatttactgggctcattttaattctgcagttgctttcataggcacgcgcattgtgattggatttcaactgcatatcgcactactcctgcggtaaaaacaaaaatcaacgtttaggataagattcaaccaaatttttaaaattccaaccatcactatattcggataaatttataaattgtaagttgataatactatggtgaatccacatataccaattttttatattaaacgaagctttcgggaaattttttatggccataatttgaaaagtttaatacaatcttgctaataccgaccattatacattccagaccgatgcatgagttgaccaatggacaagtacaaccttctagctctgcttgtacttgtagaatagaaaaacagtgtcggcggcaacaaaattacagagccccagaggttggtctgattacgagcatatgcacgcagtattttatgagataaaaaaatcaatctgtttaagatatcgatatttcgtacttcgttctgacatgtgtcaacctcattagctaaggttaaaaaaaatatagtccagaagaattactgtaatgtaatactgtagtgctggccagttttctccattgcaggcaaacctctctatgcaataagtcttgggagatgagatgtggaggccccagtgaacaagtagaatatgtgggcaatgaatcaattaagcatttcgtttccttggagagctagttagtggtagcggataaaatgaaatgtagggaaggaatacaaatgaagaatctcacaatgcgatgatgacgatggaaagaaatgccttgcttgcctggactcttgccggtctcgtccttgataccataacttgttcactttaatttgttctccatcaatcgctcaagcaatccatgctgccgcagaaggtggtgtaggtacatataagaaatgatgcctgcctgcttcttggaagtcatctttcttctctctccctccttccttcctcttgatcatctagtataaattgaggaggcttgctggatccatacaacaacaaagacagtagtatcatataacagcaagcaaataagaaagctaggtagggcattcctccctcctcaagtagagaagagctacagctgcagctgcagaggggggcataatggccgtcgggttgaggagatcggacagcattgccgacatgatgccggaggcactgcggcagagccggtaccagatgaagaggtgcttccagaggtacgtgtccagggtaagaggctcatgaagaggcagcagctcttggacgagctcgacaaatccgtcgatgataaggccgacaaggaccagctcctccagggcttccttggctacgtcatatcctccacacaggtaggagaattacttactttcctaggtacatgcgcatctctctgtcaatccaacatcatccatgggccatgcaggaggctgcagtgctccccccattcgtcgcattcgctgtcaggatgaaccctggcatctgggagttcgtcaaggtccattccgcaaatctgtccgtcgagcagatgacaccgtcggactacctcaagaacaaagaggccctggttgatgacaaatggttagtcaattaaatattcacatttgctttccgtgtagctattactattgctatttaatcaacatccttttttgctttataatctcataatctggttggttatatctaaattaattaattggctgggtcaggggggcttacgatgacgactcccagctggaagtcgattttggcgccctggacctgtcgacgcctcacctcacgctgccctcctccatcggcaaaggcgcgcacttggtctccagattcatgtcttccaagctgaccgacaacaagaagccattgctggactacctgctggcgctcagccaccgcggcgacaagctgatgatcaacgacatccttgacaccgtcgacaagcttcagacagcactgcttctcgccgaggtttacgtcgccggcctgcatcccgacacaaactactccgaatttgagcagaagtacatgctgtattaccatacctggtcaactaccaaaagcatgcaacacgaatacatgatccaatatatatttgtaatgcatcatgcaggtttcaggagtggggactggagaaaggctggggtgacactgctgaaacatgcaaagaaacactaagcagtctctcggaggtgctccaagcaccggatcccatcaacatggaaaagttcttcagtacggtgccctgcgtgttcaccgttgtcatcttctccatccatggttactttggccaggagaaggtcctcggtatgccagacaccggtggtcaggttgtctacatcctggaccaagttagagctctggaagacgaactgctgcaaagaatcaagcagcagggcctgaatgccacacctaagattctcgtggtaatttaagttttcaactaacaattgcatgcatacctgggccatccatatctattatattattaagacagctcgaaaaggaggcaccacgttcgctgtggaggctagaaattcccatattaataggagaaaaagaaaaaagaaaaagagagtccaagtagaaatacaatctaaaaatagctgaaaatcggaattaaaaataagcaatattgaaagaagtttccatataagaacccaatatgagattaatcaaaattcgaaataaaaataaaataaaatacaaaattagaaaaggaaaggagagctcaagtaggaatacaattttgaaacaactgaaattgaaaataaaaaattaaaacattaaaagaacataatacggtagtaactaatttttaaaaaaaaataaattatgaaattagaaaaagaaaaataagatttcaattaggaatacaatttataaataactaaaatttgtgataaaaataaagactattgaaaaaaaaaagaccatctaaaacacatgacgagataaattaagtaacatgcctataaaggagtagagtggtggcggttgatacgacatataaaaattgttaataaaacaccaaatggaatcctaatgacgattaaaaggaggaacgtcaggtaggccgtgaagcaaacaagtaaggcacttgctgggacttctagaaagtaaaaaaaaacccattgataatcatattcgatttttaaaatctcaatgacaataaaaatgagaagcagcgggcgaggtgtataggactatagttgcagagccgccgacggttgacgggacttctataaaattaaaaatgaattccaacgatagttatgttcgatttttagaatcacaatgacaataaaagagtaggcaacggacgggctgtagaggggcacagtgacatcgtttgatgggacttctaaaaattataaaaaatgaaactacaagtccaatttttaaaggttcggaacttccaaaaagtaaaaaaacccaatgataatcatgttcgattttaaaatctcaatgacaataaagaagggaggcagcgggcgagccgtagaggaatacaatggcaaagccgctgatggtttggcgggacttctagaaagtaaaaattgaacccaaacgataattatgttcgatttttaaaatctcaatgacaataaagagaagaaacagtggacgggccgtagaggagtataaggtaacgtttgacgggacatctagaaattataaaaacaaaacccaacgtgacaataaactctaaaaactataaaatccaatttttaaaggttccaacaagaatgaatagaaatagtggtagatcgagcaagcaaataaagaagtaaatgacataaggggtagcaactggtgtgacttttaaaaactatataattagaaacacgaggatgataaggtttggtcttttaaagtcttaagacaatgagatagctatttaataaattttaagtaaaatcatactaaaaaatatataattttgtttggatgctagccacgcaattgcgcgggccacccagctagttatcatatatgatactacataatcacttattgagaattcagatagatagtgacatatgaataaatgcaca

SEQ ID NO: 61123 - DNA, 2218 bp, Oryza sativa
tattccatattcacaatgtgcttgtagccatccagtgaacgatgtgagggctgcatatggaggaggaaaaaaattactgaagtattcacacagtgctgcaatttggtttctaatcaaattctagtggagatcactgaacacctttgtaaggtctttttctcttcttattgaagatgttcgccatccgaccatatctggcatatgttcaagaaaacaagagcagcaaaatagaaaatggtttggagcaaaaaaaaattcgtttgcatatcaggcagaggaaatcatgtggtactaactaggagtaaggaaggatacggtcgtacgaaacattagcgtacaaaatgcggttcttgaaagctgctagtgcagatctgaggaacattgaagaaacaatatgttctactacaatgtttgaacgaagaagatatgttctactataataagttagccttaagacctttcttatgacttacataaattttttatcctcatgatcagatgccatctctagcagaagaggtggcttgctaggttcaccatccgtgagaaagagttgggcaccagtgcggccaacaccaagggagccaaaggtgcagcaatcttttctagaatagatagcccttgaagaaatggaagctggtaatattattgcagaaaatgcatgtaattaatacattgatcacaagtcacaacatattcagaagtagtacttggttactggtctttggcctccgattagctatgcaacaatagtcgtatactaaaatcttactaggcaactcaaagtccaatatagtagtttttgcttccagcagaactaattttgaggggaataaaaatgtatcagataatttaatagatttagagacccacctgatttttccctctaacaccaaggtgtggggttgctaaggtaataaaattaattggttccagcccagcaattgcacctaatcctgaagtgcactccaacttttcagaccctccagttgtaggagctatacaagcagcactttgacttgcatccttcattgctgttgaataaaggatagaaatagcatatcgcgcaaacaaaccacccaaagaatgtgctaggaaggaaatctttctcaatccagccatcttctgaatcacatccaatacctgcttcgatagcggattttcgtcagagccctcttaagcgcagccatgagtgcagaccacagtttctacaaaagtgaatacttgaaaccttttgctaggactaactagcgagtacatacttgatttggctaccttgttccagcaacatcaatcccatcgaaagttttggtgtagatatttgacgaactagctgcaatgatatagttcactgtaagttttatggctagaaacgaattgttctcatttgcaaagtgcaaaccaatgtagctacagtaatgaagtggtgtgaatttcatcttgcagtactaattaaaaatataggtattctgtagtctgtacatctgatcctaagctcaattttgtcagaaagccaataggaatgggcaggtgatccctatatgtcatacctaccatagatgaaaaaattgtcacctaacctcttctttagcactgcttctccataggtccagtcactggggctgcattaaaagggagaacaatgaaggaaatttatcagcaaagctcaagaaagaattgtgacaggaacaactagcactgcaatcttgctatgcattttcagacaggtgctatgttatcgtgacaggatatactcaccttgcaatgataccatggacaagaatcagcagatgatctggtcctcgctttctttgggatttttccatgaaagatgaacgcgacacacggctacggcttcccccgaacgttggatgggaataaagttctctaccactgtcaagttctgcatgaatcaactgtcagcacactatttcattttcattaacacagcattttgaagaacatcgcgatactaagtacagtagtgttactttggatgctcatttggttgtgtcaaaactgaaagagatcttgtaccctcatgttgctagaaacaaacaagttaatatcacctagcttcttctccattagcaataaaaataaaaatcgacgtcaatcgatcaacgaagttatctactggataaccaattgtttatcccatcttccccccaaaatcaagaatgaaatacagaaggaatgggtatggaaaggcgggcga

SEQ ID NO: 61124 - DNA, 17715 bp, Oryza sativa
taaggagcaatgtaaactattgtcctagaataattgcatttgtaggaaattagagacagattagcagcatacacaaataaccacaataaccctatgtaatgaccacactggacatgcacacattccatacataaacttaattaaaaggatatcttccatctaattaatttgttagatgctatctcactagaaatacaatatttccgggacaaaatttgaatggtaaaaatgcaattattctaggacagaggtagtaatgttttccacgtatctatttccttaagaacaaactcaaaccgtaaatattagatcagttgaaatctttccataaattctgagaatgttcttttagagaaaagaccggacctttctatagaaagcatagttgagatacacagttttggggctggggataccagcaaactagaactgacctattacaggtttccaacactccattataccctgaatcaagaacaccagcagcaagggtagtcctcaaccatggtaagcaaggaaacagtgagatcaccatctaataaacagcagccaaaacctccagcccaaaattcaatgctcagaatgttatctctgaacactactgaaaggaaatacctctagctgttccaagtcgtttcctgtatatggagttgcagtccctgaactcttgacactacatgatgggaaaaaaaagggagtaagagtagggttaaattcatggtagaaacagtatatatatacatatatatgttgcagcagaagggtaaaagagaagtataatgcctttacctgctagactgctactaagcttcttcctccagatcaaactgcacacagtgttgccgttttcttgactgacaaatgcgagaactctggattgattttggatttttcaccgcagtggatgcacaccttcgccaagccacggtgaaggcagtggacggtgcagggagcacaaggcagaaggatgccaagtaatggaggctggagcagcagcactgcagcggaggtacgtgcccattttacagcagcattgcaaaatcttccctctgaacgtggcgccctctctcctacaaagtggccaatacaagtagcgtctaaaccttcacaaagatatgtacacgctctatagtatgcacacctccttggattctctccatcctgtgcctgtgagattcccaccgcttgagctgtgcatcaggacaagtcttgtctgaccttttgctctgcctctagtgattcccccctaggatgtaagatgtgtttgaggtagtctatatatattttttctcttgtttctgttgggggtacctttttcgctgtgttgtttttttcttgatagatatcagtaaaagctgtattatagtggtatatagataaacttcaagggaataaatcttaatgttggtaaactcatgtctttgaaatattttctgcagtcaggattttaagataaagagtttcgttttccaaatgagtacatttatctttgaatgagattcagcttttgtgatgaataagaactaaactgcaacgtagaaatggtatcaaatgcaagaacatctttaaacagtttaactaatgcacatggtcttagtcagagatctttgttgtaaattcaatcaagtggttccagacatgtctttggtctattatgctgtgtgactgtgtcctaaagagactgcatgatgttagattcctagtaaaaacttaagcagttgagtacgttgaagatgggcatgacgcatggtcaaagttggatcctcaatatcaaagttcctctatcatgttcgtttccattacttattttcgttttattcttgctactctttatgactatattcagcctaccgtactgcattatatgatcttctattagaaatgttagggcattaatcatatatgcgcacatggctgtcactgtcagactgtgtttaagaaccgagttatttgtatggtagcatagcgttggagatttggagtttctactcaaatctgggattcacttggaacaagcgaaatcctgaaatttatctgaccataattttagtttaagtatgtgacttaacatattcctggagttattatagcagtgcaaaagctgagaatatggttctcaaatttttaaaaaggggcatcttatacatttgcatataattttttaataagacgatcttatacatttgcacaatacctttttttcctcccttttctctctcccccatctctcttctttgtttgccgtttgtgtaaattttattcctcttaatacaaagctgcgcaatccttttgcgtattcccaaaaaaagtttttttaataagacgaatggtcaaatatgtgttcaaaagtcaacggcgtcatctattaaaaaacagagggaatacttgcactgttgcacatctgttgaatggttgagcagagcttccaatattttgcatcacaacatagctgtagtctgcaggtgcttggctatatgctggaagaaagctgaaaaatcttgagttgttacttttgggcacccttccatcttctggtaataccatggctgcaactagaaactatgggattggatcaccattgcactgtcttgagctgcaaaatctttactagttgttacctttgggcataagaatggtgcgggatgctgctatccattgtccagcaacaccattgtaccgttcctcatcgaggtaattacattcttatgcatttgcattgtttgctcttcttccacgaatggttttcaacttaaggctacaagtttttgtctctttgtcgcgtgatatggttgaataaaaatgatgtggagataaagttttctttgcaggtcgtcctcaagggaacatattggacagatcaatggtcgctgctgctatttatggaagatggcgttgatatgtattgcgggctgttagaagcgagagtaaagggagtttttttttttttttggctaagtgtggttggaactttagaaacagggattgaagcttagtcttcctcttatgttttgttcggaaccttgtgtgtaatgtttcaactcgttatgaggtgttcgagctaagtactcgtgtattatcctttggatgtgtgcacccacggtgagtgtagactgtagaggcaagatcttatcgatccattatctaaaaagtataggaagagaagcttactggtaagtttagagtagaaaccaaacactggaacacagaaattttgggtttttctacagcctttctgggttcttcctgcaccgtgaaaaggttcttgagcaacttttttgtgcataaatatgttgcaacatatatgatcgttcatgtcctccaaaggccaatgtgcaaatgttatctcgaacttggttaaataaatttagggacaatcgcatccatgcctccactttcaacctcaactactgttttaatatcactttttagggtttgcaatttacccccaatttttaaaaacgaaccaaccgtttgcccttagttttaacgcccgttagatgggtcccacatttttaggttaagaaaaacaaatggaaatgaaaaatgatttatgaaatatcaatttaccgttctacctttgagggaatggataagcatccaaccagctctcctctcccaccggattggtccttgcgcggaggcgacagttctggctccagcggaagggcacgcgcggaggcggcggctgcgggtgtgaacgagcgggcgaggcggcggccgcgagcgcgtgcagaggcggtggcggcggccgcgggcgaggcggaggcggcggcggcggccgcgtcgagggctggtgggggagagcatagcgctgcgggtgcgctcctacggctgcatccgagtgttcctcgccctgtccctgctgctgctcgctgtcgagtttgccgcctacctccaggggtggcacctcgaggaggtggcgttgctcctcgccgtcgacggcctcttcgccgcctcctatgtcgggtggatgcgcctccgcctcaactacctcgcgccgccgctgcagttcctcactaacgcatgcgtctttctcttcatggtccagagcatcgaccatgaagggtagtatttgtgatttttgttcaagttttgtaatttcttagtatttgtgaattgtttttgttaaagtaaaaaaatcacaagagatgctcatatttggtcgatgctcatcacacaagctgaaatcacaaaataggggcaaaatcacacaaagctgaaaaaaataggggcaaaaatgcaataaccaccaagggtataaatgtcaatttttctacaactagcaccgttaaactggctattagaagtgggggtacgcggctgattcagattcaaaaggtggggtaaaactgcaaaccctaaaaaataggggtaaaacaacaattggcttcgaaagtgggggcacagatgcaattgccccataaatttttttatggaaatcggaattggagttcccaaattcggacacccaaacctcgagctagagaaaaaaaaatccatcccttgccaagacgagaaatttgtttgaaagcattgcaattaggaggggactaccgatcgggcatgcgatctagacgtacaaaaatcgggcgctgatgttagcatgatgtcagcgccacccatgcgtgcaaaaccactttaaactaattttttttcttaaattatttatccaaatcatgatccgattgcaccattaaattcgttgcaactaaatcttcaaaacaagaccacacatggatatattccgacgaattttttttagcttgttattgaaatatttttaaatgttgcacaatgttccaccaagtatatcggaattgtttcactaagtagatcgaaaatgtttcaatcgtttaaattgggcgttgtttcaccttatataaaaacaatatttcagcaaatagcgaaagaatgttttaattcactgcaacattagatctatacatagtgaaacattctgagtacactaggtgaaacatttttagtggaacaaaaaataaaacgaattcccttaatagaaggtttccaaaatatatgggtgatttgttgcaaaagaatatttcgttcactgcaacattagatctatgcatagtgaaatattgtgagcatagtgaaacattgtgagtacactgggtgaaacatttttggcggaacaaaaaataaaacgaattctcttaatagagggttttcaaaatatgtgaatgattcgttgcaaaaaaaatgtttcaattcactgcaacattagatctatacatagtgaaacatgtttggtagggacacgtggcaggtggaagcatgacaaatggtggggcccagagggcatgcgcgtcgccaaggaggggggggagcgcccgattttgctcccccgcgctggtcacccgaggcgaaggataatcatgcaaattaaatggcatattatcaaatctctacaagtgaaaagtgaaacttgatatgattctagaataagccacgtcactcagtcaataatagccgttggatctagctgaaatcattatgaaccgttggatgaaggatgaataatgggaattaaggttcctgtaaataagggactatagtgtgttcacgtgacttcttcggttggaaatatcacctgcgttttttagtctcccaccagttttacacatgcacccctataaagatcttttattttagggtcctctaaataaataatatttttacaggtaatttgctccggtccttttacgataaagatacatagtagtatttacctagaaagccattgaaatttcgtattttcaaatttcaaaagtaactactgatgcaagtcagtagcgagagttgccacttgccagccaggtggtgagattgatatacgtcaatacgtgaagtgctgggattatttactgaatatatagacagtaaactcgatataatgacatgcacatagtatcttttttttaaaataaatttgctttgacataagaatataatctttgtgatacattttacaagtttgacataatcatgactaattattgttattataataatattgcttatttcaccaggtcaaaaaaattgcttatttcatattaataaatggaacatttaaaaattaacaatgatggaggtgatgggcgtgaaaacatggtaaattattaaatgtggtcgtactattgttaactacgaatcaagataaatttgttaatgctattgctaaacctacaactcatccatgacaagtatattctaccatgctcctccttggaataagtcacgaaatcccaccgtgctactccttgaaataagtctattttgtgtcccttatctctttggttcgtgccatgccgggctggcccatcatgccgaggcagaggcctaggcatgacccaaaggtcggccatgaacccgacaccattcgggccgtgctgtgtctggaccgggccaaaaacccgtggcatggcccgggccatgccccgggctgtttggccatctatatggtcacgcgaaccgtataaactagtagtttggaataagttcatctgaggtctctttaattgtcaacgaatatgattttcgtccttcaatcggaaaccagatataacgggtctctcaactattaaaactggtgcaacataggtcctatggcagtttgtacgacggttttagctgacgtggcacttacgtagctaatttgactcggtcttaatctgacatggtattgacatggcaatttgatttggaaaataataaaaattatgactccacatgtcaattacacaaaaaaataattaaaaatggtggctcaccctcctcttcttcctcatttctcccctctcctctctccacgtgccatggggaggcagcggcgcgcggcgccctataggagacgggagaggagcggtgcgcggcgaggcgtgaggggagggaggaggcatggaggccagcaaaggccgggggtcgtgggtgggggctcgacggcgacgggcagagggagaggtgcgtagcgggtgacggacaacagagagaagggagaagggtggttaccggcaagggtgacggccggtgagagaggctcacggtggttggaaggtagaggctcacggtggccccttcctcttcctctcgtcgctgcagccgcacaacgccgtcagaccatctcgatctgcggcacatccggagttgaggaggaggatgatgacgacgctgcagtgtcccgtcccaacctcgcgcatatcttggacccgtcaccgccgcccccttcccatgctcttgtcatcttgtcctaacctcaggcagcgacaacactagggacaggagttgaggcgcgcgggtagggcgcatcgttgtccgcctctagaggcggcgtcccattggatccttggtggcagagcccgccggccgatcgtccttctcaccgctctcccccttttctacaagacgccaaggtggccgaccagcgtagcaccgtccctcatgacggccatggtcatctccatctttcacgcccgtctttgccttcctggtcggccgccacccttctccccctctgtgtgcgcttgcctgccggcgaggccgcgagggagctcgaggagaaaggatggccgggagggagagaggagaaggaagcgctgtcgtgccgtcgttcgtggatagagaggaggatgggacccactgacatgtgggtcccactatttttttcttttgtctaactaacatgtgggcctcatatttttgttttagttttaaatttttatattttgctttcagtgccacatcaccgccatgtaggacgaggaccaagtcaaaccagaaacccagatgccacgtcagctaaaaccaccatctaaaccgctgaaagatctcgtttgtaccggttttaatagttgagtgatccgctgtacgtggttttctggttgaaggatgaaaatcagattcgttgacaagttaagggacctcaagtgaacttattccaactagtttctcgtgaaatttctctgccacgtcccgcacgagcaacggccaccccatcgaggtcagcttccgcgccgcccgcccgccggccctctccgacttcgccgtccactgccccgccctgcggctgcaagagccagccgactacccctccatggtgcccaaggccatcgccgtcgacggcgacctcttcctcttccgcatcccgatcgaccgcgtcggcaccatgtccctcactcacaacgactacttcgtctacgcggcgcggcctccccctcgccgcccgaccctagatctcctccccaacccgtcccacgacaccctgggagacagggagatcgccctactcagctgcagcggcggcgatggcggcggcgacggcgagccgtgttacgtggtggctgcgctcaggaccatccccggcagcacaaccatccacaggctgcatctctaccgctccaggccgggcggcgagcaagggagatggacctcgcggatggtgtccgtggacgaaccgccgccattgatgagggacgtggtgttccccatcccggagacgtcgcaccggcaagtgcaccacgtgacgagcaaggcgatcaggctgggatcgggcggagacggcacggtagggtgggtggacatctggcgcggcatcctcctctgcgacgtgctccacgagagccccaagctccgcgacgtgccgctgccgccgccggcgaaggggaacagccacagggccttccaaaaacaccaccgaccagtactgcgccgacatcgccgtcagccgagacaggaggttcatcaggtacgtccagatggagatcgtcacgcccaggatcatcgcgagcggcacgccaccgggcgaccgtgatcctgacccgttcctcgaatggctgcgacgtcgagaatccaacatgcatgtatgcacgtacgtgaaagattagagtaactttcctattatgtattgaatagactttgtttcgtactgataaaatttcttttttttgataaatctacaccctttaatttatattcattgtaatctaacggtgtagcttttttctctttttctccgattaatgtgggaatttctagcctccacagcgaacgtggtgccttcgttcaaagctattttaataatataatagatgattatattttgggatggagggagagaggaggggtaaaatggacctttcgcatggtccgatggcaagagtggcaaaaatggttccaatatcctgcaagcgtaaggcctcgtcgtagcgtaatactttccctttcccctacctcgtaaccgggaaactgttttaatccctcgaggggatatctcctcgttctttacatgttacttaaatggttataaaaagattaaaaaaatgggaagatgtattaacatgtgatataacactccacaaacatgtaagttcaaattcatcttgtacatctcgtaacgaaaaaaacaaattgaacagcagctagttaatgtatattcagagtcaaatttgtttttttcattgcgagatgtagaagttgaatttttacttgcatgtttgtggagtaatatatcacatattaatacatcttcttaaatttttttaatttttttcataaccatttgagtgacacgcaaacaacgagggatatcccctcgagggatcaaaatcctcttcccttcgtaaccctatcaaaccgaagatcccagatccaatcctcaccaagatcgatcaagctcctcttctgattggatcctcgattgatcggttgccatggccgccgtcgcctcctcggccgaggtccacgagggcacccggagctgcgtcctgctcaacgtccgcggctacagggcggcccgccgcgacgccaccaccgccacgtcctacacgagcaacggccatcccatcgaggtcagcttccgcgccgccctcccgccggtcctctccgacttctacgtctactgccccgccctgcagctgcaagaaccagccgattatccctccatggtgcccaaggccatcgccgtcgacggcgacctcttcctcttccgtatcccgatcgaccgcgtcggcaccatgtccctcacccacaacgactacttcgtctacatggcgcggtctccccctcaccgcccgagactggatctgctcccgaacccgtcgcacgataccctgggagacaaggagatcgccatactgagctgtgccgatggcggcgagcagtacgtggtgaccgccctcaggaccatccccggcagtaaaaccatccacaggctgcatctgtaccgctccaaaccgaacggcgagcaagggagatggacttcgcagatggtgtctgtggagggaccactgatgagggacttggtgtgccccatccctgagacggtgcacaggcaagtgcaccacgtgacgagcaaggtgatcaggctgggaacaggtgcaaatggcatggtagggtgggtggatatctggcgcggcatcctcctctgcgacgtgctccaggagagccccaagctccatgacatgccgctgcctctgccggccaagagcaacagccacagggccttcctcaacaccaccgaccagtactgcggcgacgtcgccgtcagccgagacaagagcttcatcaagtacgtcgagatggagatcgtcacgcccaagatcgtgagcgccacgccaccaggtgactgtgatcctgacccgttcctcgaatggctgcgccgtcgagaatgcaaggacctgaaacgcaccttggtccatggccgctggaaggccaccacatggaggatgccgatcccggtcacctcatgggacgattggtgccgcgactgcgctgttgaatctgccgagctcagcactgacaacccaaaggcttatgagttgctgtgtgctgtgagcaaagaaagtcttaaagaggatgatgatgataaggccatggaggcggcaacgacaaccacgacgaggttgccattgggacgcctgggcatggcttaccctgccatgagcatcgatgacgatgtcatttacgtgctgacaaaacccgtcatggggaatggcaaggcggcatttctgactgctgttgatgtgaggaggaagaaggtgctggcagtggccaagcttgatagcgccgttttcatgcgttactaccttgccgttgggatctccaaacattttttcagcgctccaggtacttcgcacctactgctccctgttgccatttatgttttctgataatgattgaaatttgcttgtgtgttgtggtgctaattaacctgtagttacagcaaggtagtatatgcatcattaccagcaatgctgacttaatttaggaggatattgcattcagtgcagcgactgacattagaggacagcaaaactgttgtagaaatttaagtatttcatttttttttgcctagttatattgtccaattgtctaatagccacacatagaggtctcatttttgttaggtacttttgctattcaaaagtatattagtgactaggtccagcatcactggaggtcaaatgtttgtacataggattcacagtaaatgggaaactaatctaatccctcgaggggatgtttgtaccgaaaatctgcttcacagtaaatctgcttctatgtttgtaccgaaaccacatgacagaatgagaaagatcagtatgctgaaagttcaggtctctgatcagcataacaggaggtcatctcctataatggaagacaaattttaaggatgccacatttttcaccataatattcttctcatcacataactcgtacaagatgggatataagatgctatgtggactatttgtcagtcacttgtatatcttccaaaaaatgtgtggcaccaccagacatagagatcagatcgcaaattgtgtacacatttcacattacgaactacatagctttgcatatactccatccgtttctaaatatttgacaccattgactttttagcacatgtttgaccgctcgtcttattcaaaaacttttgtgaaatatgtaaaactatatgtatacatataagtatatttaacaatgaatcgaatgataggaaaaaaaattaataattacttaaattttttgaataaaacgagcgatcaacatatttaaaaaagtcaacggcatcaaatatttagaaatggagggagtatatatttggccgtcgatcaacaacttttgccataagcctagttcatcttccaatctgctttttttttttgaaacctatcttccaatctgcattgccatttacataactaggtaatgataattttcctgggatatttgaccccattacctcttttctttttaaagatttagggcctgatccatatgacagttcttgcttttggatggtctgacgaatgaccattcgatgaacatagcaacctggtaaccttgattcaggacggtaaacttaatgttggtgcggtgcaatggtagagtactaccaagagtctgcactgtgtctgaagataaatcttagactacttgccatagatggaaaatgaaacttaatctgttccaaaagtaaaaatgaaacttgaactttgttagaatgcactgttgcagtctgtgcagtggattcttgtaggaacaaccaaactgttgtttttttaagggaaaatggcaggattactgcccattcattaagcaggaaatgtttttccttaaaaaacagtttgataatgacctgttcttagacaaatgcagctccatgtaagtattaaaatgccttcggtggtggccaaaagttaatttcttgttgtctcaatgccacttccattctcctgtgattaatatatctaaaattttgaccaaggtataacatcgtttgcattcgtcataaatattaatatcagtaaacatgttgtcaaatcttatttctgcctcgttatgcttctaattatattatattgttattatgcggttaatttaaccataaaaaagtaataatcaaattgcattagatattaatatcagtaaacatgttgtcaaatcttatttctgcctcgttatgcttctaattatactatattgttatcatgcggttaatttaactataaaaaagtaataatcaaattgcattaggaccaagttaatttcaaaacaagaagggaatgaagcaagtaataagatattgaccaaaccaatttcgaaacaagtagttattatactgctgtattgctttggattttgtctgtcttattgtacttgccgacgacaacatgaatgctcttacccttgatcccagataatgccgtaattgttgcttctaggactttctttaaaagaaaaaaaatatgagctattttatttggtgtaggtacaagagaatcacttggacaagctgaagatcatgggcagaagtcagcaagaagaagaagaagaagacgtggaaagcggcaagagtgatgctgtccagcagtgagatgccaatggtagaatattatcggcttgagtctgttgctttcatatggataatggatttgctactgctatgtgcagttctgtaacaaattctagaaccttatcatctgggtactttttttgttctttttcccttcttgcaagcttcttggagaaaacctctacaatagcttggctataaatttcagttaactatggctccctctaaggttccatattttgtcctacggtttatgagtcctttccaaaattggaattttagaacttttttaattaaagtttatttataaacattagtttttaaatcgctaaggatacattataaaagttctactcgtagtgttttttctaataagccgtacaacttataatcagcattaggtcatagtgttttttcatgatggtgtatatgatcatgctccctataaaaggagttgtttaagttgtcacaaatattggaatgcaaacatttcagtatgaagatgcatgcagcaccgagtgacacaaggcatgcacacaacagggattacaacagtacaacttagtgttaattattatagttctaatgaaactggtacgtacttcagaattaaatgggtgtatgtatcttctgaattgaattggcctgatgcgttggttttgtcctatgaattgagactgaagattcgactctggtttttcgttgaaatggaatggaatgggttcatgattctagttggaaatatatagtgtgagttgagaaattcgaacagttaagcgaatcaaactggaatgaaaaacttatatcagtgtcagtgcaagtaaacggcatggttccattcctctaagccgagatttttgcacaacgaaacaaacttttgaatgggccggaagctaggcccatataagtaaacaagccggaatttaggcccataactcggcccatacacatggatgggccatcgtggtgcatccaaaactcgattttttattaaaatatttataaaaagtaattttcattttgatctgcagatcattcagaataaaaattactttttataaatattttaataaaaaattctccaaaacttgccgttgagaagcgaggagggctgctaggttgctccgccgccgcgttctccggcgaggagtcaccgcctccgtcgccgtcgacccaccggaccgacgggattgaggtggccgtcgccgccagcgctgcggcgcagattgccgcgccggaagcgcgaacgatgggcttcgtcgacggggcctcctccatccactccggtgaacacggcatgcagcggcggcggcggcggcaccgggtggactggctccaacgcgccggtacgatgaaccaccaccctgtactgtgtttgttgatttgttcttctcattcgacctgttgcgctatgcgtgcgtgtgcccttggatagttcatagttggatacctggatgcggcctcgatttggtgtagagctgcagtgataggtgataaccctaaccaatttgagataagagatttcaatgccaattcaattagagagatgagaacacaatatgttaattaggccgcaagtccattgattgatagtctcagtatcatgctttaggaaacagtaggaaaattgcataaattaactgcaaaacagtaagaaaaatacaacatcagtaggtaaaactagctagtggccggaacaacagcacggccaattttattacaacctcagtacggggaagaacactgcatagagtaaccgcaagtagtaggaattactggaagatctctttgtacactatgtttttcaccattccttcgcctgggcattctttgtcagcgatcatgatcttcaggccatctctgcttgtgactctggagactgcgacatagagctgcccatgagtaaaaacttgcctaggcaaatagaggccgaccttgtttaaggtttgcccctgactcttgtttattgtcatggcaaaacacaccgagagaggaaattgctttctgtttagcacaaatggccattttcgttcgtttggtgacatgatgatttgtgggatacataccatatcacctatgtgtgttccggttataatctctgcctcaataacccttttcccgaatcgcgtaattctcattctagtaccattacatagccctgcattttgattgatgttacgaagaagcattactggtagaccaactttgagcttaagttggtggtttggaattccggggtgctttaagctgtttaggaactctgtaggatacaacatttccatctcatggctgtaagacattgatttgctcacactgtcatggctaaggtaggttaccttgtcaccttggatttggtccataatgtactcattgagctcattgacatcatcattcgttggacacaatatcgctctctcttctaggtacttcggcttgcagcaattgtattgtaggccagggtaggtactatcgacgatttgagcttttggatcatctcccttttgtagcagcaggtcactaggcatactcacccaacccttttcatctaataaaattgtgtcaccgttgccgattcgtagtatccactcagcgaattccgcagtcttctgatgttctgcttgatctttggatacagaattgagccgcatattttttgtcaaattgaacacctcgaaatgttgccagaggtacgagaatttgattgatgcatttacagtgtgctcccttcttccttttggcacaatggggaggatctgccggaagtcccctcctagaacaactgtcatgccaccaaagggcttttggtaactattctcatttctaaacctctgtacgtcccttaggctcttgtcaagtgcctcgaaacagtttctgtttgccattggagcttcatcccacagtattagtgatgtcttcattaatagatcagctatacgcgagccttgtttgatgaagcatgtagattcatctgttaggttgattggaatattgaatgctgagtgtgctgttctacctccttgaagcagaagtgcagcaatgccacttgatgcaactgcaattactatctttccctctgatcttaaccttgttgtgattgctttccaaaggtatgtcttgcctgtcccaccatagccatccacaaatattagcttgcctagtgattggtgtgccgattctattattgcatcaaatgcctttttctgctctatgtttagagtgtttagtatttgcaggtgctgatgcttcaacctctctttgtcatagttcatctcttcatttataagactgttctcaatttcacttaactttgccacatttgggggctctattccagtgtattccttaagtgattttcctgcttgtcgcatgttcttctcaatttctattaaagcacatttccttttatgtgaaggcgtgaggcaggaggcaggaaagttcaagagccaactttgtgtatgctgaatgtctttggagagttcctcccagatggattcccacaaactctttgggtcagtaacctcacagtggcataaaatagttgcgaacagttgttgtaattctatcccagatgcccaacaggatgcttccttaatgcactcaatccactcgttgtcatcatttagaaatcctagtgcatggcatgctgatttgtatgatgagtgcacgaatccattgacagttctgatatcttcaaatgttgtgcaaccctttgcagtgttgaggataactctgagatagtacctttctccacttgccggatgggcattgtagattctgccaattttctttcttccttttcgccttacccatttcttcactttgttaacccacgtccattttgtaggaaattctgaatatgttaattctctggcatcttcatgctttttgtttgtttccatccactcagtaaacatagtgacccctgatcttgggtgtcttatgatttcctgtaggtctgttgagtctggaaaaatcacttgttgctcattctccacgtggaagaatagcctctgaacagatggttcttggtagtgtagaggaaatgtgaatattcgccaacacgcttcagttgctgtcatgtaactacatcccagataccttttaatctcatcgttatcttttgcggtatcagtttcttcaacaactgctgttgcttggtcatctccattgtagatgctcttaaataggtatctgattgacttagaccggttaaaccactcgacatttatatgtgcttggaacttcactaggagatctttgttgtatggaacaacaaatccattgttcaaattgattcgtcccttttttatctgccttccatctctcgtgtcttgtatattggg

SEQ ID NO: 61125 - DNA, 20053 bp, Oryza sativa
  unsure (1)..(20053): unsure at all n locations
ttgcttttcattcttggctggctagggaccttccttggccgccacgacattgtaatgtcgttgtaaacttttactatgtttttcctcccaatcttaatgaaattggtcggctaacctttggctgacccggcaaaagaaatcgtatgtataataaggtaattaataagacaaaggggcaggaagtaaagtgcatcttctggcatcataatttgctaatcatgtgaagattccagttgcaaactgatacagcttatcttgtgaacccaaaaaatgtctttttccatttccttcactacttctatacactgataatcctaacatacaggatgtatactacgcaaaagaaaaaggtaacctttacaaaagtataaaatgtgtaacagcaatgacttgagtaagctaacaacaagtcatttgacttcaccttgatctaccgtctctgtttagcgtctcccaactaatatcctggccacattctttgcaactcgtgctgcatccaggcttggtgccttggcttctcagagtaagcaagtggctcaggttgttacacttcttttggttgtttgaagtgatcttaggctgctggggttgccggcttcttgaagtagctttaggtggttgtataaggctgctctctgttggaacagtacttggttttctctcggcgtcatgtgtagctttcctcggggcaacttctagcaacttgttgtagcttaaccatgccatatcttgctcctccttggtaagcctttcttcttcattttcttgcagaagggtttcatgttcatggtaacttgcgatccacctgtaaatcccaaaaacaaagattaatgtttggcaaaggcgagcatggggggaaataagcactacgagtttgacaagttttgagttatatgatttttatagtttatacgctataagatttatagaatgacatcctgttaggttgagtagcaaaaaatataagcattaccgggagtggtcatgaagtaggttcaccatgagcctgtccaaaggtaaatgttcagtggtttcactggagttgggagtaggtggcttctcagtcccaactttactgtgaccattcatggtagaaccgctctgctccagtagttcctcatcaccaaactcgaaaagatgcaacatctcttctttagagattgttctagacacttgctgtctatccaccacccttgctgcaagcccttcttttgtcacctatattaataatactaattaatgaattaagtcaataacacaactagagttttaaacaagaaaaggcaactgccaaattacctgccgtttatatattttctcttccattgttgcatgagccattaggcggtaagcatacacaggcttggtctggccatacctggaaagaacatacggtgagtaaacaaataatcacatgattgttcaacttactagtaaaaatcaagcaacaagttcttgcctccaaacccgatagatggcttgcaaatcatgggttggattccatgaaccatcaagaagaatcacacggtttgctgaatgaaggttaatgcctagagatccagcacgagtagatatcaatgtgcatttcactctaatgttttcagggtcattaaacctctccacaagattttgtcgctcagaagatggagtgctcccatcaatcctattcaacatgacagaaaacaagatcacatttgcagaataagataagcttcttttaaatataaatatcgccgttgccaaattaaatgctggtaacagcactatctttgcagaagaaaatatcagcaattcttccctgtcaaagccttgtgatgcaaaaggcaatgttcatttttccattttgtgttgaggcagtaactataaacagcacatttgcagaactacatgctggcacagacaatcacttgtgcataactaaatatcaataatgcttgtatatcaaagcctttggtgatgaagtatcacctttgcataactgaggttatacacttatactggcaggtttagcactggtgcactagtgcgtgcttcagagtaaattattaagtctagatacacctatggtttatttgctataattactgtacatccatatttaaatatataacgtcctgactttatttggtctttagtgtgcaactttgaccactattttttattagaataaaacaataatatctaacgaaactgttgtaaaagtacttatgtccaaaaaatacgagttctttatcccatcgtcaaaaaagttgtaatcatctaagttgattgttttttaatttgctataatatttagttagattaattaacagtgtggtatactggtattatgaaaccttaggaccacaatacccagggttatgtgccacatgccaaaatccatgtgattttgtgcaacttgaaccataatactcaggattttgtgatattaactctatatttaaatacagaggtaatactagtttactactgaccagcaaaaatatgtacataggcagaaagaacatgttatgatcagttgcaagcagcagctgtgctagtgaattcatgctcgtagaacataaaatgcaagcttgcagtgtttggatgtgtgtctttatttcttaactactcagtagtgacaatacaattcatttgaaaatagagttgtatgtaatatgaacctttatatctgaagaggtaattttattatatttgatatacaattataacagctctattatacatatgatgatttggttaagttgcacaatgcaacacaatagatgatgtagatatctctttttccactgattaagcggaagtagaaagtgatgaagtatatttctcctattttattatcatgctagatttttcaggattcagtttaaataacaaaatatacacttatccataaggtgatgccaaattcctagtatcgcttgccaatatacctgtgaaactccatacagtccaaacagggctaggtgcgtagaaaataacaaagcaaagtaacagaaaattgtcacttatgaaaccaccactgatagttgtattgttcttgtgtataaaaaataaaatgcatagagtgtgaaagtgcacctgtaccaatccttgccttgtttccaatatttgccctcttttccattaacttgcaacttagatagataaaattccaccaaatccagagtgctcaagctctggctgaacactaatgccttgtcacccaattcagaacatgatgacaggatatcaaggagtaaaaccattttgccactataatctgcttccttataagcattttcatctaaaagattctcccaccagttactttcctacaataaaggatatgcacataaacaaaaatactggaacgtgtgggtgtaggtgcgatactaaagttatgttccttaaccatctgtttttggtttaaattaaacataattgcacaggtaagaccagactcaccagactatcagacaaaatatagcgtgcagctagaaatcataatattaaaatatgatatgcatgaacgaattacatgacaatcaattcctaaaatactgtaaaatttgaaacttgaaacaatttatagccaatatatattcaagtacctcatttacaacatcagaacttttcttggatagctgatcatttctgcttctcagcttctctgtacaaatcacaaaggtgaccaagtgttaatttctcacagaaaaaaaaaaggagaatttgaaatatatcagaagtttgggttctgacttctgaaccaaaaaatagtcaatcaaacactgataaaattatacgagtattatattttactaattacaaatagaaaaaaaaaagagctcaaaaggaaggtctgtgaataataaattacctccatttggcaagtaattttcaatattatcatcactagagctctcatccatcagaaaggactcgacatcttcttggcgcaaatttcctttctgtttagccatctggagaagaccaggatggttccatatctacacttgaagcatattgtcgggcatgagaagaaagaacgtaaacaaatatgatagtacaacagaacattggcatgttatctaataaagacataaagatgcaaaaatgtcgcaccagcgctaacgtttggtacttggcaaagaagccactccgctgaaaagatttttctgaagcagcactgcttgagaaaccattcacgtccaagaatcttctgtacagcttcctttgtagttgagagagtttaacagtaacaacaaaaaccttcttttctggtagatcattcttcaccacgttcatgtccattcgctggacaaatcccttcagttgttcatacagaatatgtgaccgttggttcatgatcttgacatcatctgatgtagaattcgtgtgctgcccattttcaatggggttctggaacctgataatgcaaagcatatcattcaaatgtccagaatattaatttgccacagtaaaagagatcagagcatcaatttacctgttacggaactcatggctacttccaagataaccttccctaacaaaatcaaccatctgttaaccagaaaatcaaaagccattagaaaagtactacagtcagatatcaaaatactgttggtagctggaaggtaaagtagcaagggtttagggtaggagtgcataattccttacacagtaatattccatcaaattattctgcaatggagatccagttaacgcaattcttctctgtgtccttacttgtttcaaagcttgtgtagtgtcagctctcctgttcttaattatatgtgcttcatcacatacaagaatatctggcccacactgattgtgacatatgtaaatggactgtatcaaaacccacatctaaaagaacaaggttggaagaaaacatacatacagtataatgatgcatagctcatgccagatgaacatctatgattgttatattaccacataaagtggaatggtgattgaaacattagtatatccatggaaaggaggggtataagatatggatgaaaaaggaaaatgcctatgacttgacataacataaaagcttgaaatataacagaataacaacaggacaaatggaacatcacctgcaaagcattggtgatctcgtttgcaacagttttgtccctcgcactccttccaagggaaaggtttctaaatgatgaataaccaatcagaagcacgccaccttttattcgccacttttttagtaaatactgaatgtttgccctgcaaaaaccacaagtggaaggggagtcctttcaggccaaaaatagaacaccccatcataatcgtaatgaaaccttatttcgacagcatatagaagttttgacacaggcagacattccatcatcagcagaaaagggcttacaagaatattcaccctaactaatacatctagccacaggttggttatgcaggtaatcaattgaacctatcggtacaaggacatggtggaaccttcatcttccgttgcatttagaaagatgccttgaagctaaagcaattcacatgctgccaaaggttctgaagtgctgaacaatagctttcaagtgcaatacacatctaatgcaaggtcatgaaaagggaaataccaaataatgcaataaaaagaagctcgacagcaatgtcctaatgctgctgaggtgaaattgaagattttcaggagcatagctttcattagtggttatcaacatcataccatactgaatatgtcgtttcatatttctgttttcagcattaggaaaaatcaatcgcatctaaccaagtgagatttgtgacataaatctagagaagaaataaagggtaatgccagtaaccttccaaatgttgcaaaggagtctacacacatgaacagtttttttcttgagatttgggggaattgaacctagggtggctagctaacttatgtttttaggtttgagagtaacagattaacagatgcagagtttgagtttatccttatagctcacagggtataatttattttgaggctggcacgtgtcaattatctagtattgcagtagggaaaataagattatacaagatggtataacaaaggttctaggttacatgaattagggaacaaatttagtaccccctccatcccaaaatatagctacctttctagttcaaattatattttggggcagagggagtatcatgtatcgcataagacggcatttgatggatgatccaaagcaaggtctacaaagaatgattcaagcgattgagggtatcattagattttagaaataacttaggtctggatttcctaattgatataggcagatctaatagatctttccttgtccgttagctaagttttgtgctaagttgcttcaaacctatgtgcaagagtttcatagtctaattataaattccagagtgcatacttgcaaacataagacaagataagtaacaaaataattaacctgcaccttggaacatcctccaacatatacacacgaagtggcttaagttctgctggacaccatttgatgaactctttcttccagttatgcaaaacattaacgggggtaactataagcgccgtgcgcagtcccaactggatgcatctcataacagtatacaggaatgtaataacctgcaaagtcaaaatgcaaaaatataagaatacagtttccattattcttttgtgaaatggaaacaggaaagggaaaacaaaggccaccttgaatgatcgaaaaacaatcggcacatagttatagttaacaaatccagcaatacaagtacaacaattaaaggtaaactgacacccaaagaatagatcgatagatcctagaatatgatctaataaccatggaaaaaatatgataatatggctgaatcatgtaatgaagaaatcaagaatatatattacaggacaaaagtcagtacaaacctgaaaagttttcccaaggcccatgttgtgagccaaaatgcaaccaaaacctttatccccagatttgaccttcttgacagattggatcacattttcccacataaatcttattcctgatacctgaaatatcatgatatattttagcttcctgtaacagtataggtacaactgtacagaaatcatgaccagtgtgatggtgatgcgatactggcacatgaacgtcaaacaggtaattaaccagtttaaaagcaaaaataagaaagggaagttaagacgcatatcagactttctatttgatgtttcaacacacgaagacacattgcaatgttcagtgtagagtttcaaactaaatgtaatttttaaggtgaatgagcaatactgttgttcagtatatttgaaaaagcaaacctgatgaggtttcagtttagcagatatgctgcttggaattctaacaggtgcttcatcttcctcgcgggcaaggtttactatatgtccatccccaacatattcagaaacctcagatggtgcttccaaggaaattccgatattgttgctctttaacttgctggcagactgctcttgcatggacttcagatgttcttgcctagcctacaaaagaatgtttagattataacctcaatagcttcaaacaaacatagataaggtttatcaaatccaaaaatactacagaccttctccattgcaattttaagctttgtttcctctccaagttcttcgtcatccatgattcttcttatcctctttttcattttatgcttgctgattatttttgtgtaaacagttagcaaggaaaaaatttcaatatttaatccgcatcaacaaaagtaatagtaaaccaaatgcaaagaattgtgatgaaataaacaatacaatggtaaagggcatacctaaaaggaccattgctctctaatacagaaagctctgcaaagtcattctcaggatcagaagactcaacaccacctagggccttgtcacagtcagaaattaaatgttccagttgactgggtaggcagcagcaacattgccaaccagctactctagcttccgataagccttcttcaccaaaattctttgacaagcaatttctgcagaaaagcagtttacaagagctgcaactttgaagctgttcactttttacacaccaggtgcaataaccaccagacacaggatcctgtataaaacgagtacatctaagattatgattgcataatacatttccataaaaaaatcaatgttatttgaaattatcttgaaatctacagaagtggtatgtattcacctcgagacgattcttctctatcactagaaatctgcaagatccacaaattataacatccaatactgggtggcggtgcacttcagggacattcaacatttcagtgcaaatagtgcacttgaaaggtttaggccgaactttatcaccaagtttagggctttgtgatgggaagatatcaagatcaataatctcatccgcattttcacttggtgctgaatctggcttgctatcagtctgcatgtcatcatcactttcaataattacagtttttgacctcttattgtcaaactcaacatcatcttcacgtgtgcgcttcgctagctcaacagaaactccatttcatatgttttgagttttttgggaggcagctcacagcatccatttgatgatgacgccaaaccaatgttctcctgaaaagcaagacagagtagatgaaatgctaaacagtgcacccaataaaaaatcaacaatgatatagataacaaaatggataaataaacaaaacagactcaaactaaataaaactttgccagttaccttatgcaaatgtcttgtccttctttctttcaaatggcgctgcagacgttttgtcatctttgcatcatcctcttctggtacctacagagatgtacaacatttggggaaaaaatatgaagaaagtgaaatagaagtgcttaccagacaacataaaagcaaaacatcagctgttcaacaagaagtcaagaactgtgatacttgtattgcaatcacatcagagaatcattatggccatgtagaaataaaattatatcatccaccatgcaactgaaatagttataaatgcaaaaatgatagcataaaggagttatatcggccaacaaaccaacattagaattcaggtgtttacacaccgcaataaatcaaagtaataaaacagaaataagtataaacacagtaaaatgactataaacatgcacacaggagacatcaatgggtaagaacagcagcacaaacaaggcctaactatagctctgtagcacaacaaaactagtttcaacttacctttctgtattttcttctctgtacttcagaaagctctatttcatcgacaccttttatgtcactaacagcaccctcaacttcagctatctcctctacctgtaggacaatgagagttggagatttaatggaactgtattgatgtgaaagacagattaaaaacaagtgaaaagttgggtttacgtatagacagaagtttcagtataatgggaaatggtaggctgagccaattatttacaagtatataagaaatgactgaaaaacaacctaaaacaatatcatttttagtattgacaatgaaaaccaaaaaaatctaaatgttttctaattgatatgtacattagaacaaactaattgaaatattctaatctaaatgtatgtggccctgaattgacacaatacaacttacacagtaatgtacatgactcaaggatgtgttcaacatagaaagacctggcagctgacagtgttaaaccaagtcatttaaatcacatacaacccataccacaagcacaaaccatattggagctcttaactaagctcacatgtttctatgctcttcaatgtttaagccctgcttcaaggcctaaaatacaaactactttgatccttggtgcctctctttagaccctagtttcttttgtctcaagaatttcttgtggatctaataaaaatgtactccatccgtcccaaattatagggcaccccctttttaaggaaaatcaaacttggtagcttttgactaataatcatactaaccatatatatgttaagtattatgcatgttatattactagaatcatattttaaagtactttcatgtgatgctaatttcaaatttgttggaaacataacatggaataaaataatggtcaaagtatgtcactaaagaccgtgtaaaaaaatataggtcttataatttgggacagagggagtataacaatagtacagaattatagcagttgatcagtctaagtcacacctcatcaactcctggaaattggagacctaaagcagccgcttcttgtggggtactggccagataaactgatgcccagttactacttccgaaagaactttcagcatattccttagatttggtaagttcattgaatgcattccaacttttctcatggcattgtgcagatccatcatccccaacaggaatctttccagcaagaaagccactagcaccttcctccagcaacctcccatgttttctaattgaagtgtgtgaatcaaggtcagatttgagaaacaaaaacacaggaacacactaaatttggccccaacattacctccttacaggtctacaagattggaggtattcatcagcttttctgattgatttattagcttcctcaggcacttgataaccagcccagtgagccctgttcttccatgcttcagtttcacaaacatttggaacttggctttctatagacttgtagaggctgggaagttcgacaccagcagcatcaagttgctcctgcattcaaaatttcaaatgtatcgcctactacttttcttggatttcataaaggaaataactcatcgagattacaggtaactcaaaacacataacaaagaacttggaaatttaaaaaacgtaaaattggttacatagcactcgaacatacccatttcttgcacacacaaaatacaagtgaacttttctacataaattgcttctagtaaaaattgaagttttctgtgtaaaatatttctatctaaaatcatagaaattgggaaagagctaagatatgaaatggtgaaatttgtaacaggtgaaagttagagtgatatgaaatattcaatggtatgtttctaaagtggatatcattcgttgtatggaaccaatttttccaaataaacatatcttgatttatatagattcttaaattaatatgacaagcattacagtctgcagtgtttggtacaggcatgacaggtcaagctataagaataatcacttattgttctagtgttttttcaaggtcaagaactctaattaatctaaataagggactgtaaaatgtatacttaattcattgacactataaatgtgagtacaaccataaacaagataaagaaatattttggccttcattttgataaatcaatatggtttcatataaaagtgcttcaataatttacatggaacaagtacttaggacatgcatctaacacaccacataggaatggtggcaagcattgacttaacagataaatataattattattcactaatgggcaaaatgatcccctttgaggcaaaaacataccaagagaacagcaatgtgagtctccaaatcatcaagttcagattcccattccttcttgtattgcttcatctcagtagaaacggctgactctaactactcaaggtaagaaaaaatatacaatacacaaatagattaatcattgaagcattatgcattatagaataaattataagcatattgacagtgttacggacctcatttccttggagactctccgatagctccaaccttacttcagattcaatcttttccagtgactccttttcaagtgattcttgcgcttgagcagcctagtgtttccaaagaataaaaaggatgaaatggaaaacgttagggggaaaaaacaaaaaatgaataaaacaacaatggcaaataccttgctctcagcgtcaaggaattcggtaattaatgtttcaacttcttcatcagtgagaggtgcctataaggaatcaattttcagaaaaatggtaccaaattacacacaaaagagaaagcatgacaactcaagccacactaagatttccagcagttgaacagaacagaacacaatgcaaccgcagaacagataccagcaagttctatgtttcaatctgttcgaccaaaagaaaagtaatagcattgaaaacaatactgataaacatgtttatctaatacggtgacagtgatgtaacataaaggttgtgcaaatataatgagagcaactatagcaaagggcatatcaaaagagttatcctcgagtgggtatattgcttaatgtgtccaatgttgatcatactttttacattgattggaaaggattagatcccataaacatcaacagggcaagataaaacttaagttacccacccgcagatactgcaatagtacatacctcattgtctccctcaccagcatcagactctgaagtttgctcattatccgattcccgaagaaggtattcatatgagtcattctctgaatcatcatcggtggtggatgcttcctcatgcaaatcattttccattgttccatattcatgcgccttgtgcgcctcacagataccatgtcttgcgtcagtttccacttcaagtttatttgcatcactttcaggttcaataattatagttttatcttcccctgcctctccattagagtgaataggttccattttcttggacatgtcatcagataattttctattctcatccattgtgttcactatcaattgcagctacagacacataaactgtgccattcttgttaatgaactcttttctttttctgcacatagagaatacagatattgaaattgagggaaacaaaaatgcaagtttacacagtcaatcaggccaagaggcagtagtagtaaaaggagtacataatagtaggcttcgattgaaggattaatgaaccataaattactcaagaatgtgtgcagcggcagaggacataatcacataagcatgactaaaaagcacacagaggcaaccagaaaagaacagcttcaacccaccaagttacaacgaccccaacacaacccaaaactgagcttgcacatcactaaaccctaaataacagtccaaacgcggacacaagaatcaaaaatttaaaaaaaaatactttgctaaataaaatgttcctgtgattctctcaaacagagttagcattgcaggcactccaagccaggaacgaagcacgcggcgccaaattgggaacccagcactaccacggaacaccccaaaataaaaaaaaatacaacacgaaccagaggagaacaatctagcgatccgacgaatccccagcccccaccaaaacgaccacacatttatcctccaaaatacccccacacagcttcaccacaccagagctaacgcagacacgaacacacacacatccacggacgctgcagctaaaccgaccacgatcgcaacaccacgccatcacaccaagcaacaccaccagagcctatagccggagacaccgaagctgtgggccgattacctcgggaaaaaaccgcgccgcgccggggcgccccggccagccctcgcgcggcccgccccggaggagcacaccctccgctactctccggcgaccgacgacggcggcggcggcgacggcggcgatggggggtttttgcgggggaaagcggcggagggggtaaaaatgagatgcgtgagcgaatgggtgggaaaaaaaaaggcgaggagacgccgggaaaaaggtttcttcacccaaccgcgattgaaaaaaaaaaaaaaaaaaccacgaccactctcccggtccgcgctttttcaacttccctcctcctgtcctgtcctatacaggcttcccaccaagattttgatctctcgatttctgtggatcgaatttgaattttgaatctactgtggctattttcgctgggatttcactgttcgggtggagtatactagtagttcggtgggctgagaaaaaaagattgtaccggatgttgtttaggattgtgaatttgtgatctgggaaggcaggatggcagaaagttgtttcagatttggatttattttttttttatggatggggatagagctttcctttaaagatttctttttaaggattggtttggcccactcatgggtgaaaacttggttaggatatttagtccctctttgtttaaggcttaggcttattggcctagatttttaagtcagcttattggcttatatgatttataagccagtgaatttaatgtcctaagtttagtgctggagtcatacatctatctcatataagccaaaaaaagcttctccaacctagtttttggcttaatagtgttagagtggcttatgactttaaaaaaaaccaaataaaaaagctgcttgtttgttttggtttagacttttcgacttataagttggcttataagcctaaacaaagagggtcttaggtggttggactttgtttacaactgtgattcgattttggtgctggtgaatctcatcatatggtttgatagatccgtaaggttgagaggaaattatcgataattaaaaaagttgaatacgtaagtgatatagataattggaaacaataatactttgaccctaaatctaataatctaaaactggctcttttgctagcttttgattggtccacttggcgtctcttactttttaaagtaagaaaaatcataaatttataccagagaaaaaatacctaacaatcatacgtaaggaaaaatctagagaaaaatgcatatggatttttagaggctttcaaaactatattccctttccaatcacacaaacttatgctcttttacttctataaatataccatgcctactcagtactacttctataactctaaaatatatagtaaacccagaattattaataaaaaacaaatttaaaataacgaatttacatttatttttcttatttaagaaaaacatatatatatatatatattttaaattagtgagcacatcaattttattatgtagtatttttaagtgattagcaagcatgctaacaacacaccgattttctagtttatgtagaagacacaatgataccatacttttgtatgtgtttagatccctcaaaatcaagatattttttcctgtaaaaacttgggccctccgtaccaaaataatcaatttttgatgaagatgcatccttaatagatgatttttttggatgggtgagttttaggtatagatagatctatttctatacggcttcagatcttcttgggttaaagatccataattgatgttcccttaaaactattgtgtagatgagtagatcatctatatggtttcagaccttctcacggataaaacttatgtccctaaagaaaatctcatgcatgtagatctcctcacgcataaagtctatgttcccaaaaaaaacctaagtacgcagacaagtttatgccccaaaaaccctatgtatgcaaacaagtagagtaggtctattatattttagtttgggtgattacctctacagatcgggtgcccagaaattgaaggaatcaagtagcttcctcacttcaatccgcttgaattcgacttcaaccggcttgaattgaattcgacttcaaccggcttaaattcaacttgatttaagcaggttgaatatgagtagcctctccgttctgtctctccccctaattcttctccttttatatagccaagaacctagcataatatatcaactacttttatctccgatctgtccctccaaatcccctcccctcttccttttatagctaaggaaaggttgcacaaagtccaagtcggaattcaatacttatctattatggttggagtttctagaaagttccttcaaacttttaacttgtatgcatttccttccatttatctacaacatgaattttgcataaagcccctcttgatttctagttaattacttattggtttcttcgatctcatgccagggttgatccgaccatccacgcggaataacgtgcctgttattgcacatccgtataattaaagaaatggcaatgtgcccacatctcttaaacaagacgtcgtacccaaaccttggccctgcaccagtcatgccacaacccatgcctcgtactctcgctaccttgccacctgttgttccttgagcaaatggacgattgctacaccgaggcattacctgacaacgtgccattgtctcatcgactaacctctcctattcctggatggctctcacctactccatcgtctcaaaataaatcaacttctatgtttgaattttatcttaaaataaaccaacttttaccttcttacctaccatcgattcacaaatcaaataaattttatcctttaaataccctcacatacccatccatcaatacaacttacctagtattaatcagttacattttgatcctttggaaaataacagcaattgggtgcttgatcagcgccagaaaaatcgggcacccgtcgcttaccgcgcctcctgggcctccgcaccgtccccaccacacgccccaccacatgtgccgttgcaacaaatcatccacatactatgtaaacgctctattaaaggaatttgtttcaatttttgttccaccaataatgtttgagtaagtgtactcgtgatgtttcactatgcatagatcgaatgttgtagtgaattgaagcatcatttcgctattcgctgaaacatttattttatatagggtgaaacaacactcgattttttagaaaccgttttttcatatgttgtagcaaatgtttcatgagatgatttggttgtgtttcagctttttaaacgaccgaaaatttccgatctacttagtgaaatatgttccaatataattggaggaacaacgcccgatttttataaaaaaaaaaatttgggcgcccgatttgtggacgcctcgataaattttatcctttaaataccctcacctacccatccatcaatacaacttacctaatattaatcaggtacattttgatcctttgtcttcctccttaattttgccttgggaagctaggatttgaaattttataggagtttctcttttgtccctctcgagacaaaccgtatgaatacacgaaccaacttgacatatatggctgatgacggtctataaaacataatcaaatcatattatacggtttctatgttatcccgtctgatacaacgaaggttgtttagttgagtggcaaacttagaacattctgccaaactttaccacagatatgactaacaatgtggtagcagcgtacccctaagtccccaaaaaagtccaattctagttacgaacctggacatatgcgtgttgtggacccnnnnnnnnnnnnnnnnnnnnnaatcgtgtaaacagtaccatttccctggatcaagtagtctggtacacacgaattcatagctgaaataccaagtgcacatacatgagtgtctagtacgaattattacatcataagcccgcaggcatagtcttaaatcatcggaccgagcggtccggaatacattccaaaaacagaagtaggtaaggcagcggagtcaaggcaacggcatgccattgccacaggcaacgaccgtaactaagacctactaagcgccatcgtcttcatcaccctcctggtaataagcgtagggatcctccgaagcttaatcttcgacctctgattaagtttgtatattgcaagggtgagtaccaaccgtactcagcaagccaccacagcaacaatgcatatgacaggggtattcaaaggatggctatggttcttttgcgcaaagcaagttttgtaattcttttcacaagcctaagacctagcatagactgatcaaattttagtaccagtgttcatattaaacaatgacggttctgtccaccatccattgtgatcccaaggatagcttcccgccattgagtcgtcatggttttctgaggacgtccacattcccgcctctcaagaagtggctccatcagtatagaaatcatcatgcaatatcccatcccacacaagttaagaatttagagtctagccaagtgtaatacacgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaactttacatcctcatgcactctaggcgtacacggtttctagcagtgagaggagttctggcgcacccgggaagggaagactcacacatgcattaagttataattatgtttaaattctctcatggcagtcctaccgatggcgacaccactgtagacacccgcctcacggttctaccaatggctgccccaccgtagagcccctgcctcacacatcaagaaaccactatgcatggatactgcctccgctcagctatctattccgctaggtctatacccatacgagaagtgcggttgtacgggggtcgtttcatgcttaacttcatggctcggtccttaattgaccggggacggtgctagccttttccggataccacccaaatcctccgtccgccccagtcgaaaacagttgtttaattttatttctcctttcacaaatcatgtcatcaacatcatggcaatgcggcgctcatgtctccatatgcccaagcatatagcttttgataaatatgagtatgcataaatctagagtagcatttctaagcatttgtcatagttgactagggacttatacgtaaatcatggttacaaggatttaagggtaaacaataattaaggcatggcataatcacaagtaggatgtttatcattgcatgtaattttatttgtaaacaaaataattttgcaaatgggatcaacatgttcaaggaatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaatgcgaaagtcgatccttttttttattaactttactattcgcgaactagggcaaacccaattttgatttatacatcctaaactatttttgcgggtataaatattttgttaccataagtttttaatttaatctacccgagcattatatccatataataggttagaattttctatcgcgagctaaatatcggacaaaatcctaaaattatcttataatattgtacgatttaatttagtctatgactaaacgattaaatataatacacggctaaaattcctagtaattaaatccgaatttctaccgtgaatcgattacttatagagattacccaaaaataatctataataatctataagaattcatctatttgtttagttattaattacatctaaattactaccgcgaattgatttcttatagaaattaccaagaataatccataatttatattaatttttgcaattctacgactataattaatctataattaaattctaattattttaaattttctaaacttccctaatctccctctaatttctatttatttttttcttttctttttctctcctcttttctctcttttcttttctttttccttctctttctctcttttcttttctttttccttctctttttccttccttctttcttctttctctccctcggcttctcccttcctctctctctcggctctttctctacccggcggcacggcgacaaacagggggggcagaggcggcggcgacgacggcgcacggcgcggcacactggggcggcggcgcagaggcacgaaagcggcggcacgacagcacgagggcggtggcgtggcggcacgacggcggtggtgcatggagaaggggagagggagaggaggagggaatggagtggggtggagaagggggaaggggccggggtttttataggggagagagggggaaaagggagagaaggagggggaggggtgaaatgacagcggctcggctgcccggggc

SEQ ID NO: 61126 - DNA, 509 bp, Oryza sativa
gttttactctgatcagaggtgtacaactatacccacaagacacagccccacgacacgtttccgtgcgccgacatgccaccacgacataccggaaagaggccgtaacaggacccttcgcataaccccttctaactaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaataggat

SEQ ID NO: 61127 - DNA, 6586 bp, Oryza sativa
  unsure (1)..(6586): unsure at all n locations
tgtttgctattgggcatgtgttgtttgtttggtgctatggcttttgtaaacacaaggttaaaattaggccaaacaagtccctgcttttgcggaatagcactactccgcgtcctaattatagttatagtttttatctttggtggacttggtggtctccctgcatatggacgtcgtattgcgttcctaccgttcccccccccccaatctcttctcgtaactttgatctctcttattgatgaactcttgaagggaacggaaatcgaaaatccaagaggtattgtaactttatatgtggctattttctacaacttgttagccaatttctttgctagttgtagtatgtttttacgcctatcatgtatttgatttgcatagaagctgtttatgtctatctgtgtaggtatatcacaaacgaaaactacattttcttcaattaagtggagtcattttttatcttcatgagaagtacaaaagtgaccaaggatcacgtgaaattaattatcttaatatgaataggaagtgcaaggaagattgcgacatggtagaggcctattattcatgtgctaaccttagcatagttgcatgttatatacttttcctgataaaacatatctctcaaccaaataaagattcatggaatgcttttactctattcggtaactatcttcgtctatattacaatgtgttgtgttgttctgtaaagatttctatagatgctttatatttatccatgttattaattattatgtacatgcaaaaactacattgcacaaatttagaccataatcttcatatgttttactagcatgctaatttgtatgactccaatatttagaaaaaaatcatgacctacatttgttttatccatggagatgagaataggttatgtcatacttcgataatttgatcaatatggtgattaaatttcccttcctgctatattgtaagtcatttgaaaagggttaatcaatcttatgtgatatatgtgtgtcacgatttttccttcttactagcatataataaccttttcaggtgccccttactaattctatccatcataatcatttgaataattatttggtattctcctgcatcctaggagatggagggcttgaatattgaagggattcccccagtgcctattgatccaaactctgttgatgtattgtcaagctcaaatattgatccaaactctgnttggacatatttggtcaaagncttncaaatattttgatccaaactctattngatgtattgtcaagctcaaatgaatcaaagcctactatttcatttgatttgccatcaagtttctcggttggtcatactagacattcaagtgaagatttaagttcccttacaattaataatttacgcataaatcatagagaggacaattaccaaagccagtttgaagagaagcggatacatagccatggtcacacaagacgttttagtgaagatttaagttctttgaagattaatgatctatgtgcaaataaggaagaggagaattatgacaaccagcttgagaggaaggaaatatatcgccataactcagctggaaacattttcagggctgcagagattgctgaacgcttcattcaaaccattgataagagagtcctggtcgacacagcagcaccaattgaatccgttaaagatgctgttagcaaatttggagggatacttgattggaaagaggtagttttttaatccttctttatccatcttactgtcttgttttgatgaagggaatgcataaattcgattataactattctttcgtagagacggaaacatgtccaagttgagcttgacaagatgcaggaagatgctcctgagtacaagagaagagtggaagtcacagaagttgagaaaagcaaagttcttgaggagctatattgtactagacgaactatagaacgactaaaaatagacctagacaaatcccatactgagacaattcaagcacaacaagacttagagcttgctgagattcggtttgaagagatgcaacaaggcattgcccgcaaagagagatctataacaaaggcaaagattgaggttgccaatgaacgacgtgcaacggccttagaagacttgcagtcagtgaagatggagctagatcaacttcaaaaagaatacacatctctaatttctcaaagggataacactgaaacaaaagcacgtaaggccattgttgcatcacaagaaattgaaaaggttgttcaggatctcaccattaaggttatcacaatgaaagatttgataaccacctcacaagctaaccatgttatagctgaggggaaaaaaataaatgcagctttggcttatcaacaggacatggtgaattggcagaatgagctaaaacagattgatgacgaggttcaaaagctcaatgatgacctatcactcaataaagaccttgagtcaaagctacaaactgcttcaatgtggctgatgaatctaagggacgagtttaaggctcacgtggatggtacattgcctaaagtgccatctgaggctagagaggaagagcggccaatgataattgtttgtgcgaagctagcacgaactaggaaggagcttgaaaatatgaggatagacattgataaggccaaggatgatgtgaagtctttgtggaatgctgctgctacattacaagctaatgtagagatggagaaaacaaacattgcatcattaaggcaaaaagagaatcttgcatttgaatctgctttagctcttcaagaagaattgagcaagattgcttttgagctcagcatggtggaagagagaacaaaagcagcaaaaatgcctttagaactacagcaagcaactaaaaagttggaacatgcaaagttgaatgctgtatttgctaggaatgagatggaaaaagctagagaagaggcagatcaagcccaggcagaggtaaatgttgttcaattgagaatagaagcaacattgagggagatacttgcagttaatgcatcaagagaaattgcagtggcatcagcaaatgcactacaagactataaacaggaaatagaactagaaccactagctaatcgaaaaaacaacaatgtcacattgtcacttgaagagtacaatgtattgtgcaagaaagtgcaagatgccgaggactctgctaagaagcaagttattagagctatagagaagatcaagaaagcaaaggatgcagaggtgaggagtttggataggttagatcaactgatcaagcaaattgatgataggagggttgcactgagagaggctcatgagaaagccaatgtagcatgtgatggaaaattagcaatggagaatgaactaagaaaaaggagagcccatcatgagaaacaacgaaatactggtgaggtatctcttcctattgctcaaatctccaatgtaaagaacacatcaacctcttttgacgcagtaggatcatctaactccaatccttataagtatcgaatgttgctacctagagctgacactatagcaactacaatagctgagtcaaggccacggaagtctttcttcccacggtccttagtggcaatgttcatgtttaggagaaagacacatttgaagtgataactcttctccttgctagcttgcctatttatttttgtttgtttttgtacatgtaccttcaaagtgtcgacgtttagggtgggttgtaattacttatcgaaaatatataaaattaagccagaggtatttgttgttcttgtaccactttcaatctattatatactaaaagtttattaaacttcctataaacgctcctaaatcgaccgtgacactctaagaaaatcctaaaaaatctgataaaaacaaaaatatctagccattgatttacacttaaatcggtggaacaattattttaaccattagatttgatactaaaaataaataattcaacaaccggtggacccattatatctattaaaagaataactctgctcccctctttctgtaccgtgattacggcggtgtatggagtacaatgatcttgttcgccatatgaggaaccgatcgtgtagctctcgatagagtgttaatttggttgcctgcgattggtttcgatttgtcgtcttgacgattggatgctgatgacgctatgcatcgaaacgctcgagcagcaatcggagaagaattagccgctttgagaagaatggcaaatataatacaagatcaattagcaaaacaataacagataatgctgcctatgcttacggtctatgttgacaatattctaatcagcaacaaaattcacgactgcgcatcatcaacagattaatacactaccacaatcaaggactgcatgattgagagattattactagctcccacctttttatattacaagacgctttgatttattttttgaatggagatagagtagattatcacaccaacaaaattaaggattgtgcatgatccacagattaatacacagataaattaatgttggaatcaaaacaaaaatcttaaaaaggagtcaaacaccacatcacagatttatttaattcactcctctattttctaactaataacaatcttagaaattttgaggaaaaaacatctggccgtagatttatgcctaaatcagtgggtatattattttaaccattagggcaatgtctgacacagctctagattctaaatacaatgtttgaagtttatatgttaaattatagtggtttaaaattttaaatttcatctaaaatagaaacaaaatgaattatccaaatgttatcaatgtaaacacatagatctatggatctatggacctagaaatacaaaactttaataaatcttagatccggagctgtgtcaaaaacaaacaactcaattggtgatcccattggatctatgtaaagaaaacaaaccgtcttccactctccctccccctccagctgtacatttgtatgtctccctccgcactactcacccctcgtctcctcctcatctcctcccatttaattcacccctcttattttgaactaacgacataataataaagtaatttatagttacatagctaaaatataagttatggctgatttttaatttgtttgaactcttttacaattggatagctaaataactcaacatttaaattacttatagaaaaattcaaataagttggttgaacatagacccctattcttttgcatggtaaccaaacaacattctatttttaatttgtttgtagtattgttttatttataatcatataaataattgaaaatccatattatttcattttattatataaaaattaaaatgtcatttgaacatagcccctatcttttgcacgataaccaaataacaataaagcattgaaaataatgatagtaagtattatgacatcttaaattattctacttaataaagaaccattaaatgtcctctagagttcttttaagccttggcgtgtcaatgtttaaaaactagaaaaaatcttcgaaattcaatgaaaaaaaagtaaaatatttgatcattggtttgtgcaggcaatgcgagagattagtaattttacggaccgattgctcagcatgtgtggaaggactttctactccatgtatggatcagtcttgcagttatggccaagtcatgctaaagaccgtataagtcttgcatttacactattttaaaccactaaatctacttttaggaaaacctcaagcagtcgcatgccactttttaaaagttagcaacatcttagaaatcttggaaaaaaaacatccgatcatcatcagtttcaccgaaattgtttagaaaagaacaattttacggttcttgaggaggtaccatgaggtaccactttttctattataaatttggtacctcttggtacctaggtaccatgaggtaccaaattttacactaaatttttgatacctcatggtatctactcaagtaccgtagaattactctttagaaaaactagaaaatcaaaagattttccacggtctttcaataattttatgaaatacaacgtaattatgacaattgaattggcattgcaggctttaaataataaatatataatatacatgtacttaattcatgacaactgcaggctagcttaaaaaatgtaaagtgtttggttatgagtacataatttctagcattaaactataaaatgtatagaaagatattaaaattatggaagcaactataatacatcacataataaaaaaatgatgaagaaatcatactttttcagatgcaaccaataatgcatatgcccgcgtgaatgcgcgggctacctttctagttaatttaattgcattttgccaattctctaacttaaactctgagagtgagagccatgttgtggaacttcttgaggtgttgtgtcatcattaaattgacaaatttccatctttaagtgggcatacgttgtttcacttattgtttgccaaaagacagggctttggtaccttcttgaagacaaccaattgcatggagtggtctagtgctgacaggatgcaaatcatttgaaacattccccatctcaaatcacatgacatctttcaactggaaggccatattacatttgcctccatctaagtca

SEQ ID NO: 61128 - DNA, 541 bp, Oryza sativa
acacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtg

SEQ ID NO: 61129 - DNA, 37700 bp, Oryza sativa
  unsure (1)..(37700): unsure at all n locations
acggcgacgggaagccggcggccaaccaggacggccagcggcaggagctcgtgaactgggtgaagcaggttggcggcccggcgacggcgttcgacttcacgaccaagggcatcctgcagtcggcggtgcagggcgagctgtggcggatgcgggacaaggacggcaaggcgccgggcatgataggctggtatcccgagaaggccgtcaccttcgtcgacaaccacgacaccggctcgacgcagcggatgtggccattcccgtctgacaaggtcattctgggctacgcctacatcctcacccacccaggagtaccatgcatcgtacgcaattaacttctcaaagcttgttataacatccatggatcgatgcttcatcattcataggtgacaattttgttttgtgttgtttagttctacgaccacgtgttcgactggaacctcaagcaagagatcaacgcgctggcggcgacgaggaagcgcaacgggataaacgccgggagcaagctgcgcgtcctggcggcggagagcgacatgtacgtggcgatggtcgacgagagggtcatcaccaagatcgggccgagaatagacgtgggcaacataatcccgtcggacttccacatcgtggctcatggcaatgactactgcgtctgggagaagagcggccttagagtcccagaaccagaaggtcggcgctagaaacggctcgcaagctagctacacagttcttaataacttggtcgcaaaaaaaaagttcttaataatttgtacgagaaatgttcgtttctgtttgcatatatagcttatgaaatcttaccaatatatactgctctgttttctatagttcatcccggaaatttgaacttgcaagcccaaattttgaatatatcttttgctagaaaactttcttactccaaatttttaacatacaagtaaaaaatacaatagaatattctctatgattacttaaattggaccttattgatggtaagatacttaattagttgcgttcgtttgggcttatcggacgagctacttcatcgttcatcattagcactctttcaaatgttaaatagtatatttttgaaaaaatatacataattatttgaaatatataataaatccatttttaagtttacaatagctaatacttaattaattatatactaatgatatttcttattttacgtacggcttataagctcacttaagacttactccctccgtttcataatgttaagtcattctagcattgctagaatatatatgtctagattcatcaacatctatatgaatgtgggcaatactagaatgacttacattataaaacaaaggaagtagttcaaacgaatccttagtccatgttcttttcagctccttcactaagttatttctatgcattatttgttcctctaaaagtacgatttctcgttaaaaaaatctatctaccgtatatttattaagtttatttaccacaatattcaagttatatctataaccatgcagataatccaatacaataacttttttgaaactaggctatagtgaaggctgcatcactgcatgggctagcttctcataaaaaaggaaaagaaaaaggaagaaggctacatgagcccagtcaagagcaggaactatatggacttatcgtcagggataagggctgcataactaatgggccacggcccttccagaaggaataagttcattttgatttccctaactagtggttgaatttgattcgaattcctaaaccacaataccgaatatcttaacccacaattattaaaaccggtacaatttgattcccttagtggttttggtgggttgtttcgctgatgttgcgctgacgtgacagtgttgacgtggtgttgatatggcgcttatgtggcattagaattaaaaaaatggaatccatttatcattcacataaaaaaatattttggacccactaacataagggcccacatccacatgtcatcctctcacttttccttctttctccctttctctcactggcgtgccacatcaaatttttttagatggcaatgtatttaatgctatggacacctaatttttttttcttattctcattgccatttatctatttcttataatattccttaaaaaaatgtgaaatttgaaacctctaagttgaagcctgcatgaatttatgtagaaattagaacccgtgggttggctcatgaaaagccatatggacggaaatagagagagaaagtgacatggacaaggaagagaaagagtggggaagaaggatgctttgatattagagaatgcttcgatactataggataggtgcactttcgctctataatctagaagccatggtccctctaaatataagttcttcacgtggttggtactgcaaaataggctttggaaaaccgaccaagtacaacggtgaggataacccaaccaaagaatttgcccactatgttgaacttgcaacgagacagctatatacctcatagcacactgccaagtcacaaagagaatctcgggagccatagcaaggtgggcacagatcaacctacaaatggagcaatgaaacaccatagatatggtggaaaacttggtgggcaaccttagcccacactaccggaatattgaagaacacgctccggtcactcattctcctagtcagttgggaaatatggaaaaagaggaatgcttatgcatgtgttccaggcttccaacgcatcacattaacgcctactatcattatagcaaaaataaagtaggaggccagagacatacacccggacctactctcataacattgttatctctctaagtttttttttttgcccccaacagtcctaccaagcaaatcctgctaacacctataggtaaactcatttctcctcctttattaatgaaaagaggccatcctcatgtcctcttattcgaaaaaaaggttgataggtgctataatcacaggaagggtctaaggaggtgaaaatgctaacgggcgatcgaccatgcacgtgcaatccgtgtgatagggtcggtccgtacctttttttttttggctcacatggttttcagcttttcattttctaacaaatctttttatgggcttatgatcatctagttttccctttttaagctggcataggcaacttgttttttaatttgtttgaagtgtatatacaaaatcgtatatgtatacaattctattatatatatatatatatataaagtttatgtgtatataatgtttctatgcataatttttttataggggtagacaaacacactacttcaacttgtttgaaacttgtatatacaaaattttgtatgtttgaacaaagtctttatgtacaaagctttgtttgtcggtggcgtcgggtgtgggttggacttggcaatgctctcgagatccgagtgtgacgaggcggacgagtacattggcgtcggcaccaggatggtggtctccgtcgcagccaacgcgcctcggacaatcgggaatacagacaagcctagactgcttgctgcgcgcgccgacacggacatggaccaccctgacgtggattgcgaaagagaaagaggagatgatgacgtacgtggtcacctgacgtatggggcctacgtgggtcccacgctgagtcaactgccacgtcagacaaaactggagtcaaaaccgccgagggacgtagtttgcattggttttgtaagttgatggatgcattgtatctggctttgcggttgggggacgattttgtaactcgatgacaagttgagggaccttcggtgtactttttcctaatttttttcaatcgggctaacatgttactgggcctaaaaagctgctcgttgggccgttcaaagagaaatatatatgggccgacgctgcttggactcttgtggaaacggaaaaacggatgctaaagagcgcatgtgacatcttatcgtcattttcaagggttaattggatcataccactgctgcaaatgtggactattcacgatatcggccggatgtcactagaattttgagaaattaaatccataccaccccgtcatgttttccatccttcccgtcacactttccgtccttcccgtcgctctttccaggaggctgagggcacggaggctggcgttgtgggcggcagacggcggagccgccgggtcaaggaggcggagcggcggagttgccggcggacggagacgacgggtcgaggaggcggagcggtggagttgccggccggcgtcgtcctccgctcctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgctgcacctataaattcacatgcaccggcatgccactccacacaactcagctactcgaaagaagcagcaatggcaaagcgcatagcctcaatgagcagcctcctccttatcgccttgctctgtctgagctctcacttggcccaagcccaggtcctcttccaggtaagcatcctgtagtacaatgtcacattacataaaaaaaaatgacttgcgtttgacatgactgttcttggtgtaggggttcaactgggagtcgtggaagaagcagggcgggtggtacaacttcctccatggccacgtcgacgacatcgccgcgaccggtgtcacgcacgtctggctcccaccgccgtcgcactccgtcgccccgcagggatacatgccgggccggctctacgacctggacgcttccaagtacggcacgggggcagagctcaggtcgctgatcgccgccttccacagcaaaggcatcaagtgcgtcgccgacatcgtcatcaaccaccggtgcgcggattacaaggatagccgtggcatctactgcattttcgagggtggcacgccggacagccgcctcgactggggccccgacatgatctgcagcgacgacacgcagtactccaacggccgcggtcaccgcgacaccggcgcagacttcggcgcggcgcccgacatcgaccacctcaacacgcgtgtgcagacagagctgtccgactggctcaattggctcaagtccgacgtcggcttcgacggctggcgcctcgacttcgccaagggatactcggcggccgtcgccaagacgtacgtcgacaacaccgacccgtccttcgtcgtcgccgagatatggagcaacatgcgttacgacggcaacggtgagccgtcgtggaaccaggacggtgaccggcaggagctggtgaactgggcgcaggccgtcggtggccctgcgtcagcgttcgacttcacgaccaagggcgagctgcaggcggcggtgcaaggtgagctgtggcggatgaaggacggcaacggcaaggcgccggggatgattggctggctgccagagaaggccgtcaccttcatcgacaaccatgacactggctccacacagaactcatggccgttcccctccgacaaggtcatgcagggctacgcctacatcctcacacaccctggagtaccctgcattgtgagtcctcagctgcatgaatacgaatgccataaagaaaaatctaattttctcaaccagtttctccgactaaattctgtttattgactatgtgtgcagttctacgaccatgtatttgactggaacctgaagcaggagatcagcacattagctgcagtgagatcaagaaatgagattcatcccgggagcaagctgaaaatccttgctgctgagggagacgtctatgtcgccatgatcgatgataaggtcataacaaagattgggacacggtatgacgtgggcaacttaatcccgtcagacttccatgtcgttgctcacggcaacaattactgcatttgggaaaagagcggtctcagagttcctgcagggcggcaccactattaggcgaagaaaatttttcaggactatttggtgcctggaataagatttgaattatatcctaaataaccagattatgattgtatgagatttcttaatctgagcaaagcgttgagcattgctccgatatttctatgtattctacctgcctggggatatgatatttgtatcctctagaagtaaagatgattttaactcagaagtccattgactttactgctacattttaatcagttgcagcactgtgttgatcaaatgcaaacgttcctgacagcagactcatcactaaactttagggaaattaattaacctgcatactagtccagtgcattgtactccccccgtccaaaaaaaagacaaaccctgagtttccgtgtccaactttgactgtccgtcttatatgaaattttttttataattcgtattttcattgttattagatgataaaacatgataaatattttatacatgacttgttttttttaatttttttcataatttttttaaataagacgaacggttaaacattggacaaaaaacagggtttgtctttttttgacggagagagtataccttacgaagcacctgagcactactactgctgatgctgcttgcattgacctaggaccgacggcctgctgctgtgcgtgcactactacttgcttagctatattgggccacagcccaagccagccagaactctcttttcttctttttttttcccccatttttttcatcagacaattctttttgcgcgttacactaacttaattacctcgttgtgaatttaagaacttttcggacaatgcgcggtaacaatttctaagctttgaaccggtgatacggtagtatcatcagataacctcaatggttcaaaatgctacgacgtgtaaaagtacttaacgagttcttgcatactaatctcgaggccacctagcatttagagatcaagtttgatattgtcactgctatattgaactggaccacccatatataggcgttcgttgtacacgatgtcttgcttcgtgcaatggaacctgatatccggcaggttcttactcactccgtactaaaatataagagatttttaatagataatctttattcagatttatagtactagaaaatgttacattgatctatattttgaggagtatgatagaagaaccataataaccattggttccaccatttattttcaagtgggctagcaaaaataggaatcaataggcgagggcttgaccttgaagttaacagagaaaatattcacgcatgctattgtagcagggacatgcaagattgttagtatctgatattttaggtagtatatttatctaaagtagtaggattatgttatcgggatattatgatattttcttttaaaagtttaatttaatatttatattaattatatagagctgatctagattgataataataaataacataaggatagatttgtcaagaagtacctactaatgctaatagttttatttaacattgatttcgaagatatgaacacaaatgcattcatatagttttgatttttgaattcaaataatgtctagttggaaacagttagtatcttgttcctagagtgattctaatgatactacgctatatatcccgatactagtgtgataccagtcgaaaacgatcctagaatacgtattccgatactgacaaccttggaggcagacaacgcacctcctatccgaccaagacatgacctaagtcattggccgacatgtcccgacttaaagctaatacaagtttcctagtaggtgcccaggattaaaccaagttgcccttgttgggaacatttagagcttgcggtagagtggctagtggtacatgaaagatggagatgaagcttggtgcccacgctaactgaaaggaatattctcttagaatatgctaggagccattccaaccactcttacatcataggaaggtgatctgtgctattatactattagggtttacagtcccacaacggcatcaatctaacttcacatgtacttatcataaattaaagacaccagatactgtagcaatatagattacattttatcgaaaatagtgacaatgagagccatttggagcatatcagattcaccttacaactaggataggtaggaaaaccatctccttgtttatccctattttatttgtgacctcttggatcataacattcaccacgtcgcaccacttgacaatttctatttttcaatccgaacttcattatttttccacgtggatccatgttattatacaaatctaattgatggtttctttcattttaggggctgtttaggttgatgccattttcaaccatactatttttttagcatagttgtcaaaaatatgtctatatttagtttgttgtcaaatctattatataattaaaggaatagaaaaagaagcatccacgttcgctctcatggtctaaaaattctcacattaatcggagaaaaagaaaaggcagagtccatatcgaaatacaatttagaaatagctgaaattcggaattaaaaaataaggaatattagaagaggagactatagtccatatagaaatacaatttagaaatagttgaaattcagaattaaaaaataaggaatattagaagaggagactagagtccatatagaaatacaattagaaaataactgaaattcggaattaaaaataaggaatattagaagaggagaccagagtctatatagaaatacaattagtaaataactgaaattcggaattaaaaataaagaatattagaagtagagtatagagtaaatacaattaggaaataatagaaattcggaattaaaaattaaggaatattagaagtagagtatagagtccatatagaaatacaattaagaaaaaaatagaaattcggaattaaaaaataaggaatattagaagtagggtatagagtccatataggaatttaaaactaactaaaatttggcataaacataataaaattaaaagtatatatagtattaaaggaatagaaaaagtagcctccacgttcgctctcatggcctagaaattctcacattaatcggagaaaaataaaaaacaaagtccatattgcgtaaaatttttgaataagacgaatggtcaaacatgtgagaaaaaatcaacggcgtcatctatttaaaaaacagaggtagtacaatttagaaatagctgaaattcagaattaaaaaataaggaatattagaagaggaaactagagtccatatagaaatacaatttagaaatagctgaaattcggaatcaaaaaataaggaatattagaagaggagactagagtccatatagaaatataattaggaaataactgaaattcggaattaaaaataaggaatattacaagtaaagtatagagttcatatagaaatataattaggaaataatagaaatttagaattaaaataagaaatattagaagtagagtatagagtccatatagaaatacatttaagaaaaaaatagaaattctgaactaaaaaataaggaatattagatgtagaatatataatccatataggaatttaaaactaactaaaatttggaataaacataatacaattaaaagtatatatattattaaaggaatagaaaaaggagcctccacgttcgctctcatggcctagaaattctcacattaatcggagaaaaagaaaaaacagagtccatatagaaatataatttagaaatagctaaaattcggaattaaaaaataagaaataatagaagaggagactagagtccatagagaaatacaattaggaaataactgaaattcagaattaaaaataaggaatattagaagtagagtatagagtctatatagaaatacaattagaaaataatagaaattcgaaattaaaaataaggaatattagaagtagagtatagagtccatatagaaatacaattaggaaataatagaaaatcggaattaaaaaataagaaatattagaagtagagtatagagttcatataggaatttaaaactatctaaaatttgcaataaacataataaaattaaagtagagtttagagtccgtataaaaatacaattagcaaataactaaaattcgaaattaagaaaaacatgggaagaagtgtttaaagtcaatatagaaatacaatttagaagtaactgaaattcgaaattaaaaattaaaaaatattgaaagatgagtttagagttcacatagaaatacaattagaaataataaaaaattcagaaataaaaataaataatattggaagaagagcatagagtctatatagaaatacaatttacagaaaattcagaattaaaaaaaataaatattaaaatacgagtctagagtacatatagtaatatatataattacaaataactaaaatttggtattaaaaataattaataactaacacgtatataaaatataatatgaatattacatattagtagttttgtaaagttattgcaaaatttaaaattatgttgccattttaatatttttgaataatataatgagaaaacatatatgctattatatgagagaaaatataataatgctagccgcgcaatatgcgcggggcaccatgctagttttagtaaatacataagaaatcctgtcaaaattttggcaatattgtcatcttgccatattgccaaaatttaataaggtttattttggctacaatctgaacaagcccttaattttcagtgttagtaattttcattaactaattctagcgaggactcttgttttaatcagaattgccatccttgatttatttacttttttatttaattaacatggaatgtacgagccccatcaactggccaagagctgatttgatgccaaaacatggctcattagcgataaaaaataatttataaatgaaaattttatatatgtgtttttaattagtaacttaaaagctaatgctacaaaagaaatacattaaaaatattctaaaatcaactacagaattatgttttgaatcagattttagcagcggttgattttatataggacaaacaatgaggctctaattccaatcagtaaagctagccgaatggcattcccttgaaaaagaaaacaatgaggctctaattctaggaagtgtccggcaaaagtacgtgtacaacaaggataattaaattcatgatggatggatgaattgtataatgtaatttggataccaaagaagaaaactagcaaacataggaaataaagaaaaaacattaattgcgaaacaaaattcgaattggttttagctagctgcccttaggtggatgtgcgccaacagagacgatcgcatgaaggaaggctgcagcctggaacagcctcgcctcctccagggaacgggaacgggaagaacaaaaggaagctttacctggagcccacaacgctatccaaggctttatctaacttcctattggcctcctttttatcctcttttaaatgagcgcaactcgtcgccgccgtgccgttgcgtttctcgttaggagcaactgaacttatccaacgaattgaacaatcaattcacccggagaggtacgtctgcatgccgggctgcacctataaattcccatgcaccagcattccccatccacacaactcagcttgtatctgagacacgcaatggcaaagcattccaccacaatgagctgcctcctattcttcgtcttgctctgtttgggctctcacttagcccaggctcaggttctctttcaggtgagtctcattgatcatttgatctgctgtacttcccgttagtatgtcacatgacaataggaaatagttcctagctatgaacaaatttgacgtacctgcacgttgacatgatgttggtgcagggattcaactgggagtcatggaagaagcagggtgggtggtacaacttcctccatagccacgtcgacgacatcgccgcgaccggagtcacacacgtctggctcccgccgccgtcgcactccgtcgcgccacagggatacatgccgggacggctctacgacctggacgcgtccaagtacgggacgggggcagagctcaggtcgctgatcgccgccttccacagcaagagcatcaagtgcgtcgccgacatcgtcatcaaccaccggtgcgcggattacaaggatagccgtggcatctactgcatcttcgagggtggcacgccggacagccgcctcgactggggtcccgacatgatctgcagcgacgacacgcagtactccaacggccgcggtcaccgcgatactggcgcagacttcggcgcggcgcccgacatcgaccacctcaacacgcgtgtgcagacagagctctccgactggctcaactggctcaagtccgacgtcggcttcgacggctggcgcctcgacttcgccaagggatactcggcgaccgtcgccaagacgtacgtggacaacaccgacccgtccttcgtcgtcgccgagatatggagcaacatgcgttacgacggcaacggtgagccgtcgtggaaccaggacggtgaccggcaggagttggtgaactgggcgcaggccgtcggtggccctgcatcggcgttcgacttcacgaccaagggcgagctgcaggcagcggtgcaaggtgagctgtggcggatgaaggatggcaacggcaaggcgccggggatgattggctggctgccggagaaggctgtcaccttcatcgacaatcatgacactggctccacacagaactcatggccgttcccctccgacaaggtcatgcagggctacgcctacatcctcacacaccctggagtaccctgcattgtgagtgctcagcttgataatctccatcgctatcagaaatcgatatttgttaaccataatctcgaactaacattccgtctgtctgtacagttctacgaccatgtgtttgactggaacttgaagcaggagatcagcacattggccgcggtgaggtcaagaaatggaattcatcctgggagcaagctgaacatccttgctgctgacggagatgtctacgtcgccatgatcgatgacaaggtgatcacaaagattgggactcggtatgatgtgggcaacttgatcccgtcagacttccatgtcgttgctcacggcaacaattactgcgtctgggaaaagagtggtcttagagttccagcagggcggcgccactaggccaaatatttctttcaggactattttgtgcctgaaataagaagtttaaatgatgtcttaaataacaagaaagtgattgattgattgtatgacagacaaatatttttgtcaggactattttatgcttggaaaagaaatttaaatgatatcctaaatacctggaatatgatagtatgccatttcattcaaacaaattattaaaatttgctctgaccgtctgacgtgtcaagggttcaatgtggagtattattcttgcctcagccctcaggacttttgccccactagctgtgaagtgattttttttttgtttaaattcgcttggtgttagtagtttaccacaacaatctggaaattaccttacctcagcgcagtatgaaaatgtttgtcttctatctatactcttctaaatgaaggcaattgtggtggtggtggtgaaaactcaaaaatattagcagaaaacaacatgttcatcatactgcagatggagcaattgaataatgggtgcgttttctactctaattccatggatcacagtgaaaatagttgggattgactgcacatagcaaaaccgacaaaaatcgcttatcagatcgagagggaaatctgtccaagcgagttgcaaattccttaccgaaccgaaggaagaatcaccgaatcggcccggatggagatctccgctccgcgccgccgccgaaccagtagaggggagaggacggaggagaggagaggacttcgacgcggcgtgcttcggcgccgccggagaagatcgacggtatggcacctagcggcggcggcgccgcggaaaggggattcgtcgccgcggccgaggagagggcaatctggtaattagcgcgagttgacatctccaagagtccagaaacgccgcttcggccttcggataagccacgtcatcaaacaacctgacccggtttgaccttttccggtagactattctacccttggtttgctgccgctgcctctgctggctgctggcgcctccccgctgacctcacgccttaagtcagcatccacacgtcacctcggccccacggcacagcacacactgcccaaatcccctcgacaccacacgttttccacagggctaagcctgaaagaggaaagatcaacgacgacgtggagcatgtcctggcgccgttctgtcgccgtgttactttcgatgttggtctccccctatataagtgcacccgctctcccggcttcagctaacgacctcaagcacactactagctccggctcacttagctccctactgatcactggaacactcatgaccaagaaggtgataccggccatggcggcggcgaggcaggattcttgcaagaccaagcttgatgagcgtgggggtagtcatcaggctccgagctccgcgcggtggatctcgtccgagcaggagcacagcatcatcgtcgcggctctgcggtacgtggtgtccgggtgcaccacgccgccgccggagatcgtcacggtggcgtgcggggaggcgtgtgctctgtgcggcatcgacggctgtctcgggtgcgacttctttggggccgaggcggcggggaacgaggaggcggtaatggcgacggattatgctgctgctgctgctgcggccgcggtggcaggaggatcaggcgggaagagggttaggcggaggaggaagaagaacgtgtaccgcggcgtgcggcatcggccgtgggggaagtgggcagcggagatacgcgacccgcgccgcgcggtgcgcaagtggctcgggacgttcgacaccgccgaggaggccgccagggcgtacgaccgcgccgccctcgagttccgcggcgcgcgcgcgaagctcaacttcccgtgctccgagcctttgcccatgcccagccaaagaaacggcaatggcggcgatgctgtcacggcggcgacgacaacggcagagcagatgactccgactctgtcgccgtgcagcgcggatgccgaggagacgacgacgccggtggattggcagatgggcgcggacgaagccggcagcaaccagctctgggatggcttgcaggacctgatgaagctggatgaagcggacacctggttcccgccattttccggtgcagcgtctagtttttgagctagtgttattagatctcaaccgttggattagattactggaaggccattcatttattcgtttcattgtatagctaattagctatacttcattgtttgtgcagagcacgttttttaggagtaccgtcttatacatatttttttgtacagagtagaaagtaacaagaattttgtatattgatggaatagattatttccaattaatatttgcgcaaaatgtctgcgatgacttgaagctgagttaatttgcaaacgatgcaacggtggaagcagttacacatgcgttccagtgagtctccacgcgagttaataacttaggcgtgtacgtattttgacaagtcgtgactcgggagggtgaatccgcttttcacctgactagtcaacgtcacatcgagaggtggtggaactcagctagttttcgctcgtggaacagcaccgtacgagggaaatcacccgtggcgacggcgatgtggaaaacagcaggcgagcaagcacccagcacactgcacacgggtacacgacggtcaactcgtttccgaggaccaagcgagagcgggagaagagaagcagcttgatagtttacagaagcagcttgattagtttactcgccacggccaagtggcccaactgcctttcccactgtgatcgcaacgtgccaccagccgcccaccacgcagcgtcgcgagccgtctagggatggcaaaccggccgcggtcaccgtcgcggctaagccgtagcgcgcgagacgggtgggtttccgcgacgccgcgcggtggattctggagagaagcgcccgcgatgccgtgatagccacggaggcgcggacggtgaaccgcggctccagctgagtgttttgatgggactcgtttcgtaagccaaaactgggagcggggcgctgctttctcgctcgctgcgcgccgcctggtggcctggggaccaccagccccatccgtatccgtgggcaaaagacgtttttgtctcattgtgtgccctaaaattgatcttttatcacaatccgtctttaggccactggagtttcattcgggctcattcggaatgaagcaaatgtgaaggaaaacaatggaggattgatgatttctttgaattagctaccgtagttgcattcgttttaaaagattggctacccgattgtcacaggaatactattcgctacctatgcacgaagaataagaaattcttatgttattcaatcatgtgtttcacacatacaatcctatcatatttctgtgatttctatttctacatttttttctatcctgcattccaaataagcattaaataaggtgtcatgtcagtgtttctgataatgttgcaacaaattaataaagtgagagatgaaatgggttttaactagacgaaatcttgtctacactgtttttaatatactccagtttgtatcttgcatatactacccatgaaacaacaaacatgaaactatgcattatgtgagctatttcaatcatcaattaaataccttattacttatgtggtatcttggaaacataaaaatgatatctctaattaggaatagccttagatccgatcttatttgcttccattccatcttgattccttaatgaccacccctatatgcccatagtttcatgtcatctagattccctaaggcataggctaggaaaagggatcgaatgcaatgttctttgactcaggaacgtcgtccccatcccagcaacaaggagacattttcatccgtaaaatcttgcaatacgttcatcattcttgttctcttgaccccatctacccgagaactttgtgactatgacgactattaattgaaacaatgatacctccataccaccaaatcaagcaacaaatattgtattagtaatcgctcttgtttgctattgggcatgtgttgtttgtttggtgctatggcttttgtaaacacaaggttaaaattaggccaaacaagtccctgcttttgcggaatagcactactccgcgtcctaattatagttatagtttttatctttggtggacttggtggtctccctgcatatggacgtcgtattgcgttcctaccgttcccccccccccaatctcttctcgtaactttgatctctcttattgatgaactcttgaagggaacggaaatcgaaaatccaagaggtattgtaactttatatgtggctattttctacaacttgttagccaatttctttgctagttgtagtatgtttttacgcctatcatgtatttgatttgcatagaagctgtttatgtctatctgtgtaggtatatcacaaacgaaaactacattttcttcaattaagtggagtcattttttatcttcatgagaagtacaaaagtgaccaaggatcacgtgaaattaattatcttaatatgaataggaagtgcaaggaagattgcgacatggtagaggcctattattcatgtgctaaccttagcatagttgcatgttatatacttttcctgataaaacatatctctcaaccaaataaagattcatggaatgcttttactctattcggtaactatcttcgtctatattacaatgtgttgtgttgttctgtaaagatttctatagatgctttatatttatccatgttattaattattatgtacatgcaaaaactacattgcacaaatttagaccataatcttcatatgttttactagcatgctaatttgtatgactccaatatttagaaaaaaatcatgacctacatttgttttatccatggagatgagaataggttatgtcatacttcgataatttgatcaatatggtgattaaatttcccttcctgctatattgtaagtcatttgaaaagggttaatcaatcttatgtgatatatgtgtgtcacgatttttccttcttactagcatataataaccttttcaggtgccccttactaattctatccatcataatcatttgaataattatttggtattctcctgcatcctaggagatggagggcttgaatattgaagggattccccaagtgcctattgatccaaactctgttgatgtattgtcaagctcaaatattgatccaaactctgttgatatattgtcaagctcaaatattgatccaaactctgttgacatattgtcaagctcaaatattgatccaaactccgttaatgtattgtcaagctcaaatattgatccaaactctgttgacatattgtcaagctcaaatattgatccaaactctattgatgtattgtcaagctcaaatgaatcaaagcctactatttcatttgatttgccatcaagtttctcggttggtcatactagacattcaagtgaagatttaagttcccttacaattaataatttacgcataaatcatagagaggacaattaccaaagccagtttgaagagaagcggatacatagccatggtcacacaagacgttttagtgaagatttaagttctttgaagattaatgatctatgtgcaaataaggaagaggagaattatgacaaccagcttgagaggaaggaaatatatcgccataactcagctggaaacattttcagggctgcagagattgctgaacgcttcattcaaaccattgataagagagtcctggtcgacacagcagcaccaattgaatccgttaaagatgctgttagcaaatttggagggatacttgattggaaagaggtagttttttaatccttctttatccatcttactgtcttgttttgatgaagggaatgcataaattcgattataactattctttcgtagagacggaaacatgtccaagttgagcttgacaagatgcaggaagatgctcctgagtacaagagaagagtggaagtcacagaagttgagaaaagcaaagttcttgaggagctatattgtactagacgaactatagaacgactaaaaatagacctagacaaatcccatactgagacaattcaagcacaacaagacttagagcttgctgagattcggtttgaagagatgcaacaaggcattgcccgcaaagagagatctataacaaaggcaaagattgaggttgccaatgaacgacgtgcaacggccttagaagacttgcagtcagtgaagatggagctagatcaacttcaaaaagaatacacatctctaatttctcaaagggataacactgaaacaaaagcacgtaaggccattgttgcatcacaagaaattgaaaaggttgttcaggatctcaccattaaggttatcacaatgaaagatttgataaccacctcacaagctaaccatgttatagctgaggggaaaaaaataaatgcagctttggcttatcaacaggacatggtgaattggcagaatgagctaaaacagattgatgacgaggttcaaaagctcaatgatgacctatcactcaataaagaccttgagtcaaagctacaaactgcttcaatgtggctgatgaatctaagggacgagtttaaggctcacgtggatggtacattgcctaaagtgccatctgaggctagagaggaagagcggccaatgataattgtttgtgcgaagctagcacgaactaggaaggagcttgaaaatatgaggatagacattgataaggccaaggatgatgtgaagtctttgtggaatgctgctgctacattacaagctaatgtagagatggagaaaacaaacattgcatcattaaggcaaaaagagaatcttgcattgaatctgctttagctcttcaagaagaattgagcaagattgcttttgagctcagcatggtggaagagagaacaaaagcagcaaaaatgcctttagaactacagcaagcaactaaaaagttggaacatgcaaagttgaatgctgtatttgctaggaatgagatggaaaaagctagagaagaggcagatcaagcccaggcagaggtaaatgttgttcaattgagaatagaagcaacattgagggagatacttgcagttaatgcatcaagagaaattgcagtggcatcagcaaatgcactacaagactataaacaggaaatagaactagaaccactagctaatcgaaaaaacaacaatgtcacattgtcacttgaagagtacaatgtattgtgcaagaaagtgcaagatgccgaggactctgctaagaagcaagttattagagctatagagaagatcaagaaagcaaaggatgcagaggtgaggagtttggataggttagatcaactgatcaagcaaattgatgataggagggttgcactgagagaggctcatgagaaagccaatgtagcatgtgatggaaaattagcaatggagaatgaactaagaaaaaggagagcccatcatgagaaacaacgaaatactggtgaggtatctcttcctattgctcaaatctccaatgtaaagaacacatcaacctcttttgacgcagtaggatcatctaactccaatccttataagtatcgaatgttgctacctagagctgacactatagcaactacaatagctgagtcaaggccacggaagtctttcttcccacggtccttagtggcaatgttcatgtttaggagaaagacacatttgaagtgataactcttctccttgctagcttgcctatttatttttgtttgtttttgtacatgtaccttcaaagtgtcgacgtttagggtgggttgtaattacttatcgaaaatatataaaattaagccagaggtatttgttgttcttgtaccactttcaatctattatatactaaaagtttattaaacttcctataaacgctcctaaatcgaccgtgacactctaagaaaatcctaaaaaatctgataaaaacaaaaatatctagccattgatttacacttaaatcggtggaacaattattttaaccattagatttgatactaaaaataaataattcaacaaccggtggacccattatatctattaaaagaataactctgctcccctctttctgtaccgtgattacggcggtgtatggagtacaatgatcttgttcgccatatgaggaccgatcgtgtagctctcgatagagtgttaatttggttgcctgcgattggtttcgatttgtcgtcttgacgattggatgctgatgacgctatgcatcgaaacgctcgagcagcaatcggagaagaattagccgctttgagaagaatggcaaatataatacaagatcaattagcaaaacaataacagataatgctgcctatgcttacggtctatgttgacaatattctaatcagcaacaaaattcacgactgcgcatcatcaacagattaatacactaccacaatcaaggactgcatgattgagagattattactagctcccacctttttatattacaagacgctttgatttattttttgaatggagatagagtagattatcacaccaacaaaattaaggattgtgcatgatccacagattaatacacagataaattaatgttggaatcaaaacaaaaatcttaaaaaggagtcaaacaccacatcacagatttatttaattcactcctctattttctaactaataacaatcttagaaattttgaggaaaaaacatctggccgtagatttatgcctaaatcagtgggtatattattttaaccattagggcaatgtctgacacagctctagattctaaatacaatgtttgaagtttatatgttaaattatagtggtttaaaattttaaatttcatctaaaatagaaacaaaatgaattatccaaatgttatcaatgtaaacacatagatctatggatctatggacctagaaatacaaaactttaataaatcttagatccggagctgtgtcaaaaacaaacaactcaaattggtgatcccattggatctatgtaaagaaaacaaaccgtcttccactctccctccccctccagctgtacatttgtatgtctccctccgcactactcacccctcgtctcctcctcatctcctcccatttaattcacccctcttattttgaactaacgacataataataaagtaatttatagttacatagctaaaatataagttatggctgatttttaatttgtttgaactcttttacaattggatagctaaataactcaacatttaaattacttatagaaaaattcaaataagttggttgaacatagacccctattcttttgcatggtaaccaaacaacattctatttttaatttgtttgtagtattgttttatttataatcatataaataattgaaaatccatattatttcattttattatataaaaattaaaatgtcatttgaacatagcccctatctttgcacgataaccaaataacaataaagcattgaaaataatgatagtaagtattatgacatcttaaattattctacttaataaagaaccattaaatgtcctctagagttcttttaagccttggcgtgtcaatgtttaaaaactagaaaaaatcttcgaaattcaatgaaaaaaaagtaaaatatttgatcattggtttgtgcaggcaatgcgagagattagtaattttacggaccgattgctcagcatgtgtggaaggactttctactccatgtatggatcagtcttgcagttatggccaagtcatgctaaagaccgtataagtcttgcatttacactattttaaaccactaaatctacttttaggaaaacctcaagcagtcgcatgccactttttaaaagttagcaacatcttagaaatcttggaaaaaaaacatccgatcatcatcagtttcaccgaaattgtttagaaaagaacaattttacggttcttgaggaggtaccatgaggtaccactttttctattataaatttggtacctcttggtacctaggtaccatgaggtaccaaattttacactaaatttttgatacctcatggtatctactcaagtaccgtagaattactctttagaaaaactagaaaatcaaaagattttccacggtctttcaataattttatgaaatacaacgtaattatgacaattgaattggcattgcaggctttaaataataaatatataatatacatgtacttaattcatgacaactgcaggctagcttaaaaaatgtaaagtgtttggttatgagtacataatttctagcattaaactataaaatgtatagaaagatattaaaattatggaagcaactataatacatcacataataaaaaaatgatgaagaaatcatactttttcagatgcaaccaataatgcatatgcccgcgtgaatgcgcgggctacctttctagttaatttaattgcattttgccaattctctaacttaaactctgagagtgagagccatgttgtggaacttcttgaggtgttgtgtcatcattaaattgacaaatttccatctttaagtgggcatacgttgtttcacttattgtttgccaaaagacagggctttggtaccttcttgaagacaaccaattgcatggagtggtctagtgctgacaggatgcaaatcatttgaaacattccccatctcaaatcacatgacatctttcaactggaaggccatattacatttgcctccatctaagtcaatacatcttgtaattattctacagttttttcttctttcaactgatcaattgatcattgaagcttgtcttttccacccatctgattaagtacatcaaaattaactagtcatacaattttagaccatcaccgacatcctcgcaatgcctgacatgccttagaacggcaccaaggtccccatccttcttggccctgcagtcatagctcggtggagcatggaagcacggctccatcgacgttgtctggatgcagggcgggttagccgacgctgtccgattcgtgggcgttagcaacagccagggctttaccccggcgaggccatggccgacgtacccaaccgtcgaccgcccgctgaccaccgacacgtcgcagtagctctggaggaacatctccaccagcgccttctggttgggtgcctgcttaccggcgccggccggctgcagcacgctgacaggctcgccggtcaccgtcgcgtgctcgtagtacatcgccttcagcttctcggcgtactccgacggctgcgccgagctgacgagcacggccttcgacgccgtggtggctagcgccgcctcgttagcgctcgacgtcgcgtttgggtcgatctccggcagaatcttctcctgactcgtgcaagcgacgatctgcttgaagtactcctccgacgacaccttgctcccggcgaaggtcgtgatctgaatgccaatattttcttcaaacttggccatgtacgacgtgtggtacctcgtgatgagctcccacaccttgttggaagggtggaacaggtacctcccgatatggtggaacaccgtgtccctcgccgggaacatccaccggagctcgtcctcgaactgcggcaccaggaacagccccggcgtgaagtagagattggagcgcagtatcagccagttcaccttcgccagcacggtctggtcgtcgtcgcagaagaagagctggtccgactgctggtagtcgtgctccagatggacgtacgcgtacgacggcagcgactcggaccgcacgccggcggggtcgtcggtcttgatcttcttagcaccgagcaggttcgcgtagctgtgctcgctgccgcggccgagctgcgtcaggttgtggacgaggaaacccgcggggagctcccacgatgcggccgggaagggctcgcagaagagtccggccatgtcgtcggtgacgtgcaccacgaacacgcggtgggtgaggagcgcgtagaggaaggcggacgccatggagagcatgcggtcgccgaggtggctgccgccgcacggcgtccagacgaggtaggtgcactcgacgaggcccatgctgtaggcggaggtgagctgcatcagggacttcttgtagaagagcgtgccgggcccgcacttgcggtggagcgcctcgtacttgcgcagccgggagacgaggtacggcgacggcgagtgcggcgacggcttgcggtggagcgacgacttgtaccggctcaggcacgcgctctcgccgatgtccggcgagagcagcccgccgaggagcctgtcccggttcgccggggaggattccggcggcgtccctgctggatcctctgcattgaccaagaaaccagtgaactaatcgcgtagtgacgtcacaggaagatcaacgttgagtgctgctgctcaccgtcgtggacggtcaccgtgacgcccatctgcgacacgtcggacaaggtcggccgcgctcgtgacagcgcgaggaagagcgggagagcggcgaagcagaggacgacgagcagcgcgacgggccacacgccgctcgtcttggacggcaaaggcggcggccggcggtgcggccgcgtcggcttactgtccattttaatcaaccctccacttcgtctccgccgtgaaagattttgcagcttcggtgcacgagctgggcagagatcagattgactccaatgcagatgcagccgatctgctactgctggggtttgcacttggcgagttgaccacttgggctctcacctttttgccgctcgaagtaatggccttgcgtaagatgcaaacttccattgttgactcgcctaattgatctcggtccaaagacggtgaataatctaacccaactaagcaacaagaacagcccaggtaagttcacttacggcccataactcaaattcgtttgacttaggtgactcgcttaatggatctcggcccaacgcatttcagcctttctgttcaggactgcatagcctgaaggaaatccaggcccttcatagtaggtacaagtacaactcggcctcttaatttcaggcctaatatcgcaaattcgcaatatttatgttctaccagcaaaaatgtctttgcattctaacaggtaaaaataatttttacgattggcataaaccatgtcaatttaaaccacaaatcgaaacaagacaaacaaaacaatagcaaaacaaaatcagaaatcatatagcatgaaacccgattacgcgcgcttcaaaatatataaactaggattgaatcagatacaagaatctgactaggattatatataagggaggaattttaagatgcacttggttttaactccaaggttttatgttaaatttttaacacatttataatttcttcttgaaaaagagttttgaggaatgtccctctgggcattaaaaaaaaaagggatgtccctccctccaaatcttttttttatatataagggaggaattttcaggcagatcatgtcaaatgcgccgttcagctggggaccgctgattacgacgggatcaggtccggtaccaatcattgccatgttgaacaaaatttccgtgtacagcgtggcagagacacggatcaaactccagctagtttttttttttccccgagagaaaagagagctaagtctgccacgaactgactaatggcagcaaacgttgatccaagcacgtcccacgaccgtgaacatatatatcatatactcctctgtcccataatataagtgattttgagtttttacttataacgtttgaccactcgtcttattcaaaaaattttaaaattattatttattttatttgtgacttattttattatctacagtacttcaagtacaacttttcgttttttatatttagaaaaaaaattgaataagacgaatggtcaaatgttacataaaaaaactcaaaatagggagtgagtatacaccaaccatctagaacaataaaaaaactctgcaaagattcagctagatcagggcatgcaagcaaggcacaaacatccaccacgtccacgcccctacggagagcacgagacgcaacgaatagatcccagcctgactcggtcactcccgtatccaaacgctttccacccaagcagcgcaaaatggcacctcaacctgcattggtactgagtagtaccaccgactaaaagaacgttattataaggcaaaatttgctacagacatccaaaaaaacatgtaattagctggaggacatcgtaaaaacgtgaatttactatagggcatcataaaaaactggtaattgactgctggacactcgcagcattattttattatttttggaggaaaaggagagagagacaatgattaaagacaagtttacccttggctcaaatgactccaatgcagttcccacagagaagtctcctctccctctccttcttcccagacgggccgagtggcggttatgcgagctcacagagacggcatcaaggaaagaagcacggcaggccaggttcctccccgatttttcgatgcgaattgagttgatctgactccgtgcggcatggccattcgcgacatcacccgctgcaggagcgcgccggagaggagggagagcgtgtggagggctgcgatggagttggaagttgcagttggaggtagggcggcgtcggagtggtgatgtgaggcctcgctgatccggcgccggtgcggtgtaccagacgtcggcttgcagctgccgccacgctaggctaacccatgcccgacgcctgtgctactgcgcccggctgtcgtgccgcaccgccccgcgccagtcgcctcccgctcaaaagaaaaaaattcaaagggtagaaccgtatttacacaactgttctctctccttttcctctaaaaaataataaaataatattgtgggtgtccagcagccaattaccagttttttacgatgccctatagcaaattcacgtttttacggtgtcctccaactaattatacgttttttgatgtcctgtagcaaattttgtcttattataaagaggttttttactgtccttgaggttgtgcagtaccaaatcctgactgttgatctggcatcatccaacggtggtacagcacctcctcattgaagcggtaccgtgggtgaaagggtacttctgtactttcgcgtgggcatctctttctttcgcgttcggcttccttccctgtttcacgagagaaaaaaatcgttggggaagagcagcgagagatggcggcaagaggcaggggcagcgagagattgcggcgacggcgagggcctcgatgtgcaacggcagcggcgcggcggcctcgatgcgcctcgatatgcgacggcagcggcatggcggcctcgatgcgcgatggcggcggcagcggcggcctctcttttcctcctttctgctgtgaattttgttgacggcggcggcaacgacggcctgtctcttcctcctttctgctgtgaattttgttgttggatttgctgaaccaaatgtaaatggctaaatggttgattaccagcttactcttgaattgcaagtttcgtattgatgaactaaaataacaaggttcagaaattggatctgctgtaaatagtatcgattcatgagaaagtctcgtgtactttgagttacgcattgtttttttcctcctgaatccttcctctattcatattaaagttacaaactcaaattgggaatctcctcctggtatttctctgttcagattaaagcagcaaactcaaattgggtgcctccgagcaaggcaggctcgatgcacgatggcagcggcacggcggcctcgatgcgcgacggcatcagcaggctcgatgcacgacggcggcaacagcctcgatgcgtgacggcagcgtggcggcctcgatgcgcgacggtggcggcggcgcggcggcctcgatgcacgacggcggcaacaacctcgatgcgagacggcggcgcgatggcctcgatgggcgacggcggcagatggaagagaggagacctcatttttgttagcccgatcatacccctgttaaaccaacggttagattagattggtacctcgtgatacctctttaaggatgggaaaaatgctctattataaaagatgcttgtttcatctcaaatcataggttaatcattgtgtcatgtactgcaagcctccaaatttgcaatgcagctcccttgtcttagaagaggtcatgcatatgtaatctatacatgtgtgccaccaagagctgatgagtagtagaaaattcatagagaaaaataatgaacttctgaagaaactgccacccaaacaaaacaaagcagaagtctcaactctcaagccggcaacgagccaacgaccatctcattgcggttgcaccttcctcctcctccaatgatccccctctccctcctcgccgtcgtcctcgtcttcggcatcgccggcgccgccgatggcctttcaggtgatgaacgcttttgccctcggtgagttcacaacgtgcaatgtgcttgggcagttgatgaacattgtccgcgtttgtacacagggtaccagataagttgcggtgcgacgtcggagaaggtggtcggcgacgtgacatgggttcccgacggccggttcgtcagcgtcggcaacgtctccgacgtgcggtcgccgggggtgctgccggtgctctcctcgctccggtacttccccgacacgtcggcgaggaagtactgctacgtggtgcccgcggagaggaagaggaagtacctcgtccgtacgacgtacttctacggcgggttcgacggcggcagcgcgccgccggtgttcgaccagatcatcgagggcacgcggtggagcgaggtggacacggcgggggactacgccaggggcctcgccacgtactatgaggccgtcgtgctcgccaccgagaaggaggtcagcgtgtgcctcgccaggaacgccgccaccaagtccagccccttcatctccgcgcttgaggtgtcgccattggaggactcggtgtacaactccaccgacttcgagtcctacgctctcagcaccattgcgcgccacagcttcggccacgacggctcagcggccgtcaggtaagaacaatcacgcaccaccgcccatttccttgctacgaattcatggcgtgcttgccgcttgatgctcgtcgaatctgtgattttttttttctagctatccaggcgatcgtttcaaccggttctgggaggcgcacagcgacgggatgccggtggtggagagccaggcgagcgtgtcgcaggcggcgttctggaacaagccaccggaggacgtgttccgccgaggcgtcacgacggccggcggccgcggcgagagcctggagctccagtggccgccggcgccgctccccgccgcgagctactacctggcgctctacttccaggacaaccgcgcgccgggcccgctcagctggagagtgttcgacgtcgccgtcaacggcgagacgttcttcgccggcctgaacgtgtcgacggccgggtcgatgctctacggcgacaagtggccgctctccgggcggacaaagatcacgctgacgcctgcgccaggctcgccggtcgggccggtgatcaacgccgccgagctgatgatggttgtgccactcggagggaggacacatcccagagatggtaacttgacaaaatctcatggatcatgccgaattcgtggtttgctcatcgaaatttattcatgtctcattgtctcgtgttgctgcagtgatcggcatgcaggcgctagccagaggtttcgacaacccaccggctgactgggccggcgatccatgtttgcctcaggggaactcatggactggtgtcacctgcacccaagaaccacttgctcgagtggtttctctgtaagttactgattgccatatgtactatatgcatcaatgcctgcaaaaggggcagtatgttctcttgttgatctctgaaaccgaaatggtggcaatcacacggcaggaatctcacgaattttaaagttgggggatcaatatctgacggcattgccaacctgacagcgatctcaagcatgtaagcctccttaaacaagctaatgccagactcccattctttaattgtcctgctgacagattggaaaaagattgcagtggtaaagtaaatattgattgcctaatttgggtacggtgattgcagttggcttgtgggaaacaatctgaccggaccaattccagatatgagcctcctacatcatttggtttctctgtaagcacagtagctacatactgctcaataattgttttggagaatgcttcagtaaactgaagatcacctggctaaatttcttaactgaaggcatctggagaacaaccgactgacagggcagattcctccatctctagggagcatgccaaggcttcgtgaattgtaagtggcttcaacaagtagtttatactagtcaagtatttgagttcatcgacttgttatgaccgcttgagttttttgcttgacaggtttgtgcagaacaatgcactgcaaggggcgattccgatcagcttcaagaacaaaacgggcttcatgttccagtgagtgatcacgagtgctgtatttaagcttgtgattccttatttttctttagtgactgatgaaatgaaaataatcttgctctgacagatatgcacctgggaataaccttagctaacacaaattcaacgagtataagcttgttcaggttgagatcatccggtgttcatgagatgaagaaaagagacattaaccgttgacgacacgctggaacacattaattaaacaccattttttcccttttattttgtttctttttgccgttcgattctatccgtatttttgttcctcctttcctttctttttggcaaacatgaggtgatcctgaatgtatttaaccctgcaactgtgtggtacctgattcaatttatttgtatgtatatttttaattactactaccttcattgtcaaatagatgccgtcccagtcagacagaaaatttgcatgattaattaacgaagaaatgtcagaattttccatcagaatgatattggtaaattttttcatgaaaatcatttcatataattattcttttaatagcaaaacatgtagttagaaaaaaaagatgaaacatgtgtaacgaaaatgatgtcgatgtctaaacgacaagtactttgaaaatgagagttgtctttctatcctcttctttacacgtcaatgcctgctactgcaccaacaataccagagaggatctgcatttatttacgtgcacaaccaccaacccgataaaattatagaaactaagtaatagaaaaaatttatgctcgaccccatgctccaaacccaatcacatggacccattaaaaagtccacattctattccattttcagtcgcataggtctataaataaaatttaatctctatacactttaatcttcgttgcaatgtatgggtatctctatctggaaaaacagtgagttcgaaaactgaatattttagttcctcactagcctttgtagcaaaaaaatgcattaaattgcggatcctacaaaccggcccagaacagttgggcagcccacgaagtcaccaactgacagcccagcccattaacgcctccaatatcaagatatctcccaatttccttttttttttctttattattatctgtagattccggcacatccttcgtcgcgctcgtcgccacatcgcttgcttccccgtcactcccactatttcccactcgtcgccggcggcgagcgagcgagcgatgatctccgcgtcccggacgcaaaccccgctcccatctccatgactcccgcgaaccccaccccgctcctctcctccccacgccccaacccttccctccccctcccccgccgcgcccggcgcccccacccgccgccggcggccaacaccaccggcgcggcctccacgccggactggttccggcctagggcgccgcccgacgcggacccgtcgacatccggcggccgcgtcgccgcccgggatcccggggtgcgcgtcagggccagggagggcgcggaggaggagaagaaggggaggggaagggggaggaggagatggtgggactggtggtccggggacagggagagctacctcgtcgacgacgtggagccgctgccgctgccgttgaccgttccggacaccgagccgatgtcccgcgaggagctcgaccgccgcctcagctgcgacgtggagatcgaggtgggtgcggttgcggtgggatcctaagagtttttcacttctttggtgattcggagggaaaatttggtgacgatttcggagtatgtgtttgtgtggatttgggtttgaaggattgcaagactgtctcctacgagtggacgggcaagtgccggagttgccaggggacagggctggtgagctatttcaggaagaaggggagggagaccatctgcaaatgcgtgccatgcgctggcattggtgagatcccttgctcgcattcccagtatcgatcgaattgctctcatttgtaggtgatcggaaatagggaatggggatattacatgtatccagatcttcttgctaggaattgctattgtgaactggaaagggtgtaggttgccttcagtttaggggtggcacttggttatcattagatacagtgtagttttgatgagttctttagtttagacagataatttaccattcagccttggtctgcagttaggatgttataaaatgatttgcattagtatgtactgaacatttcatgtcaaacctgtaagtgcagcttttgcccccttttattcaaagaaggctgcaaataccactgatagtactaaatatccagtaaatattgtgcacataacccttggtgctaaaaccttgcacagaaaaggagattttgctcagagatgccatttctctttattgctcttcctattgttgttaagttgagcaattagtctcgattagtcggtgattgtcagcccacacgaccagaagcccacaactcaaacaaatataaagtcgcatgactagctcgacttatcagcgactttcagtgattagttggtgctcagatcgatgtgaaagcatgaacatgatagcactcctgctccacctcatgtagtgcctataataattaatagcctgccatgtaggatcaaacctaatgtggcaagagagttaacgaagtgtgtgagagagaatccatgtcttgcatgagacactacccaaggcaaataaaccaacacatcaagaaacaaacaaaatagcattaggggttgaggtagtgtctgtggcacaaaacgagaggcaaatcaacaaataagagggagagacgatgagagtaatttactatttgcattgatctcacacatagaaactatgcattggacaaatagtattttatagcagtgtccatatggcatgaagtggcatagatgtctagcattaggaatgccttgacagctgaatccaaattaagcatgctaattgcagatgctagcaacaatgatgaaagtttattttaacaatcaaggatagtaaatcaaatatcttgtgtggaatgaactactgataaaattgtatacagtgcctcagttatgtagctcctgaaatgctgcagatgaataatgggataacggaacctagaattcaatgctttagaaatgttcaggaatagctgaaaaagagtgttgtttactgttggaatgttttcctctatgctactgagttcagttacctgagcttttctaagtacattggaactgatctaatatgactaaaattgccatgatatgctaccgaagtcaacagtaaagatatgatactatcatcgaacaaaataatccctgaaaaaatctaataacaagcaacgctagttcttcaatctgacctgatagataatacccctgatagaaattggcatagcatgtgcaggtacgtgtgtgttgggcacttaacgttattcctttgtccaacagatgagaactagatatttagatagttagctgctgccaaaatttccaggacttttgacatggaaaagtaaatagatttagatnnnnnnnnnnnnnnnnnnnnnnnnggatttctgccatagtaaagtaagtagcttgagacaattagatattccaatcgagctcgtgagattaacttttgttgataactgagatctttctaaataccatgctaatttattttgattcctttctactgccttaactcttcattactcctggcaaacttttacctgttgatttgctgttatgacacttggatgggtgttctacttattctgtaggttatgttcggaaaatcacatttcgccaggacattgaaaacatggatgagttagacaatgggaaaccaccatagtttgatggccctgttcgcttggcagctgtcatttattaactgctgctggatagattgtgttcacaacttggacgatttaaccagtgattctttctgttacagtcaggcacggtacatgatgaggtgccatttttaagtgttgtaaaccattatctgctaataattgtactcctttgttcttatcattatagttgataaagaaaaggaaagaaattatttcaagtcagctttggttctgttctacacttctacatctctttctctttccttatcccaagcggctatactagattcttactttgcatgttgtctggcccatcttttgcccttctttctggtttgaggtagcctattctgcaagttctggaggaatcacatattctgaaactttctgcagctgtcaggcatatattctatatatgcaccttagccatgtttaggacaaggaacctatgaacttccatgacgggcaatcaggagctcatttaggcgtatcaatcatccgtagctgcagcaaatcaaatccaaaatgtctcatctgagccttttgaccttcaagtacaatcttgagaagctcaagtccaaggccgcaggccggccaaccggccggctgctgtccggcggggaccggcagttctccgacttgacgaggatctacaagcctgacgacgacgagatgaagaaagtgttcaacaagatcgccggcgagcacgaccggatcaccaggaaggatctgaaggggctcctggagaagttcgggaaagccgacgccgcggccgaggcgaggcggatgatctgcgtcgccgacttcaagaagaacggctacatggacttcgaagagttcatggaggtgcacaagagcggcgtgccgctgggggacatgcgccgggcgttcttcgtgttcgaccaggacggcgacggaaggatcagcgccgaggaggtgatgcaggtgctgca

SEQ ID NO: 61130 - DNA, 1291 bp, Oryza sativa
ttctttgttccaagttcctacgagcagttgtgcttcctagttgcatttatttttaccttgaaacattgttagtactcccttcatcccacccactaagacactaagggtctgtttgacacagctccagctccacccctcctgagctggagcttagccaaacagtttcagctccatcaaaattgggagtggagttgggtggaactctgtcacaaaatatacgagttgtggagctgggtttagacagctccacaactccactccagactcaactcctggagttatatttaggagttggagctgtaccaaacatgccctaagatgtactccctccgtttcaaaatatttgacaccgtttcaaaatatttgacaccattaactttttagtacgtgtttgaccattcgttttattcaaaaaatttaagtaattatttattcttttcatatcatttgatttattgttaaatatactttcatgtacacatatagttttacatatttcacaaatttttttaataagacgaacggtcaaacatgtgctaaaaagtcaacggtgttaaacattttgaaacggagagagtatgtgtattttaatagtcaactctttaaatatttaactaataaatattttattataaattatattttatttgatgaaaattatatcattggattgttatttaatttacctttaaatgattatgattctattgctaaaaaaatgtagtatataagaaatttaaatataaagattagttttaaagtctgtgttaagtttaatcgtgttttattgagttggagggatggagtacttgttaaaatactggtaagtcaatgctgtttttagctacatccaccagcctcgttgaatgttgatccaaacagttgttctgttccattttatatattactctctccgtccctcagtagatcggatcagagttgagatttcacaaaagaataccttacgattggggaaagtaggaagcggtttgggcatgcgctgcacatgtgagcagttgtcagttgagcaccatgtttatgatgataagctcggacgtactttcttagtcccaaaataaaaatcaataaagatgtaacatatttcagtactgagaatcttcacgtggagatgttaagcaccataaatctagacagatttgtgatagttgtacgagataatctcttatatgccactgaaaattggtctgattccttatatgccactgaaaattggctcttcccttatataccattggtctaaatttgtgcaccatctcatgccactaccatc

SEQ ID NO: 61131 - DNA, 597 bp, Oryza sativa
cccccatagttcattttctaggagtagatctgctagctccactccaaaaaatggaggatctggaccgtttggcacagccccggctccaggtaagttggagttgggagctagagctgtgccaaacagggccctgcctaagagacagagcggctgtatgcctatatcagtgtaggataacaattgaagcgaagttgttacttatcgtacgtgcatacacatttgtgtttacagttatcctcactgaactctaagatggcagcatttatggatatgtggttgccagggctgctttgagattcttcaactgactggctcctttacaattgcggaggaaggcgttcggaggagaaccggcgggctcagtgtctcgcttgccggccctgatggccgtgttgtcggcggtgtagtagctgggatgctgcgagccgccagccctattcaggtaaagaaacaacaacaacaactgaagaacctggacaaaattaatcgatttttcgataacgtaattcagtcgaaccaagtaccatgcttttacaactgaagatagagaacttcgttgttaactctgtcactcatgcatggtagactctgtagcca

SEQ ID NO: 61132 - DNA, 2099 bp, Oryza sativa
tttcctctgacttctctcaattagatcaaacagtaccatgactcgtgtgcttctcacaaccattgttcctaaaatatccatcttttaatccaccttgagcttagatgcttctcataatcagtgccccatgaaaaccatgtaacctaccgagactggctaactgatatgtttagttttgattgaatacccttttaattgtgtgatattttggtactgcagaaacctatcgtggatttggctgatgaattcgaaaacaataccataaaaaaaaagatcacggtatgttcatatattgtgcacattattttttgtcagtatacatttaactattctgctaacttgaaattctatacacagcttcttagcgaaaaatacgatttcttcagaccagttgacagagatggcagttgcttttatcgagctttcattttcagttacatggtaaatatttcggcccgcttgttcaaactatgctttgttcttgtttgttagacactaaagctcattggtgtacaaacaggagcgtattgtagcaatgcaggatgacttggagcgcattattgaagtttcccgtatcggagaacgtattggaaaatacaagcaagcttatgcaagatttggttcttttggaatacctcaagaagaattcttgaaagctctttctgtacgtacttttagttctcagttttcaacattcaccagtacaatttgcccagtgtgggacattcttttcacattttatattattgatcacaccttcactcttttaatcttgcaagtgcacacttcattgagtttgaatagtaactgccgatgtcctttggccccatttctattgaactgattattttgattagctttatagttcattttggaagtcatttggggcaaaatgttttctgtagtcaatggtacggcacatcacaaatgagctaagcttgtaaatcgttatgtgatttccatgtctgctcaggttaaattaacctgcgctttgctaacagctctggtttgctatgcttgctgatagttatgatttgtagcatttggttttctttataatttatagcccagaatcactgaatttgctgaatttctttgttgcaggcatttgaacaattgatcaacttaattgaaaaggggtatggctaattagcatcctgttggttttcaagttatgtttaggaatgatatgaagatattgtttcttgttatatcttagctgacaaacactgtttgtatttcatagtgttgctgttgaacaactatatcagatagatgagactgacatcacaaaaaacagtgaggatacttgatgattgctagactgtttttccttgttactcatctgtttcactgcatgatttttttttccctgtttaggtttacgcttccttaggtttctgactgagattgagatctgcacacatgaggaccactacaagggttttcttctaacagcagattattcatctgtttttgaggtagaagaattgtgacttcctagcctactaccacccacccatacttcattaccaatattttgctgcatgtgtagtgctttagatggttgttgctaattacgtaatattttggaatctaataagaaaaaaactccttaatttgtaatctaataagaaaaaaaaaactccttgaattatgcttctaatgtaccagatgttaaaatttctaaacaatgctaggattttctttttctttacaggctcatttgatcccacaaagtccaaacagtaggcagaatggattatctttttgtttgatttattggcccctattacagttcaaagtccaaacaatttgctatatgctccttttgactctttgttttagttgttgaagttaccccactttgaaaagatgttgaagttacataaaccacaaagtcaaacataggacataagcgggaagatattatattggatgaatctatttatattaataggtttttcttcgcctagcttctattccttctgtatacaagatttaccagcaaaaggaaaaaaaatatttaggcaattagcatttacttgtgctttgtttcgtcaaacagttttgccaggttgaagtgcgacctgagaatg

SEQ ID NO: 61133 - DNA, 3815 bp, Oryza sativa
ggtgatcatgcagatcgctgaactgacacgtagaggacaaaaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaagaaaagggtacatgtggtatccccttaagatataaaaggaggaccatgcccacaaagagagggggctggattttcccgggagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagagagagcttgagatctcaccctaagcccccggccgaactggcaaaggggggcctgcgcggtctcccggtgaggagccccgagctccgtcatactcaatgatgtaaaatagcattgaggtagaggtggataatgcagaatgcatatatcgtgcacattctctctatatcctttaaaataaaggattttataaatagattgtattttcttaataaagtctgcttggtattgattgaggcaattaacattacaaagagactcacaattttaactcagggcagaaagagtgattagctttgtttaattttagacgataagatgatattggtttatttttaatatgaaatcatatgaaaatttaagcaccctctgactatacatactccctccgtcccaaaaaaaaaggcaaaccctgagtttctgtgtccaactttgactgtccgtcttatatgaaatttttttataattcatattttcattgttgttaaatgataaaatatgattaatattttatgcatgacttgtctttttaatttttttcataattttttcaaataagacgaatggtcaaaccttggacacggaaatcagggtttgtctttttttgggacggagggagtacattatcggaaataataaaaacaaaaacaactgcatagaaaaatatttaggagagtttccaaaatccaaacactcaatgatagattgatgacacgcaaacatatagaaggggaaaaaagaaaaatgtatatattagaaggtaggcacaagtatgatccacaaaaacaagataaaaataacctccaaattagaatcaggaataaatttatgtaaccaatcacatgtgatttcatatggtgtttttaattagaaaaagaacaccttaaataaataaagtagatactaaaggagaaaatgactaattggatattttccttaggaaacctcgagagaccagacgatgtcggttcacctcccttggaaattttcatcctcacccctcacagctataaaagcctagccctccgcccctcgggcccctcacgaacacccgcatccgcaattactcacaaagcgagggggcaaaccgagagaactcgcgagagaagggtaaaaaggtctcttcccaagaagaagtcatgcggcgtaagcccgccgcccggagggtggttggggaagcgacgccgaccccgactccgggagctccggcaatggcggtggcggaggttcgccgccgtcgtcgccgtcgccgccttcgccgccttcgccgcagccgctgctgccgacgttgccctcaccgcaggccttcgtggacgcgtacaccggctatgaggttagggttattgaatcgcgtctcgtgctcttccccccccctcccccccccctctcccatttcctgtgttgtcttcgggaacacaccccgcatcgaggttttttttttctggtgatctttgcgttaacgagttggtgggaactggtggggtttttctcgttgcgatgcgaggcttgttgagttttcccaacgcgcggctcggctgctcttgcggtgaaattttggttgggagtagtcctgcggggagcagcggggatgggttttttggggtttattgggtagtttctttgaattgatcggttgttgtttaccgtgtgtttcttgtcttctggttcttggattctaatctgtttgtcggattagtttcgtggggttttgtaccatttgttcttggatttttttccccctctctcagctctgcctctgctgcttcggcttcaccataccgctccttgtgcattggattgtttcttgaaggttttaatcgagtttcaaggtagttcttggtctctatctagtttgattgtcttgacataggcaagaattagggcatttctttctttaacctttgagtttgacgaattgcatctccccactcttgcttgcatgattctggacttgatacttcagacaggtggaattaatgtcagaaaataatacgatctgcttctgctgcttgcgtgttggtttctggtcgatttctctatgttttcagcgacccaaatagataactcagtgtcctaatttagacttctgatagctttgctgcctgtgagttttgatcttgttacttgtatatactattgtgaccgtaatattggattctattgtgatcgtaatgttgcctagtactgtgaaaatgtttgaaagtactacctcaggatttagatcacgtggttttattactgaggatcacatggttttattgaattacaggatcagggagcatgggaccccgattccttgtctctagagttgggacttgcaacgttacgagagttggaatgtatcagatatcaggtgtgaacatcatcaacacagcacaagactgtaaattcactagcagactaactagatttacccaaacatcaattttgaagctaatttttgcattttgtccgttcgtctgcggagcataagctgaccatcccattgccgtgaattttctttaggaagcacaagaagactggagaaagagtgatgataacaagtctgattcctgcaagcaaaaagataaggtgtgaaagttctctttctatttcatcgaacttgctttgcatggctacatggacctgagcttgactaattgcatcttttttcccctcttgcttctggacttggtacttcagataagtaagaaaaagataatgtagaaaagtgatcatctgttaccgctactcgcgtgttggtttctggtcgatttctctatgttttcagcaacccaaacagacaacttagcgtcctaatctagacttctaatagctttgctgcctgcaccttgtactggagagacttctgatagctttgctgcctgtgagttttgatcttgttaccggtttactattgtgatcttaatattggatttttgtgatcgaaacgggcaactttttagcacatgcctagtactgtgaaaatgtttgaaagtactacttcaggatttagatcacgtggttttattactgaggatcacatggttttattgaattacaggagcaggaagcatgggatcccgattccttgtctctagagttgggacttgcaccgttacaagagttggaatggatcagatatcaggtgtgaacatcatgaacacgtcacaagactgtaaattcactagcaggctaactagatttacctaaacatcaattttttgaagctaattttgcgtttgttcgttcatctgcaaaccataatctgaccatcccattgctgtgaactttcttaaggaagcacaagaagactggagaaggagtgatgataacaagtctgattcctgcaagctaagagataaggtgtgaaagttctctttcca

SEQ ID NO: 61134 - DNA, 2942 bp, Oryza sativa
ctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgctgtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagccgccccggaggttgtcgcctgagcgtcacccgagggagtgggcccgagcgacgcgccggcggtcttgtcgtaaaccgcctcgaaagacgccatcgcctctgcctggcgagcccgggcggtttcctcccgggtgacttcttcagcctgacgagcccgggcggcctcctcccgagcggcttcttcagcttggcgagcccgggcggtttcccgggcggcctcttcagcttcccgaaggcgatctgcggcctctcgccggtcagattctcgcctccgttcctctgcggccgccggatcttcggcttcggattggccggacttgggatggcgggaggaacgcgacgggacatcactgaagcagaaagaaaaaccagaaggcaaacaggatgggtaagaagaaacttgcttttggaatagaagaaaagacggtcgcaatgagcatgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctgagattcagcaccctttggaccacgatcttgaagtcatcgggagcccaatcccgtctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggagccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcccggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggttttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcggg
